United States Patent 7,745,391 (HUMAN THROMBOSPONDIN POLYPEPTIDE) - sequence listing, part 50

SEQ ID NO: 139093 - DNA, 557 bp, Homo sapiens
gcatactaccaccattgcaggtgagttctcatcacagagcctcaccataatggaaactgccgtgacttcagatgagctctcatcacagagccctttaagcagccagggttgggggacttggtgaaaacatccaggggagaactgacctaaggacttggacaggggtggctgtggccattttttctctccctcagaggtggttttgaatgtggaatggaggagtctacccctgggtaaataaatatacataggtatgtcatatgtatctgtatttatatttattggcctttctcagggctgttgactcacaggaactcaggagctggagaggcagcagttttggtgagggaggttgagggtggaggtgagatgagggtagactgaccaggctacttagacttctccaccgtctccctcatcccacattattttcttccctgggtccatgacccccaaccctccatcctcaaggaaacttgagcctgcctttgccttgctttgaaccctgagcaacgggctccccatgggtcatggctgtgactgcaaactgtgtttga

SEQ ID NO: 139094 - DNA, 296 bp, Homo sapiens
gtacttactggatttagatcaactacacagcaacacgtttggattctaccataatgtacttaacagcaatcatctatgtgtcttttctaaaccccacacttactagtcgaatattttttccttttgttgtaaatttccacaaagattcaactgctctcttgaaagcaaatcattgatgtatgtatgggcagatgaaaaattaggcaggctaagaggtaaccctcctgcacattaaaaaatccattctgtagccagcaggcaggaatttccgcgggggtacccgagcttcgcaaatt

SEQ ID NO: 139095 - DNA, 108 bp, Homo sapiens
cagctctgtatgccagaagagagtggagtgattgctgtaatctcaaggatagtaaatatgagctaaagattttatatcatatagtaaatacatgctaaagattttata

SEQ ID NO: 139096 - DNA, 256 bp, Homo sapiens
acttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttcc

SEQ ID NO: 139097 - DNA, 371 bp, Homo sapiens
aaggtgagtaaatgactaactaaatttttgttcctacttatttttttttcccattacacttggagcatttggaaatgttcccaaattaataacttgaagctgccaagaagtagatataaccaataccttagctcaggcatcatgtttgcatgattttgccattcatccatcattcagcaaaacttctttgaactaccatgtgctgagtacagttgatttccagccctcctaagttcctgtgtcatcctgggttacatgggttattaaactgtttctctccatctttctcatatatcagcttctaagccttcactctgtgctcagatcgtttcctatcttttctgtttcttcattgagtggaacaaacacca

SEQ ID NO: 139098 - DNA, 416 bp, Homo sapiens
cagaaagattctgaattttcgagggagacgcagcgccatctgttggacactctgtgaattactaactggctggaaatgatgctgtgtctgtggatgacgtctttgtgaagccgggtttttttgggtgcagtgatacaaagcaccacaaggaaaaccagtgtggaacaggaaatgagggtgtcactgtccactctgatttcaaggtctgagataccatgcagtgcccaataggtgcacacgaggcattagtaattgcaattatttttttaaaaattaatttatgtgtattatctgtgaacagctactaagttcttaggacattcgtactcactaagttattcagatctacttaatgagcagaactgttaactgtttccttttggctgcagaaaaaaaaatgactgagacactaaggg

SEQ ID NO: 139099 - DNA, 301 bp, Homo sapiens
cgggcaataccacaatatggtaagtgctaagagatttagctacagagtgctttgggagtggagatctaacccagcctaagggatcagaagacttctcagagatgatgatatctaaggtatatcctgtgggatgagtgaaacccagctgagtacaacaggaggtgagcagtgagatgctggggcaagaacttccacgcacacagaagagcacgtcgtggcaagtggaagaggggacaggcttcggctaactcattgacacacccagaactcatgccaggcacttggggctcaggaggtgctg

SEQ ID NO: 139100 - DNA, 371 bp, Homo sapiens
ccaatgaagtgacaaagctaataaacttattttctgggtagaaagcatatttatattttatttacagaataaatattaccagtacagaaggtaatattactgaaattaaattcattcatgtcctccatgaggacaacataaaagtagctaccactgatacccacttagtacgttatatcaaccctgagaccaatattattatgttttaaaagtgaggaaactggccgggcttggtggctcacgcctgtaatcccagcactttgggaggccgaggtgggcggatcacttgaggtcaggagttcaagaccagcctggccaacatggtgaaaccccatctctaccaaaaatacaaaaattagctgggcgtggtg

SEQ ID NO: 139101 - DNA, 107 bp, Homo sapiens
tggaaatggcaccggacacagataacaccactgggagctgaagaacaatgccttcagaagtgggaggagtggaaaattattctcagtgtagaattctcttcccaaac

SEQ ID NO: 139102 - DNA, 222 bp, Homo sapiens
ggggcatcggggcacctgtccacctgggaggtgggggtcagaggcccagcgctggtcccagggctgttttctggtggtgagacctggagtccaggggctttgatgtgagtgtgagcaagagggagtgggcagctggccaggccactgcttccatcatgcctggaccgtggcaccttcctcctcccaccgtcagcccgtgtggcaggagactcaagctgtgag

SEQ ID NO: 139103 - DNA, 791 bp, Homo sapiens
tcaagaacgaaggtaaaatagccaacgataccagcaatatttgttgatctgcttttcaggcaattaaaaaaaagacagaaacagatacacaaaaggccatcattgagtttctatggcagtgtaaaataccagacattaagcacaaacaattgcaaattcataaccgactggtgcaactaagaaacctgtgacgctagaaggccagggaaaaatttgacctgttctaggctggcccaaaaggcctccccaagaagtggagatttgacagagctgagatctcacggatcagtaagagttaagtgggatgagagagatggggcgttccatcaaaggcctctgtgggcaggaggatgtgctattttcaaagaactgaaaggcccaacgtggttgaaatgagagtaagagcttctgagagttcagtgtgtggatgaagaggcaacaggaaaaagagcactgaggccctctaaacatgttcagaatgtttgtgtctttaccttaacatataatgcaaggccagtacctcacatggtgcctatctcatagcaggcatacaagaaatacatggtaaaacggaagtggttataggagaggaagctagagatgtgggctggagctgggtttccaagaaccttgtagaacaggctaaggagtttgaacagccaggcgcggtggctcatgcctataatcccagcactttgggaagctgaggtgggcggatcacttgaggtcaggagttcgagaccagcctgactaacatggtgaaaccccgtctctactaaaaatacaataat

SEQ ID NO: 139104 - DNA, 544 bp, Homo sapiens
aataaaacacaagaaagacaattaaaaacaaaaatcacttatctttccatgatctagaaataaaatttcatgagtaatctgtcatttttaatgaatcaatgtcaataagtctttataaatacacacaaacatgcacacacaacactgtggtctaattccacatagcttaacactaacaaaaattgtgtaagttagttttttataaccctgtgggagggttctgggaacaaataggaaacatgcaatatgaacatgtattcttccccctccacctctaatcccagcctcaatcaacctacttcccctgagccttatggtagtttgtgccttttgtcaatgagtataggcaagtgaaacctagattttattggagttacataaagagggctagcaattgaaagccttaaggcagatatgggcgatggagtatcctgggaagttataggttctcagagaattgtagaaactgtagtgacatgaacttgtcttaagatatctggtttctttgagcacaaagtcaatgaacagttgggccaagcctcac

SEQ ID NO: 139105 - DNA, 185 bp, Homo sapiens
gtacatgacgtggcagtgaccggcaggccttcctctccgatgctgggggcagctctcaggtccaggtggtgctgggttctctgggccccgccccccatctcccagggccctgaagatgtaagagctgcatcttttctggggcaggcctcctttgggcccagccctgtgaggcccctctgcctgtg

SEQ ID NO: 139106 - DNA, 415 bp, Homo sapiens
gtttgttattttgctttctaattgttttgttttacatttaagacttcatccgaagttggtattaggcacaataatttacactcattaatattcttccacaatatgcttggggtgctatgcagaaaagagttaatgtcgcaggtctaagattgcctcttcttagataacccgcttgaaaggttggcacttggctggtaaacagttccttagagtgctataaaacttttcataaatgataagagcacagtaggcttgctgtgcctaaactgtttgcacagataatgtgatttatgctgactacctgctttccttttgggagtctagaattttgatacatgcgaggcagagggtacccacaagaccatcccccagtgaaaccttgggagctgagtttcttaagaacatccacggtggg

SEQ ID NO: 139107 - DNA, 358 bp, Homo sapiens
gtgccagcagcgcacacacttttgcaaagaaaaggctttctggtatgaggtaaattctggagacactgggaaagacaaagctgcatcaacttcttgactgcaggatttctagccttcgcggtgtcatatgtggatccctgggtgcattgtgggcactgccacatgagccacacactgccagtcccatgtccctttcagcaaacaaaatgagggagcagtggtagctgatggctggttaaggtgtcctgggtgccagcactgcagaggagccagggtgccccgagatgggtgtgttcctggcatggccttgttcagctttgtgacgctggacaaatcacttggcttctcacagcctcaa

SEQ ID NO: 139108 - DNA, 2339 bp, Homo sapiens
tgaactatagttgattatttttaaagataaggagatcaaatttccttaatatttcagtatgttgctttttgtacccttaaaattattttttcctatgcagaattgactttgattaaaaaatgtttttgatgactattttcctgattcgtcagtatatctaattgtgttcattttactcatgaaaaatcttgtctatgagggacgtatttttagtaacatttttatagcatataagaacttttacagcaaaaacaggaatcattaagtgtgtgtgcttttatcataacttctcttttaatggaacttaaaatcttaactcgtgtttttgcagcactttttttgcacatggtaggttcttaatatttgaatggaattcagtgtgactgttctttgtgttctcaaaagtctgatctttgtaacaatttgtctttcacttgagactttttttttctttgcatatgtgcacgtctcactcttggttttccttaatcttttttaactaaacacatctatgactcatatttccctatttatgaataggagcaatttaaaatttcccaacatggtggtatgtgatgtaacataaccaaaggctacatgtttacccttgtttaattacccttcatttgtggaaagatgacgtatgtatttatgatgtaaatgtctttcagaatgacctttgggactaagcttttttttttttttcccaccaaaaaatggtcatgacctaggaagccttgttagtaaaatttaaaaaggaaaagttggctgggcatggtggctcatgcctgtaatctcaacactctgggaggccgaggtgggtgtatcaattgaggtcagagttcgagaccagcctgggtaacatggtgaaaccccgtttctactaaaaatacaaaaattagctgggcatggtggcctgtgcctgtgatcccagctactcgggaagcagagacatgagaattgcttgaacctaggaggtggaggttgcagtgagtggagattgtgccactgcacgccaacctgggtgacagagcgagacttcatctcaaaaataaaataaaataaaaataaacaggaaaaatctggtcaaatgccccttgttcttcttcaacagatacatagtgagttgtgtaaaaaaggagttggaaaaggaatatgtagattcaaagtgacttaaagaatagaaaaaaaatttgttttaaaaaatggccaagactaaatcatagtgtctagggaggtacacctgaataataaaactataaagaaatacaaaatatgattactactaagaatagtctgttgccagtagtacacagaatgagcactcaaattataacagaagcattttggtattcataaatgttctttttttaaaaaagaacacaatcgaaattataggctgtaagtactgattttaattgtagtgaatgtgaaagtgttgttaatgaaaatataaagaatatttgttaaagtgtggacctagccaggaatactaggtagaaaaggtaactctttaaaaacatttttttaattgtgaagttaatttattgtcactttgtttgatatttattattagagtccctaggttaattctgtttttattgcttttcagaataattaagacctaaatcttctgccgaattctgtttggtttccttatttcttttgccatgttctttcattccacaaatgttattgagcacttccagtgtaccaagccttgtgtttactgctttgatgataaatgcaataaggtaatgctgcttttaaggatccttcaggataggctcttgtagcagtaaggacttagtatttttgctatagaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactgtggaaagcctggtggtggtcctggaaggcttgagaatacctggagctggaagctccttgctcattggtgacctttttcatatgcagcagagctcttggcattcctagcatactaccttgaaaggactgtgtcttgcctcctagaaattctggacttggtagaatcatttgtttatgttattttaaaaagaaaaaaaactctgaaatgtactttttggaagaaaaatgaacttgtttttggacttttctgtgtgttgtttctttaattgaaaattctgtctggagattgattttcaacccccttcctttccctctagttttaaattgtaacattgctttccaagcatttc

SEQ ID NO: 139109 - DNA, 184 bp, Homo sapiens
gaccaaattaaccccaaagactccttccccagcaaagagttgtgaagtaagtcagtaatgtggctaatgaaagaaatattttctgagatgttgtgatctgtcataagaagtgttgattcttgatgacatggaaaatgactaacatcttatttcatgcattccaaagagaaaaacccacagatgt

SEQ ID NO: 139110 - DNA, 678 bp, Homo sapiens
gttccatactatagaaaaatgtaaagttttaaaattatttatccagtggttgcaaaattgaaatcaaaaggggattaagggaagaaaacagatagatacacaaataatataggcattcattctgttaatattgagtaattactgtttgtcagacactgttttaggtatgaggaaatgacagtgagcaatacaaaggccacattctcatggagtaaaattccagaggtggagacatgtaattaatacttaaatataaaacagtagattttctaaacgcagaaaacggaagagtaacaagaaactaaatcaaggagcattatatagcctagactgcagagactcaatataataaagttggcgattcttcctaattatcaaatttactgcaattccagccaaaatgtttcagtggttttttttgtttgttgtttttgtttttgttttgccctttagcttcacaggtttgttctgaaatttatgaggtataaattcttaagagcagcaagaaaaatttcgaatctatttgtagaaactgcatatgatgatggttcataccagtagagagaaagattggatttgggggtattactagtagtaaggggattcactagtagtaagggaaatgcaaaataaaatcacattgaactagttcaaaatcatcacattggcaaaagcatt

SEQ ID NO: 139111 - DNA, 296 bp, Homo sapiens
  misc_feature (222)..(222): n is a, c, g, or t
atccaggggatgtggactggggctgaacctaatgactggctctgagagcagatggccaactctgccacacggggtcctgagcctgtgaaggtctctgagtggtctgcgagttttcgaggttctgcgagtcctggggggtcctgtgggtctctgagtggtctggccctgctcagagacatggtgcttgaggctccgccctcacccaggactttgctccgccanaactgagttgcagctctgtaatcaaagctgaagtccacactgtagtagacgaccaccagaagtgcgcctgggtg

SEQ ID NO: 139112 - DNA, 259 bp, Homo sapiens
tactcttgggcaagtgtgtcacttgtctctacatgtctgacctttcccagcttctaaagtgcaaaaagaaagattggggacatgtccataagaatattcccatatcttcagaaatgcaaaggagaaaaccattaagtctgcaaagtagtgaaatcagaactcatcatggagttacaagttactaacacatttcagtatttctaccctcttgtctatgtacttttcttttggaattccttaagcaataaaacctgacttt

SEQ ID NO: 139113 - DNA, 558 bp, Homo sapiens
agcaggcactattttggtagagatatacaaagtctgggctcagctgaacagacacagggcttttctccattgcttcctgcatgcctttgtccataaaaatgtgcgatcaggcccagcaaggaaccagcagcatttgttgaatataacacatatgtgctttggcagggtgggagctcttgagaaaggaaggtgctctgacttcagatagtgttttctcactcccgaggaagcgagcgcctcaaaatgatttggttctttgtctcgaagtccccccagcatgagcaggttttgtgggagaagactgagcctcggccaggaatcacagccgtgagcctggctctgcgggggtggcagaagggccatttgtcatccccgtgtccaggtcatgtttttcctgtaggagatggctttgttcactcggggaacaggcgcctccccctgtggctggagcctcagcttcatatccatcgttgaacttaggatgacccctccacagggcctgccttctgctcccagccctccgcccctctgtcgctttctttgtttttattataaaag

SEQ ID NO: 139114 - DNA, 283 bp, Homo sapiens
cctctctttgctcatctgttaaaatgcagttagtaacaggcttactgtgaggattaataataataataaggcttactgcatactttgtgtcaggcactgtgcatgttacttggcatgcattatcttatttcctactcacaataactcttcggaatagataccagtactatgcccccactttcttatcagaaaacaggcatagcgagttcgttatccagagtcacacagctggtaagtgaagccagaattcacatctagtcagcccaaactctagcacctgcac

SEQ ID NO: 139115 - DNA, 403 bp, Homo sapiens
ttgggaggaatgtcggggggatggtgcaggaggaggcaacatgccagctctccaaggggagatggaggtttatccactccaggaggagcaaggatggaggatgaacccacagagacacataggcctggggtgaggcagttgggggacctggcacatttattcagtaaggaataacgctttgagtggctggggacggtggctcatgcctgtaatcccagcactttgtgaggccgaggtgggtagatcatgaggtcaggagtttgagaccagcctgtctaatatggtgaaaccccatctctactaaaaatataaaaattagctgggcgcagtggcgggcacctgtaatcccagctacttgggaagctgaggcaggagaacagcttgaaatcaggaggtggaggtt

SEQ ID NO: 139116 - DNA, 521 bp, Homo sapiens
tggaacattgaaataaagaataatagtattatactagaaagggtgaattctaaggatataacaattaagctctgtgaagaatattctaggtagagaaggaggtatgcaaaggccctgaggcccaaaggcaataaggaatgcagtcgctgagacctcttctacctgagtgtgaataaggaggcaggttctgaaggattttaatcaacgggtatgatacagtttgtatatttgtctctgtctaaatcttacgttgaatagtattccccagtgctgcaggtggggcctggggggaggtgtttgcatcatgggagctgatccttcatggcttggtgttgtcttcataatagtgagttttcaaaagctatggttatttaaaagtgtgtggcaccccgccaccaccaactctctcttgctcccacttttgtcatgtgatgtgccttctccccctttgctttccaccgtgattgtagaagctccctgaggcctccccagaagctgagcaacgtcagtgctatgcttcc

SEQ ID NO: 139117 - DNA, 137 bp, Homo sapiens
tatattaataaatagtgcatcaatattctaaaccactcaaaaaagttaaaaaaactataattggttgctgagagaattaaaaataaaattatataaaatgctcaattaaagctaaagaaggcaggatagagtgaaaa

SEQ ID NO: 139118 - DNA, 376 bp, Homo sapiens
atgagaacaatctaagcatgacaggtgatgtcttcttttatgactatgtaactgcaattgtaagaatgtatttcgtgtcagtatttttggatggatgaataattttttaggttattgaaatctaagatcttaactcaagtaaaacaaggtttttaaataaaatttgatccttaagctcattctatgttgccaagacaactcagcattaagcataacatttgcttttcaaaaagcatatcattaactataatccccaccatgagcagctgagtagaaaggcaggttgaacctgaactccaaaaccaacctaaaactcagaaagtggaaggagcatcggctaggccctggcctctgggattcagatgcaccgggttca

SEQ ID NO: 139119 - DNA, 214 bp, Homo sapiens
aagaccacatgatcatctcaatggacgcagaaaaagcatttgacaaaaatcacactttcattataaaagcattcaacaaactaggaatagaaggaaactacctcaacataataaaagccatatatgaaaagcccacaactatcatgttaacatcaccacacttaaagactgacagcttttctcctaagatcagatacaagggaaagatgcccac

SEQ ID NO: 139120 - DNA, 299 bp, Homo sapiens
aagtgaagtgggggtgaaatggggaagtgggagtgggaggggaggaaggggcaggtgctgggaagttggcccttgtggccctaatctgtctgtgacagcttccgctcctacccatccacagggacaagaacaagtatccccttccccagcctgctccctcttaaaaaaaaatcctcttcctatttagtatgcaacaggtgctcaatgtgtgctcctaccgttctccaggaaaggagggagctaagcaggacacagcccagagctcagcactcccctagcctcccaccctcacctcccaa

SEQ ID NO: 139121 - DNA, 315 bp, Homo sapiens
attctgacagttaatttactgtaagctattgtttgctgctatcaaaacacaaaacacattccccccactcccccaaaaaaatacccttgcgattggtcctatagttcgcattttaagaaacaagggcttcaaaaataattttcatctgtttgaaaccatgggggctgctcaggcattattctgtaatcatgccagtaaaactttgagaagagaacctcaactttgagtgatttttctaaatgtgcatgttacataatataaagtgactagatccctttataaaaaaattcgcaattgttttaatgaatgtgaacg

SEQ ID NO: 139122 - DNA, 334 bp, Homo sapiens
tgagcctgcaataatgggctgatgggatgggcccacagggagtgaggcagtggagggcagcagcactgatggatgttaagcatcagaacggcccactagaagacttaattgacttcttcaggctcttccttcgtgtgcacttattcatccatccatccatccatccatccatgcacacacccagctatttattctttcatccactcattcatatctttagcttaaagcacaggtctgcctcttctttttggtgcatatcatccatccatctatccatccgtccatccatccatccatacatgtatccataattcatccatgaacccttaattca

SEQ ID NO: 139123 - DNA, 432 bp, Homo sapiens
ccagatgacttcactagtgatctaccaaccatttgaagaaagaattatcaattctacaccatcttccagaagaggacagaaaacacttcccaactcattctataaggccagcattaccctgataccaaaactaaagacctaaaaaaatcacagaccagtgtgtctcatgaatagagacatgaaaatctgtaacaaaatgttagcaaatcaaaccctgccatacagaaaaagcataacccggccaggagtggtggctcgcgcctgtaatcccagcactttgggaggctgatgcaggagaatcgcctgaaccaggcagatgcaggatgcggtgagccaagattaagacactgcactccaacctaagcaatactttgtctcagaaacaaaaaaaagcctgggaagcaaagtgagaccccgtctctacaaaaaagt

SEQ ID NO: 139124 - DNA, 376 bp, Homo sapiens
taggatgagtacggtttcagctggccgcttttagccatcattgaacaactaataccaagaccaaagcaggggctatatatattcatattttaccagaaatgtgtttcagaacatcttaaagaaaaacctcctattttgcaaataaaagccttaatttttcaactacgtaccattgctgaatactttgtttacatttctgctaactttagcaggtactcactttttactttaagctctaatattccatatcccagcctccttttcaggaaagcaagacataatacattaaataaacaaaatagcttcaaaggtacagaaaaatctcaaacattactccatttttctttttctttttattatttgagatggagtcttg

SEQ ID NO: 139125 - DNA, 299 bp, Homo sapiens
gtactttagagaactgggggactcaaactaaagtcagattgctacctgcatccttcctggcctcaccatctaagcctcactccaagaagtcttgagctccacctctttttggccttttaatttagctatccatgtcctacccattttttcaaaccatggtcttgagttcagaacccaccatcattctaccttacttttagttttagaatttttttttatattgatttttgctgagttttctgaaaaattggtagtggattgccaggcatggtagctcatgcctgtaatccccagcattt

SEQ ID NO: 139126 - DNA, 194 bp, Homo sapiens
tggatctacaggatcctgtgtcatcccccttcgtagagatccctcttaagggtattgaaacctagctgtttacacaaaactagcaagttggtgatggaaagtcttaggagtgaggtgagggcacttttcttggtctgtcatccaggcaggaatgcagtggctcaatcacagctcacttcagcttccacctccca

SEQ ID NO: 139127 - DNA, 152 bp, Homo sapiens
attaagatatgtgtagcatatatagatactgttcagtaaatgttagccattatttagtgactacctaatactaactgtagtattttaacaaatatctacagtgtgtactatgcaccacgcactactatcactctctccatctctctttctct

SEQ ID NO: 139128 - DNA, 534 bp, Homo sapiens
ccaccttggcctcccgaagtgctgggattacaggcgtgagccactgcgcctggccctgaaatttcgcatgttttacggttggcttgttagggttaaattggtgcaccttatacttggttgcatactagactcactggaatgatttgactttcgtcatagttgcagaggcactctgaaaccctatgtatgtgcttcaccagggacagccccacgcatgggaggtggtggccagccatcaccccagggtgaatttctctaagagcagtcctaggccagggggtgagtgtgggaaagtcagggccgtttccatcagttaacgtttcagagcgggttcccgctggaagtgctggaaatacccagatgccatctgtagcattttatgaactgtggcggatccactctctgtgtcttgagcttctgctctgtggtctgctcagtggaagcatcctgtcagtccactgtacagtggggtggagccgcagccagggtgggtgtgccgtttgattggtcacggaatgaacagggcaaaggtca

SEQ ID NO: 139129 - DNA, 462 bp, Homo sapiens
ctcagcctttcacagctactggcaatggtggcatttgacacacactgcagccccgtggggggctggagggaccctgcctttgtggtggaggaaagggaggtagtgatggtaagctggaccccagctgctgtcttggaggccgggaggtgccaagcatctctctctgatcccgtgatggggtttctgccgtgtgtcgctggaacacctcctccttgctgatgtccgagccaaaggaagttgttttatcccagtgccgtgaaaagcttgtcagtgtcttggtcccgaataggacatcagggatgaatattttagtttttaaaagctttttgtttcagctggacatggtggcctacgcctataattctagcactttggggggccgaggcaggagaatcacttgaggccaggagtttgagaccagcctggaaaacataacgagaccccatctctgccaaaaataaa

SEQ ID NO: 139130 - DNA, 586 bp, Homo sapiens
tgagagaggggtctttgcttcaaaaagcttgcactctatcttcctaggaggtgattaaaattagttctctaaatttatattattttccccatctattgggctataactatctctttcatgtaggacattgatgtctcatgacttcaccactactacggagggaattgttgccatataggcattgactgtgaagcttctagaacacctgtctccaaaatggggatgtatactcccaagaaggcatgcaagtcaattctaaatatagctaggtagagagacagagatattaagctttacttgtgtttaatatattaattgatactgacaaaatcaggcttttttgtctgatggtcccattttatatacaatatgtaaggtatgcctaagaaacaaatcccacacaggatttacactggaagattttacactggcaccacatttatgtaaaattatgttaccacatattgcaattaaatgtacttggttaaatggatcagatgattatagtacgtcctcactaacattgtcagtaggttcttggaaactgacttgaaccaaaacagtgtacagcaaaaccgattttacc

SEQ ID NO: 139131 - DNA, 154 bp, Homo sapiens
tgatcttgaactcctgacctcaaatgatctgcccaccttggccttccaaagtgctgggattatagttgtgagcccctattggtgcctggcaccattatcgtttcattcatttgcatttctttgatatttaataaggtttaatatattttcatct

SEQ ID NO: 139132 - DNA, 425 bp, Homo sapiens
aagaccacatggaatggtttgtcaataagtttttaagcttattatttcctatgcttacttagcatagtgactgcctttcaaaataatatgagtggaagagtaagattttcttgcacaaaatgtgttaaatgtatacttaaattaagaatatatgagtatctgaagataatctctaatcaaatatatttttattttatttttgtaaattattcttcccaggagcatggaatcaagttgccctgaatctatgctctcccaaatagattttttttttttgagatggagtttcgctcttgttgcttaggctggagtgcagtggtcttatatgaaaaatgtcataatctttgctaaaatttctgtgtaagtgaaactaactttctccactttggaatgctgaccccattcatttggagtcagtgtttctg

SEQ ID NO: 139133 - DNA, 100 bp, Homo sapiens
gaaatggacttcttcatctgtacagatttgttaaaccattctatttgcttcttaataataggatttatattagtactcattaccattggacacaatgaca

SEQ ID NO: 139134 - DNA, 486 bp, Homo sapiens
cgtcacaaacattttacaattgtttccagagcacaggcagaaatggggaagagtcgcagaaagaatagggtcattccaatggccatgatatagttcgctgcatttctttgaagaaaagtgctgcccatttctaacatttctaaattacttcaatgccattggagctagctagctttctaaagcagagttcttggtattctatgcctttcctcaaaaatgactccttggacttatagcattctatctttccagtctcactttcttcctttcccttttactcaccgtctgcctctgccctactagactacttgctactcaccttcatgcttcttcacctttgcctttgcagcttcctgagcctagtataccttttccaacatgactgttggttgaaattctacacaacacagtttagatgacatccactctagttagaattaatcacttctttcttctcttttacaattttttttttcattttttgct

SEQ ID NO: 139135 - DNA, 394 bp, Homo sapiens
acaaccagtagaacatggcagcgcaaatgtggggcttggctcttaacagcttcacatgccatttacttgaaattatgggcccatttgctgagagaaaaaaaaagaagattgaacacagtcttgcttctgagttagggtttttgcctttcttaatcaatatatctttcccaggaataccggtggatgagtctgtgttaagcccaagggaagaaatgtataattcaggcagcagagatagcctcactccaatgtgaacaatctctcttcagactccagggaaaatgcccaagatggtatattgcgtatggcgcaggtttcctgttttagctctttggtcagctgagaaaattggtgaggcctgatctgctgaaggatgacctgaattaaccctcct

SEQ ID NO: 139136 - DNA, 209 bp, Homo sapiens
aaccttccctgctgggattctctaaccacagctcgcctgaagtattttgcctttccctctggctaacagtttcccctcagcccttggttttttggttgtctgtgccacagactttctctatctgtgaccctccctctcaggaaggattcacaatggctccataccggctcttctttctgccaagtctgtgagtccatggagaacagttg

SEQ ID NO: 139137 - DNA, 227 bp, Homo sapiens
gttcctagcttctctgcctggaacttgaggctctcagggcctaggactctgtcagactttcctctcctgccccctgctcgcccgactgccccaccactcccccatggcctcccactgcctctgtgtctttgcccatgttgttcatgccaacggaagggcccttctctcccttgcttgcctgtaccacccactgcctgcacagggctccccgctcctccagaaagcct

SEQ ID NO: 139138 - DNA, 366 bp, Homo sapiens
actttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgttt

SEQ ID NO: 139139 - DNA, 271 bp, Homo sapiens
cctcggcttcctaaagtgctgggataacaggcgtgagccactgcacctggccagatctttatatatatattttttctctttggttattgctggcatgaaggaatattgttaaccaaattcagtatgtggattttatatagtttgaaaacaaaagcagactgcttaaaaaagatttatgacatttatgagattgttggaagtttgaacattgattggttatttgatattaaagaatcgttaacattttagatgtggaagtgatattgtaatt

SEQ ID NO: 139140 - DNA, 485 bp, Homo sapiens
atgtcatagtaacaatcatcataacagcaggacagtgaacatttgtaaagagtagataaactcttacagcctggaagaggcatctcatgggagcttgaatactaagtagaggaatcaccaaggcaatgtcagatacttctgcagtagagtagtttcctgagactttatttctgttctgtttccattgttctgttccttgcctttggtggcaggtggagaagagatcttctcggggatataagcattagggcctcccagttcccgggagacagcagaacctgagaaagaaatgggtgtgtggtacaaatgaagaccgggcaagcatggcatggaagccttagtgtcaatgcaaagggttacccagacttagataataggcatgccagatatacagggagataagtgtaaacttaaagccagagggacctcatcaaatgttccactccgattaatcactggttccttcacatgagccatagaggttg

SEQ ID NO: 139141 - DNA, 323 bp, Homo sapiens
ctgtctggatatcaggaaagagtttatcaaatgcctgtggaaatccaagataaggtctcatgatgagtaacccagtgaaaacatgaagtcaagtctaactagtcactactatttcactactgctgactcctgatgatcagctccttttctaagtgcttactgtccacttattccatcatctgcctagaatttatgtgaaggaatcaaagcaaaaggatcataaggcttcctttttccagtatgtttttcctcctttttgaaaactgggccagttagctatctccatttttatttcatgaatacatccccagcgcctggtatat

SEQ ID NO: 139142 - DNA, 437 bp, Homo sapiens
caatttggtgagggtatttaatattttatggtttcacataaaatgatcacagcgagtgagagttttgtggcaaggtgcaaaagtatctaaaaaatgccatgattgttgtgaaatctatattagcgaaaatctaaattttccaacagaaggacatgtaagttacctgcacctctgtggaatgtttttaaaggatgcaagtatgaactaagtgtggtagggtcaacttttgatccttgcattttaaaagttggcactagtatgaagttttttatggcagcactaaaactcacacggtctgaatagtttattaaaatggtgtaaggctgcactaatggccagttcccaaatgcactaagatacttaatgtgtaccattcctactgaaagtatgaacctacttagctgatttccagcttgcccatttctggaaaggtaagc

SEQ ID NO: 139143 - DNA, 142 bp, Homo sapiens
aaaacctgggatttagaaataccaattgacatgaaaactggccatttctgatttaaacattttgtagacttctttggcaaaaatagctatgacgatcctttaaatttatctctttgcctaacaatatttgtctcttcatctc

SEQ ID NO: 139144 - DNA, 543 bp, Homo sapiens
tcacacagggacatttaagtctgcagaggttactgctgtctttttgtttgtctgtgccctgcccccagaggtggagcctacagaggcaggctggcctcctttaaaggagtcttatatgaaaattcccagaactaaagcacataaatctttggactgaaagagctctggaggacccagcataatgaatgggaaataacccacctcaataaccgtagggataaaatgaaggtatgacattctttgagaaaaagagaatatataaggaatgtagaattagaatgacattagatttttcaaaaaacaaacacaaaataaaagatagtaatgctttcaaaatcagagtgagaatgactttcaaactagaattcaatacccagacaaatattgatcaagtctaagggcagaataagacatttaagacattcaagaatacaaaacaatttctctcccatgccccttttctttggagaacatgaaaggatgtgctccaggtaaacacagaatcagaaagaagaagaaataacaactggaacacagtaaaga

SEQ ID NO: 139145 - DNA, 567 bp, Homo sapiens
aagtcttaatgagagtcgattgtggtttgaagtatgtgtagataagtagactaattagaaatatttagaagatagaatatatattaatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttcaattccagggtcatataggagaagtaaatcggaaatgttgagcagcctgttggatatgtgggtctggctagcagtagactcatgagttgccagtatatagactgtggttgaagcctgggagtgaacgaatcactacaggagagtccgcgacggtcggctaattttttttttcactcac

SEQ ID NO: 139146 - DNA, 631 bp, Homo sapiens
gcggccgcgccaacacccccccccctcccccgccgcaaccaccgcgcgcgcgcccggcgggggacagtaggaaggggggccggcggcgagcgcgagcctcgcccacccgggtctacaccgaagggtagcgtgcccgcgcgggggccggcgggtgggagatcgcgccccgaggagggcgagggagacccaggccccgcgcgacggtccccctcgctggagtgagactgaggaaggggccgctttctgcccccctcctcccacttcgccccagagaaagagccttaccccttccacacccaaacaccactctcctggacaattacttttactctgagagaaagggcgaccagcagtggccccatcctctctgattgccggccaggttggttgtcatggtaacccttccccagcggtgggggcgaggtggtggggagcagccttcccctcgcttccacctttgtggttatggagccccaaacctcttaggactctgcaccaggagaaggttgctaaggtaacctaagtgtccgtggtggtccttctgctcctatcctcattgattactatggcaacctcccccccacctagcattcaggtagaaaggaccccagccccaaggacactgatctct

SEQ ID NO: 139147 - DNA, 411 bp, Homo sapiens
tataatcccagcactttgggaggccaaggtgggcagactgcttgagctcaaaagtttgagaccagcctgcgcaacatggtaagaccctgtctctatttaataaaagaaaaaaaaaacactttgttttaatttaaaaaaaaagaaaaaaacagatctctttatcagggagccccaagagtggttaactgtgactctctcagaaggggccttcagggatagaaagacacaattcagatctaaccacttaggttagtctgcccttaatcggctgtttcctcccagctgatggctcaagaagagtctcttaggagattatcctaaggaagaaatactaagtaccattattactatcatggcaacacttaacagcagcaaaaaattagtctatcaaatgtccaactaaaggaaaac

SEQ ID NO: 139148 - DNA, 385 bp, Homo sapiens
caaacgctgctctgatctctgcattcaaatcctgatggactcaagtcaagagtgatggcctcccacctctggccactcccatccccacacgcctttgcctcaccgagcccacacgcggcggcagcagcacgcctaggctgaaccatacccggtcaacttggagactacaactgccaagcaggccggtgcttcccgttctactgtaactctctaagcaaaatgtgccaggtttttaggggagaaaacacactcagtcccctccttgcactgtccccaatctctacgcctcaatcactccctgtgcctcaacagtgtgcccactcatcgctgatatatacactcctgtttgccattcacgcagggccgctctaacttgtggtttctg

SEQ ID NO: 139149 - DNA, 225 bp, Homo sapiens
tgagggctgatctcagcccatgacatgttcagtcaccctgcggacgccgatagggagcgcgaggcatcctggcatccacaaggagcccagaggatcgctgagagcaccacatcaagctgtcgggcagcaacccctacaccaagaacccttaaaacatggattaagacaataaaaagtggagaatatcaagaaactctaagcttcttattttaagaacagtgataa

SEQ ID NO: 139150 - DNA, 252 bp, Homo sapiens
cttaaaaatggataagtctcctgcagtaaagtgacagattaattaaactgcaaaccttctcagttgtctaggtctggagaaagttaagatataagatgatcataaaaatggaaagtccagatatcaaagacacaaaatagctgaggcaaagactagggaaatgctggtaaaggagatttcagcagtagagaagcaaaccagtgaggggaagatctattttttaatagatgattaaaaattttctctcaggga

SEQ ID NO: 139151 - DNA, 209 bp, Homo sapiens
ctcctgaccttgtgatccgcttgccttggcctcccaagtgctgtgattacaggtgtgagccaccacgcccggccattatcaagtggtttccttatgcattatctttttgtgctttgatcatgctctgcagttttatgattagagtattactgttcatggggggtcagtttctctgtaaaagcagttttgagactagctctataaaatct

SEQ ID NO: 139152 - DNA, 270 bp, Homo sapiens
ccaaaatgagatggaatgaaaagaatattcttataaaatcgcaggactagaataatcattttacacgtatccaagtaaacttcctttgttgtcaaggatattctgtttcaggttttaaatgcgtctcagattcctacacataatatttaaacgaagaaaaaaaaactctagaaagaaacaaacaagaattctcgagtaagcaagtaatttaaaggctgaatacacagatacgcaacctcaccagtatgctccatgttactacatatttaa

SEQ ID NO: 139153 - DNA, 195 bp, Homo sapiens
tctgtttttttgagcgtgtctttctgtagtgtttttctcttctaataactttgtgtagggtttgactttgataattttctgttccctttttctcagctttgtgctgtatttcacaatccataaaatctacccacttaaaagtatacatttcagtgtttctttttgtttttttattttttgagacaaagtctcact

SEQ ID NO: 139154 - DNA, 1257 bp, Homo sapiens
tttagaatctatatccagaccaaggccatggaacaatgtagattcactcagtaaaaactcactagcggccttctttgtactagtctgtcacctttgcttggctttgggaagcttcaaactagggcagtttatgtttgggagtgaccagtcaaatagcaagacagacataggcaaggatgtaatttttaaaaatttaagtggggaatggtgaagcatgaatcaaaacagaaggtagtcttaccttcttggaactgtaaaataaatacatttgaaaaaggcaccctctcaaccttctgcgagtcagaatttttgctgccacccctcattttgaatctctattctgcattttttattcttttttttaggaaggaggaagaaaaatttctcctgaagaattcattggaaattaaaattaacttgcgtattttgtattctttggaatgtgatgaagactgatttgaaagggcagtgctggatttggtcaggcataggaaaggaagacatgcagtcgtcctgcctagctcatccccgccacgatggagaagtggggttgctttcgttgtactttttttcatttgtttcttgccaagcccagtggcttctgttataacatgtggcagcttctcccttggagactgattcagtccaagttaccataatatttaggaccagctacagagacgtttcttcccctaaacccatgccaaatctaaatcaaactatcttcttctccttagccgttcaaatagctccagctcttatataaaaatacgagaaatacacaggcctcttttcgttttattcctgttcaaacagataaacaaacaaggcacatcatgcctaggttgctttgagcttgatcacttcctcctaaagcagtcttacgctgtgttgattttaagaattgcaacttaggtgttctagaacatattctgagagcatagtcatagtctgtgatctcagaatatgtttgcttccttctagaacatctgagttctagaaattgcgtacaataaactgctgtcagtgctgctggaggaaggaagagtaactctgacatcactggccttcaacaggtgtggcgctgagcttctgggcctcagaagccctgacttctagaggctgggggccagcggggcagggaggtgatctcatcatggatggccacagatcatccacctgccaaacagttaaccctgaacaagtcatgtcaatttattttgcttttaaaaaagaaagtctgcaaaatagaaaaaa

SEQ ID NO: 139155 - DNA, 504 bp, Homo sapiens
cacacacacacacaaagttgttgacacttgaataaggtggttccccaaaatgtaactactcatagcctaacattgaccagaagcctcaataacataaatgttgatcaacacgtattttgtatgttatgtgtatcatacactgtattcttacaataaagtaagctagagaaaagaaatgctttaagaaagtcataaggaagagaaaatagatttactattcatggagtgaaagtggctcatgataaatgccttcatcctcgtcatcttcatgttgaatagtctgagaaggatgatgaagaggagggattggtctttctgtctcaggggtgacagaggcagaagaaaatcttcatgtaaatgtttataccatgtttttcaagtgtcaaactatttaaatttaatgtgttgtgatggttaattttatgggtcaacatggcttggccatggtgcccagatatttgatcaaacattattctggatgtttctgtgaaggtaatttttgga

SEQ ID NO: 139156 - DNA, 147 bp, Homo sapiens
aaagttaccttcaaaaagtattttcttttaggatataatggcttcattcatgtcaaatagcttttcttttatttattttaagttggggaatagacaaaagtcatacataatttaacacaataaataaggcaaatgcaataatattgg

SEQ ID NO: 139157 - DNA, 401 bp, Homo sapiens
tacttgagtaattacttggctagaacttccagtacagtgttgaatggaagtgaagaatgagggcatccttgtcttgttcctgaccttagcaggagagctttgtcttttaccactgcgtatgatgtgagctctggggtttttaaaggtgttctttgtcaagttgaggaagttcaattctattcccagttttttgtgtgttcttatcatgaaagtttaattttgtcaggttctttttcttttttctacatcaattgagataatggtgtgttttttcctctctttattaatgtgggatattacatatgtttttgtatatcgaaccaccctcataatcctgggacctgtctcaattgattatagtgtttaatcttcttaatatgatgctatatttggtttgcaag

SEQ ID NO: 139158 - DNA, 489 bp, Homo sapiens
agatattttaaaattctctctggatttcctcttttatccagttgttcaagagtgtattgtttttatgaatttgtgaatttttctattttctttatgttaccgatttctagttctttccactgtggcctaagaagataccaggtattatttcaatcttcttaaatttgttaaaacttgttttgtgacttaagatgtgacctatcctggaatatgttccatgtatacttgagatgaaattgtattctgctgctgttggctaaaacgttctgtatgttaggtccatttggtgtatagtgttattcaaatcagttgtttttttattggttgtctgcctgaatgtgctatccattattaaaagtggaatattgaattctcctactattaaattgtttttaacctctttcttcatatctgtccatatttgatttatatatttaagtgctctgatgttcagtacatacatgtttataattgttatagcttcctgtt

SEQ ID NO: 139159 - DNA, 340 bp, Homo sapiens
catgccccaccacacctggctaatttttgcatttttagtagagacagggtttcaccatgttggccaggcttgtctcgaactcctggcctcaagagatacgcctgctttggtctctcaaactgctgagattacaggcatgagccaccatgcccaacctcacttgcttcttatccttacactcccctggccctagaacaaccttaacctggcttcctccagacctctgagtcatgcattgaagtcagcaccaccacgtggagaatcaccattatgtgcctctccttgggcctgccttagcagaactcagccccacccctagaaaagggcactgtcctctgcc

SEQ ID NO: 139160 - DNA, 401 bp, Homo sapiens
atcctgactatactagtttttatggccgaggtcactgaagttgtgccaaaaattcaacaatgatgttcaatctaatgtagcaatgcatttatcttattgctgaattttagactcctcagaacaaagcacttcatttaaatgataaatgctcacctaaaataccctgttgtaaacatttctcacatttaaacaattgtggataaaatactgcaatggtaaagctttcttttcaatacagaataaaagttgatgtttaattatttaatgtctcttttaattggagggaaagaaagtattttaagtgcctgttgcataattaaaataaacaaacaaaaaaccctgtcacatttaaaatggtaaaagtccataatttgaattgacaactataaatgaatttaact

SEQ ID NO: 139161 - DNA, 196 bp, Homo sapiens
agaggtcgatctgaggatccccactagtccacggttggcttatcagtacatggactatactgataagccagacatgaaattccatttgatatactctgctaaataaatgatgcaagcacagtacattttagagacagaatcttaaagtacacagctctaaaggtaccatctcccttttctcgtctgtaagaataag

SEQ ID NO: 139162 - DNA, 456 bp, Homo sapiens
atttcaccggccccctgaattgggtaacatatgtgtcatctacttagttagaggctctaagactgataatgaatcaatgagtgaagcttttggaggaattcggcttcttggttcgtgggaggaggggtaggtctgtgttttagtgttttacaggcaaattttcttccctgccattttattttgcacatctcttagcattattgctgaaatgtgagaacagcatttaggaagcccaacaaagcttcccaagtgtgaagctgtgacattttgttattctagaaccacttcagaaagcaacgttgtatttctacttaacatttaatgtgttgcagctgctacagaattatttacaaagtagtaaaacagagaaaaagcaatcatttcccaacatcattagtaacaaatatgtttgcttatattttctaaagaagtgacaagaaatgcagataatgagtg

SEQ ID NO: 139163 - DNA, 399 bp, Homo sapiens
cccgtccaaaaaagtgctcaatgaagaatgaatgaatgaatgggtaagctctgggagaaataaccaggctggttgggcagggaaacgtccttctctgaactttagggttctcatccgtaaaatgaggataagcaacagtctccatctcacgggaactgaaggtatggctgaacaaaataggcttattgtcactacagtggcataaacacctcccttactcaaaacactttcaagggcgcagagagaacgctgtacgagtgagcagtaccgtaaactgttactgctctgggttctgtcacgggacagtgactactcctcactgaactgtggaagaggtggcccaaaaaacgcgagaagaaaagagaaagtttttagacgcagaacgcggctcgcggccac

SEQ ID NO: 139164 - DNA, 338 bp, Homo sapiens
atgagatgacacttattaggaggagattgtggggaactaaaaaattctggaattaagaaaactcatttttttacttataggtgttttcttatgggaaaatgaaaagagaactcatttttttccaagaaccctttttttcttaaatttatatgcccttctgtctctaaatacagttcaaaattgtactttttaaagaacaaacctaattgtacacagtacagtttggctcttaaattagaagtcatcaaattcacaaactgcattttaagaaattcagaatattaggctggacatggtggctcacgcctgtaatcccagcacttggggaggcctaggcg

SEQ ID NO: 139165 - DNA, 493 bp, Homo sapiens
catttattctatgcagacgtattacctctctgaaccctcattcatacattcagtagtatttcctgatgacagactctacctgtaacaaaattagctttcatatattttaagttacagaatacagtgcatgagtctagttagcacgtgacagacaattctcagttacctgccttgtgtattctccctgccagctgacccagtaagcacgagctcaagaagccaggtatctttttactttttgaactgaaagaaaaagttgttaagttcatagatcagtcgccttaagtgaaaagtcagccttccttccaccctctccagccacatccagccaccattcccttccccaaagcaacggctttttccagtctttttggtttttgtttttttgagacagggttatgtgcccaggctagagtgcagtggtatgatcatggctcacagcagccttgacctcctgggctcaggcagccctcccacctcacacacctgacta

SEQ ID NO: 139166 - DNA, 414 bp, Homo sapiens
gtacctgattcttcagatgtcactcttgaaatagccacctgcccacgggcccatcatgccctcaatattttcttcatatctctgagcaaagggtgtggggttttattacttctcctgtgtgtcccagttgaatgtgagctgggtgagggaggtgctttctctgttccctgctgtgtccccagggcttggacacaatgaaggtcatgccactcctaagtagcgagcagccagcagctgggctcctaagtagcgagtagccagcagcgcagcattcaaatgcagaggccaccttgaggtgtcccactgcacccccatccagcctctgccgcaacctcccttagaagcaaagacatctagggaagtggcttgcttactcgaggatagagaaatggttgcttttagttttaccattca

SEQ ID NO: 139167 - DNA, 513 bp, Homo sapiens
agttcgacggagactctctgagattggctcctcatcctcctgctgacagccaggtctcagagaggcaagtcccacacttcccaaactctggatccgagctctgccgccgccggaggaaaggcttctaactggttaggaagcacagaacttgcctggccttcaccagcattatcagatctgtcattctctttaggaactggctctgctctaggccttgttctttgctccagaggtaacaattgccatttttctttggtatttctgctgtagtgatcgtacttgcccttctcataggaaaccatgggaatcagcccaagtcacagctggcttccagatggctcttgatcctgtgacaccaccaacattccaatgctgatttgcttgggaggttcaaacttggcttgccggggcaccatgcttctggaaccccaccctgggagatttataggcaggccttggagagtctccgtcgaactagttcgaaggagactctcggatgaccatgttgtagct

SEQ ID NO: 139168 - DNA, 138 bp, Homo sapiens
aaggggctctcaggaacaggcaacggacaatgacatcagactggtccatggaatcagtgcaggaggtatccaaaaacacctgcacttaagattcagttcaataaaaagtgacgttacccaagggctatggaaaagctg

SEQ ID NO: 139169 - DNA, 288 bp, Homo sapiens
tcatttccatcgatggcctctgtctttgggtcactctagaactatgggcctgcttgactctctaagtccagcccgttcccttcagtatccaggcctccttccatgattctttgattcctgagtgacttcgtctccatgttggtgtctaatggtcttactttctatgtcctatttctgttcccgggagccactttctgtccagtgttgtcaccttttgtcttccctatctctttggtcattcctggactcctttgtctgtcattgtgtccatggactgtccactctgca

SEQ ID NO: 139170 - DNA, 498 bp, Homo sapiens
taatagtgtgatgaacatgctcagccaaaggcacttgagaatgtctctggggaaaattggatgcagacacagacaagcacacagggagaataccatgtaaagagtggagttatgctgccacaagcaaaggaactaccagaagctaagagaagcctggaacagatccttccccagaatcttcagagaaagcatggacttactgatgtcttcatttcagacctctggcctccagaactaaagaagaaacgaacttataaatatcaaagatatcatttgagattacatagcaatggagcagcaaaggtcttattgattggagagcgattgattggagagtgcagacgtatgcagcaacaggtttgtcagatgtggtggtcattgctcttactccagctttgcatcctagaatcaccttgttcagatcatcaccacttctcaattgggtgatggtggtagtttcctacctactgttgttaccggagaggggtcccgatccag

SEQ ID NO: 139171 - DNA, 393 bp, Homo sapiens
gggcatgggagccgctagaacaggagacagagggggactggaccccaggagggctggagggcagaatgaaagagggatgtgtgagggagtctgtgaggcaggcatgtgagagacacacagagatccagaagagacactggcacccagtgtcctgaagaccgggtctctccagcctgcccaccaggccagctccccaggaggccacccggggtccttccctagatggagccccccaaacctcccctccctatctccttcgtttggtgggaagaatccagtagcctcagaagaaaaagggagcaagagaaaagtgagagtcagttggtctggccttgggatggtgcgtgcgttccctgcaagccagccagctccaggacacctgggcccatgcct

SEQ ID NO: 139172 - DNA, 424 bp, Homo sapiens
gtagcagagagggcattttcctccctcttctctccttcccctttacaaaccccatctcaatcagtctgatttcccagatggagcaaatggggccagggaacaagatatgacaaatgattgccaaagcgcagtagaagatggctttgggattgcactggaattggtaaatggagatcctggtgtccactgggcaggtgatttgggtgctggtgaaggttgtggcaatcattctgagcagaatgtgcctgtgagagcctttctctactattggggctaattccaggagaaaggatgcctagttaagacactaccttatatgattttgatccctttatttctcagtctcattggttgcacctgatttcctctatgacattatacaactattgtataattttttctgctggtagcacatgatttttcc

SEQ ID NO: 139173 - DNA, 748 bp, Homo sapiens
aataacaaagcaagctctcaaaaagttttatttcctctgtatccatttttatgaaggtactgagagatgtgcatcaacaaaataagtgagtaaactaagaaagaagaatgtactggatcttataaaaaaggaccaacaaagaaaaatattttttaaagtcctagggtgacagcctatagagcaaccagtatgaatgaagtagagatctgggtgcaagatcaccaagaaataaacataattgacaggtatctgatatatttgaatattttgagaagaaagagattcaaattagagaatgtaaagaaactaatattagtaaatggaaaattatgtaagtacaaaacaattttcagttctaggaaaaatgtttctcaagaaaggaaatttaatcacactacactaatgtgtattttgaagaaagcttagcaatatggacactattagtttaacttaaaaaaaactgtaggctgggcactgtggctcacgcctgtaatctcaacactttgggaggctgaggcaggaggatcagctggggtcaggagttcatcttgatttttacatttgaaaataatgaaataaatttacaaaataaaaggaaaagtgaatatctttccaacagtccaccaatatcctcatcccaaaattatcaaaatgtgttaatattcctatttattttcatgcagtttattacattttgtttggattataagccatgatctctctctctatatatatatatatatacaca

SEQ ID NO: 139174 - DNA, 405 bp, Homo sapiens
gcgaactcccgacctcaagtgatccgcccgcctcggcctcccaaagtgctgggattacaggcgtgagccaccgtgcccggccgggttattatttaattgtgaaggcacaaaagcttaaacggcaggattcaggtgtccactagtacatcttgtttctgttttgaacagattggaaagttagctctgtccgtcagttctttcagtttttgttatttctactgagattgcctataagcattccattgggtgccagtgtggtgacttaattcaagagagatgtcaaattcatgcttcttaattcaacatttgtaaacattgtttttttggtcattgtgaatctgttatacatcttgagccagctgttccatatttttgagttcctaacataacctgtatgaattcagg

SEQ ID NO: 139175 - DNA, 499 bp, Homo sapiens
tatcacttcatcgtctctttgtttcaaagcctcaaccagctctgttctactcaaagaacaaaagtccaaatacgtgctttgtcagcctggctggtactcaatatcctcccaaatttagcctcacctgacttgactggctttctctgagctcccccagcataaactcagacatggagtgtccctatctgtggaagaaacctttggacatgagatgtctcctctccaccttgctgacctgtctcctcccctaaatactaccatcatccttttctgagtcctcaaagactcaagactcaccttgtcggaagtgaactctcccctggctggtgcagtgataaatatttctttctttctttcctttttctttctttcttttttctttttttttgacagggtctcactttgttgcccgggctggagcatactggcacgaccttggctcactgcaacctccgtctcctgggtttaagtcattctcatgtctcagcctcccaagtag

SEQ ID NO: 139176 - DNA, 370 bp, Homo sapiens
caacatgagtaaaatatactcctaaccctcaagaatcttatattctagtacagaaaacaaatctacaaataacacaaggtacaataagtgctataagaaatatacgaataaagagagaaaacaaaaaggagtcaagtttaaatttttacagtgtacttttactattctttttttttttttggaagaggcgaggtctcactgggtggcccatgctggtcttgaattcctgggctaaagagatcctcctgcctaagtctcccacagttttgagattacaggtttgagcaattctgcctggcacatacattcatttttttaagaactaaaagtatacatttcagttcctgagtttgtatcaaattcatttatt

SEQ ID NO: 139177 - DNA, 321 bp, Homo sapiens
caatgttattccttctgacttagtacttctgcttcagaaatcttacagtgatctaccttctagaaagactggagataaatacatcaaaatgttcacagtagtgtgtctctgagtggtagaattatgggtaaaaaaaaagatggcttgtttccatttttcttttgcacccctctgcattttttccaaataatctataatgaagacaggctccttttatatttggaaataatttccaaatataaacattttaattttataacattttaaatttttcaaaacactggtcctcataacaagaaaagttatttgttgcaaccacac

SEQ ID NO: 139178 - DNA, 332 bp, Homo sapiens
tgctgggattacaggtgtgaaccactatgcccagcctgtttttaatttttttagagatggggtcttgtcatgttgcccaggctggtctcaagcagtcctctcacctggccctgtattggagttctgaaaacatgattcctgagctagttctttttatttccctagataccttttctttccttgcccccaaatgtgggtatctgcatgcacaggcaggcaaacaccttatttctgaggtcagattttactatatcccaaatttaggcctaaactgttgctcccatgggcagttttttacactactatccttgaagaagaaggaaactaagttt

SEQ ID NO: 139179 - DNA, 434 bp, Homo sapiens
ctcccaagtagatgggactacaggcatgcaccaccatgcccggctaatttttgtgatttttgtagagatggggtttcatcatgttgtccaggctggtgatactgtattttaaaaatacagtttttatttgattcttgccagtgaccttctaccataatgaagcgactctgagtcagagcccccttcacagagcactggagctccttcatgacacttagagtccatctctggctggtcattggtgaatggtgtccagtcttaccgtcaggtttatttgaccctggacctttttactaagggagtggcaagcgaattgctgccacgtgcttgtgtggtgatccagccgcgcctttccggcacagtcggctttagtgaacaggcccgtggatcagtggtgctaagaataatttaaactacttaggggaagatttggg

SEQ ID NO: 139180 - DNA, 458 bp, Homo sapiens
gttgtgtccagactgaacagtagttcttctgcaggcgatcactcctgtagttttacctgcttgggatgtggcctccatctgcgcatgtctagaaatttctcattacgagaaattcctatttagttaaacatttgtttagtatttatttcagttctttcgcaatcatctactttgtaagtttacatgtctcatagatgttgataaataaatacagaagtcaatgatcaaaattaaatggtacattgttaacatccaccagctttaatccagctataatgggaaagaattggaatcacttggtctgttaccagttgttatgggctgaattatcttctcccaccctgactcctgccccaattcatagattgaaatcctaacacctaatatatcaaatgtgaccttgtttggaaataaagtcatcgcagatataattagttacaatgaggtcatactggaat

SEQ ID NO: 139181 - DNA, 495 bp, Homo sapiens
tcccttagtctcccaggcgggagtgcaggggcgcgatctcagctcactgcacctccggctcccaggttcaagcaattctcctgcctcggcctccgcagtatctgggattacaggcacccgtcaccacatccgactaatttttatattttcagtaaagacagggtttccccatgtagaccaggctggtctctttggccaggctggtctccaactcctggtcttagaagatccctcctacttgagtcttccaaggtgttgcggttgcaggcatgagccaccgtgcctggccttggtgctctctattcatgtgggcttgagttactgtctagtgtcctttcatttatcctgaaggactcttaggtctttcagtgatgaactctctacttttgtttatcttggaatgttttatttttcctttatgaaggtagttttgtgtataaaggttttttttttttttttttttttagacagagtctcaccctctcgcccaggctg

SEQ ID NO: 139182 - DNA, 327 bp, Homo sapiens
tgatgtccaagggcaggaaaaggagtgtcccagctccaggagaaggagacagaggaaattcttttctctccttttttgttctatgtgggccaccagcagattggatggtgccctcccacaatgagggcagatcttccctactcagtccacttactcacatgccaatctcttctagaaacaccctcacagatgcacccgaaggaatgttttaccgcttctctagtcttcttttttttttccagactatagtcaggcttctttttttttttgagttggagtttcattctgtcacccaggctggagtgcagtggcgtgatctcagctcac

SEQ ID NO: 139183 - DNA, 428 bp, Homo sapiens
ggccatatcatgaatatccttaaatgctagactgaggatttagacttcatttgtttgggagttaacagaaatagatcacttgtgcattgctaatttaagaaaaagatattgtatgcttttgacatatttagggaggtgttgtggacccaccacctggagagagatatatggccagcagtttgaaatgaaattcatttcatagcagaatttgaggacagaggaaaagatttaggaatcacttgcatgactggtgagggtgaaaatggtgattatggatgagatgactgagggagggagaataggcaaaggagagaaagtgtatcaggcagaaacttagaacacaccaacatttttaagattaaatgagcaagaagagagcagagagatgtagtcaaagaaagaggcagtaggtatgattcagagctgta

SEQ ID NO: 139184 - DNA, 252 bp, Homo sapiens
tcagcctcccgagtagctgggactacaggcacgtgccaccatgcctgcctaatttttgtatttttagtggagacggggtttcactgtgttagccaggctgatgtcaaactcctgacctcgtgacccgcccacctcagtctcccaaagtgctgggattacaggcgtgtgccactgtgcccagcctacttggtttttgtgtatgtccctggcacaccgactgtcgccctggtatttaattgttgtctctgtgag

SEQ ID NO: 139185 - DNA, 643 bp, Homo sapiens
tgtgatgtcttcttcatgggcacagaatgatctgtgggagcgccagggaggtgagaattaagcaaccatattcccttccttgcccacccttggaacagcttctccttggtcactggcattggtcaccccccaagtccacaccttccctctatgctgttctaggatggaaggacccagagttgaatgctgggccccaccacgagctgggaggtaatcttagaattattctccacaattatattgatctcccaagattccctctggtgctcaggatgttggtgtgcgtagaggccataacactctgtgggagcagtcagggcctgcagtgctacagagatcggatgctgtcttgagcaggaagcagagcccctgagccattctcagcagtgggcctgctctgaagggacctctggaactgccgtccagggcaggtgttgctggggagggaatgcgagtagaaggagctggaatttgagagcaggttgatgcaggcagggccctttgaagacctccgaaacagtaggcctgctttctttcagaggccccaccccatcctgggagacagattaaaatagactcacatcccatattaaatacaacagttgaaaaaattctttaaactttataaagtttattataaagc

SEQ ID NO: 139186 - DNA, 304 bp, Homo sapiens
tatgaccccccttttcagtttttcatgccaaatgccaggatttcaccctttcatgcttttttccatgcttaggctctgtctctctccatactacgtggaacatgaagccactggctgcagcagtaacagcacagagcagggacggcagctccctcactcccctcctcatttacttcatgcctccactgaaagaggatatttttatactgcccattcttacaatctgctcaagtcaccaaagatacatggttgacgttagcaaaaatactgtaaaaatgtaaaaatggttaacccgagctaggca

SEQ ID NO: 139187 - DNA, 267 bp, Homo sapiens
ggtgacagagcaagactctgcttcaaaacaaaaaaaacacgaatacaatgacgtccaaattgttgtcaacagtagaatcctttctggagtgcagtggaatcccaaacagcagacaacagcagacctgccctggctgaggctgaatgggcatcctagggtctcaccaattcctctatcttgattccaaagtgtttctcagagcttctaagagcagaatttgaaaccacagattcagtccaattccctcatgtaacaaatgaagaaatc

SEQ ID NO: 139188 - DNA, 1232 bp, Homo sapiens
gaggattttttagcttgctaagcagttgttgaagataaatatgcagacaaagataatttaagagttcaaaagttttctattccgtattgggagactacatggatatttagtagcctctaaatatagtgctctatcctcctgcttggcatgagagtaacatcaagagaaagactgagataatatttagtttctgacatgtaaataggatcccagctgcaggagaaaggctttgctacgttcctttggctactgccctctcttgcatattacagccaagcctggatgacctccaccatagagttctctttggtgtagagaagatgctcattccgtctttaacagcaaagcatggagactgttgctcagcaggtgcaggggtatgtatatgacaaaaggaagcaaaataaaaactcactctctgtctcagaggaagtgggacagagaggagagggaaaggaagaaagtgaaagaattaaatgtaggccccaatttactgtgcattttacaagttgagggagcaaacagcctccaggaagcttttactccccacctccaactctcatttgggaaccctgggaggacacttctgtgcacagtggggcagcctagtgattaggaaggggaagctgagtggtcctatgagacccagaaaaaggtctggttgtcattttctagacacccctccattcctaaggtgttcatactgagttaaaagccgtcaagtctgtaatagggtttgtaatggtgggtcaaggtaatttggcagcaaagccatgggcaggctgtaggccagggctgaatggggtctgtggcaactgcataggggtagttggccatcagaagctgagtcaaagcctcgaggcctatttagtcaaggaggctcaggatcaccgagccaagagatgagattgagctaaagtagtggtatcctgcatcagtggatgctagcaagacagagcagtttggggtttactccagagaccagaggaggaggccattaccatgcttgcgagcacttcctcttttttgctgccaaaaagtcatgcgggatgtcctgatataccgcactgccgttctaatgacaaaagcaggggaaggggaactatgtgagagatttaacacttttatttaagaagactgaatattacctaaattatgattgcagactaatctttaaatcgatcgaagagtaagttaatcttttccccactagtcagtatagtaagactaga

SEQ ID NO: 139189 - DNA, 1188 bp, Homo sapiens
gtgtcccagaaaaaaaccacttgggctccctgtttggagtctggctggctctgagcattgccaatggcccctactcacctgactttgtatcctcttcttttagaggctttgcattctgcacccagcttcactaacagtgggctgaaaccaaccttgggttgagtgtttcatttgggagttatttggccagggccttttgaacaatagtgtccccatgaagtgctagataatatatgtgtaagaatcagcttttttttttttaactataatatccttcagaaatttctaactactttgtaactgcatggcttaacctggtgataaaagcagttattaaaagtctacatttttttttaaaaaaagaatagaacaaataatgggagcattgggttgacctttgcaaattatctagttttatttacctattttacacaggagaagactgagagaagggaggagtagcttgctgtagttcagacagcaacttatttcaaagctggtgctaaaacctagagtgaactggtacttctccatttctgaaggaaatgcagaagaaacagaagcagaaagacaacattttggcctggacatatttaacttaaagatgactccatttttgaactttatttcttggaatagagtatcttctaaatttaaactgatccaactttcacaaaattgggcagttagaagtcacagagggaattagcagctgttgttataagaaaaagcaaagggattgttgccagacttcataaatcttggcatatttgagaaaaatgtcccaatttgttacatatgctcattcatgtgtgtaaacctttggttatagtgctttgtcaatataaatatgttttacattataaattggtctgagtgctggatttcatgtttattatcccttagaaccccactttcttttgctcttcttctcgggctttctttgctttatttctcccactcttttcttcttttttttagtgtacaagcagtgaagggtgcagatcatggatagagctttcaagaagtttgttctagttcttctcctgaaactggacctccctcctagcttggtaacaactaccttatggtctccagcctggtgacagagcgagactccatcttaaaaagcaaacaaacaaacaaacaaacaaaaaaattactcccaggtaactcacaaaaaccaaa

SEQ ID NO: 139190 - DNA, 353 bp, Homo sapiens
cgcctatcgatcgccgcaggctgagactggaggatcccttgaggttaggaatatgagaccagcctgggtaacatgggaagacttcatctctacaaaaaataaaaaattagccaggtgtggtgcaccatgcctgggtaatttttgtatttttggtagagacgaggtttcaccatgttggtcaggctggtcttgaactcctgacctcaggtgatccgcccactttgaacttccaaagtgttgggattacagacatgagccactgcgccggtcattttttttttttagccttttaaaagatataaaagccattcttagttcccaggccatcagtaaaataggcagtatgctagatt

SEQ ID NO: 139191 - DNA, 733 bp, Homo sapiens
ctcccatcagcattagctcattcacgctccccagacccaaatgtggaggaggggttgagaattggccttatctgctctattcaggaaattgtcatttctgctttgctgctgcaacatggattactggttctcccacctaaaaggaaggttgtggggtttggggttagaggggtttaggagcaggaagatttaccatagacgtcgcttaaagcaggatggttgagtcatggcttgctgcaactgataagcaaggaactgccctaaagattgtggcttattcatttcaaaagacaaaataattgcctttccttttcgtgtggctcaggagttattactttactttttctctctctgtatcatattcagtgcagccacgttataaactggaaatgattattactaaactataaaaactacagacttaattaggcagaaaatctaagagcaaatgtacactgtattttgagaaaaaaatgacggcactggcttcttcaaaagccggatcctgtaggtgcattcaaacgcagtagagagaaagctaagacagaaaaatcccaacttgagtttaatatttctgtccgtttatatagcactttatgtttgtcaaagtaattgtgcctatcttaagtcatccctgtgcagtagaaggagaaggaagagattattacctacactttagcatataaagaaaagaggaggtgggagatttaagggtttctttgaatatccccaa

SEQ ID NO: 139192 - DNA, 848 bp, Homo sapiens
tggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagcc

SEQ ID NO: 139193 - DNA, 590 bp, Homo sapiens
gtaccaatgtgtgttatatttattttaatgttattttaaaatgaatgaacataacaatagacacaaagcacttcttagtataattttaaataactgtgaagcaaatttcaaattaaatataaataatttggcaaaaccaactaaattcaattaacgcgccgtatttcttgtagtagatatatttttctcccctaaagcagttcaccattgttgaagttaaaaaaaatagtagtatcaagttcaggtttagattaattgtgattctttatgttgactttagtaaaattaaggcagaaagtgcctactaacatagatatactgtacagatcattattaataacttaaaatatgtttgctagtttcaaataattgcaatatacttttcccatgagcagctatcaatggctaactttaacaagctgtctctaaaaactgtctcactcgccctaagataaatttagctatattgctttactgaaatttacattaagtgctgatctaatccaattatggctagtgtcatggccgtaacatttattcattttacattgactgaaatatttattgtcaatgtactttcacaagttagg

SEQ ID NO: 139194 - DNA, 331 bp, Homo sapiens
gcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtg

SEQ ID NO: 139195 - DNA, 348 bp, Homo sapiens
agtccgttcgactgagcgcaggtgcagaggccaacgagtcagaacgtcacacaggccagcctgctgccgactgctctcctgactccctgaggcatgacgacagctctgctgggtcaccgggaacctcacggccccagggatggaaaggaagagagtgttgctgtctgaatttccggtgcatgccctccccaccctttttttttgagacggagtttcgcctttgttgcccaggctggagtgcagtggcgcaatctcggcccactacaacctccgcctcccgagttcaagcgattctcctgcctcagcctcccgagcagccgagaccacagggctcagtcgaacggactg

SEQ ID NO: 139196 - DNA, 448 bp, Homo sapiens
tagtaacatcgaagaccactgatcataggccaggtgcagtggttcacatctgtaatccattgttttgggaggattgcttgaggccaggagttcaagatcagcctgggcaacatagtgagaccctgcctctaaaaataaaaagagatccctgttcacagatcaccacaacagatgtaataataatgagaaagtttgaaatattgtgagaattaccaaaatgtagcacagagactcaaagtgagcacatgctgttgaataaatggcactgatgacttgctcgatgcagggttgctgcaaatcttaagtttttaaaaactttttagtaaatgctgttaattgtagcttgatttgcataaatactctaatgaaatggtttgtagacaaaagcaggaaatagttgtttttgccttagtggcactgtcctcccccttagcagttggaagcctca

SEQ ID NO: 139197 - DNA, 521 bp, Homo sapiens
ctataccttctttacagtctcttcaaacagatgttgctttttctttcatatgccttattcttataaacctggagatggagcaagtgtcctcctcattactgttttaactactatcagtcatctttgatcctccaaaatcccaagtccttggaggctcactataccattcactatagggccttcccactgtttgtctctacctcacccactgttttagctcctgactgccttcctcttcaccccattccaacaatctctcatgattatttcaataatcatgcacaatcactgaataaataaccttactattgaattgtttgatttcttcactttaatgatacattcccctaaggctaagccttacacctagaatatatcagcatgcactccaaaattcataacctttaatttttcatcaacaagtacaacatgtctgaaatctaaattttaaggacccttttttttcctcactcagtctgctatccctcgattctattagctttttttactgtaccaaattg

SEQ ID NO: 139198 - DNA, 282 bp, Homo sapiens
  misc_feature (20)..(20): n is a, c, g, or t
  misc_feature (40)..(40): n is a, c, g, or t
taaatggtaaatggtaaaantaatggtaaaaccctatctntactaaaaacaaaaaattagccaggtgtggtggcaggcgcctgtaatcccagctactcgggaggctgaggcaggagaatggcgtgaacctgggaggcagaggttgcagtgagctgaaattgcaccactgcgctcctgcctggggaacacagcaaggctctgtctcaaaacaaacaaacaaacaaaaaagcccattgagcccggtgcagccgcctttcacttctctgagcctcagtttcttca

SEQ ID NO: 139199 - DNA, 271 bp, Homo sapiens
tgtgatccaggctgcctgtgttccctggagaaggtgatcaccctgcctttcataggatgcaatcagaacccattcctggagaccgtatcccaccctacaaagtgcaatcagttggcctttcctgttttccacctcccgctgcacagagcttcagtcccctggcctccctctgcccttagagtcaaaaacccctcacctcccaagggcttttaacagccctggtggcccaggccaatgatacctaccttgtcctgatcaggactgtaacaag

SEQ ID NO: 139200 - DNA, 665 bp, Homo sapiens
atcatattagaagacagctggattcctacactggcttctccagtctgtggcaatatattattttggttgaagtggatgcagaaaatctggcctcacatatgcaattggaaaaggcatgagaagtatggtagtagccttttcagataattacacataatcttctttaataccacaccaaaacttgacacatcagagtattgtagagattagttgcaatacgaaatctaaaaccaaatcatgtaacttttcatcctctgttaaattgaaatccattggtctgtcttgcagttttaatagatctcttacctctgcattaatttataacagtatacatcagtgatttggagattatcagtctactggtttatgacaatcttccaagtgttagtgtatgtcattataccataccagaagtcacgtttgtttctgttaccagtgatgtcatcagaacaatctgtaagcattgagaagctgtcagagtcacagtagtggacacaagtgttccaagttactgcttgaatgctcgaaattttatcactggctattttccttgaaatgtcaagctcacttatttttgagaaaatgtcagccagatactcaagtctgaataactgtagcttattggtagttatactaggtaaaagcagcactccattaaaaaaaaa

SEQ ID NO: 139201 - DNA, 595 bp, Homo sapiens
gtgggactccacgtagccccccaagggaccacgtgcaagttcctcaacctatgtgggccttgctttcctcttctgtaaaatgaggaaattggatcaattaatctctaaggttcttttcaattctaggttctattataattaattcctttaatgatgaatgggaaaggtacagaagcaaatttaccaagaaaatttaagagtagctttgctcaaacgatatagtacatttacaaacaatatagtacatttactcccaagtggaatctattttaccaccaattttttagagtgaagtctttttttacctttattttacaataaaactagatctaataacataaaagtatcagcatatatagtgggaaatatcaatctgctacagtggtcattcaagaaggaaactagggccgggcgtggtagctcatgcctgtaatcctagcactttgggaggcctaggcggagagatcacttgagatcaggagttcaaaaccagcctggccaacatggtgaaaccccatctctactaaaaatacaaaaaaagaatttacctgggagtggtggtgcgacctgtcacccagctattgggatgcgagga

SEQ ID NO: 139202 - DNA, 587 bp, Homo sapiens
ctaaggcaacgttgttgagtgggaaaacacagggtcatatttcaggattaagttttagagtcaaacagaaccaggctcaaatccaatttactgtgtgaccctgggcaagatactctgccaaaataaacctgtttcctcatctgtaaatggtgacaccaatgaatatgtcaaatcttataggttgctgtaacaactggccctaccacttaacacctagtagatatactcaataaaaggcagctactgtcaggaatttttcccagacccactcactgcacttgaacccttgccagaagcaggcaggcatgctcactgtctcctcagaagctacgcactgcatttgtcttggcactaagggagagaacgttttttaatgaaaaggtcagtctgccccaaactcacactaattttttttttaaacagggctttgcctgactccacttttttctccctactctggtcctgcccaaatttcatagcaggaagacagctttgagaattagcaggggtggtttgccagatgttcctttgcagtctgcctttgtgactgccctctgactaattcaaactaggtttaacctagtact

SEQ ID NO: 139203 - DNA, 380 bp, Homo sapiens
actgcaagctccgcctcctgggttcatgccattctcctgcctcagcctcccaagtagctgggactacaggcgcccgccaccacgcccggctaattttttttgtatttttattagagacggggttttaccgtgttagccagcatagtcttgatctcctgaaccctgtcaaatttaacagtgagggatgtgtgcaactttgataacactgatgttaataagttctgataacccagtaacattgggccggcccaattttcaattttgaatacgctaagttcttactactgtggttttctttatggtttaggaggcctacgtttaatatctactcaatactgaaataaccaatgttatgtagtggttaccccttgctctgtggg

SEQ ID NO: 139204 - DNA, 172 bp, Homo sapiens
aaggttgggaacagaccatcgtttttgtcatccagattcttccagcgaatctcacaccagcaaaggagatacaaatacttagagccaacaaatgaccagtagaacctgacatgcatacatgcgcacacaccccttttctctctagcagcccccacacatactctcttcctct

SEQ ID NO: 139205 - DNA, 410 bp, Homo sapiens
ttaacataaaattaaagatgacagatgacaattataaaatatattttagaaaacaagagcattttctttaaatttaaatagttattgaaataggtacataaagataaccatttcctccattgttgcataggcttaaaaatgtttgcaaattaaggcatagaggtgtaatgtcagaggtagccattttcttcccaagaattccctaacattacgccaagatctggaagtgaatctgtctggttctggctatgcactggagcacagcactgaggtcttattcctggtcactgagccacgaacagtaaagggttcatggttcagaaagaaacttgcaccagttatttagaacaagtataactatctcccagagtgtacttcaattttttttatttattttattttttttattt

SEQ ID NO: 139206 - DNA, 204 bp, Homo sapiens
ggttgctattttaagcaggactcccccactcccattttctgattaaaaaaacaaattgttcttaaattgtataccttcctgtgtccttaaaacaagggatgacaagttctttcgagttgagggtttggtgtaccccatatcaaacagccagactgtagtgctaagtttatttattttatggttttttttttttttttttttttt

SEQ ID NO: 139207 - DNA, 546 bp, Homo sapiens
cagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatt

SEQ ID NO: 139208 - DNA, 219 bp, Homo sapiens
ggcaaatttaaattccatcttggaggacctaaagatatgtattaaaagttaatatatattcaaaatgtatgactcatttataatcaaagaatttgagaaattataaattgaaacaggatataaatttttaatttctactgtcttattcagtggtaattttttattcaaagttcttaagctgcagaaataaatttataaactgcagtttttgtaaacagc

SEQ ID NO: 139209 - DNA, 256 bp, Homo sapiens
ggcggcccagatttctatgtattcaataaatgccagaaatcaaatctaagtgaaatctgatatttaagagtggcaactaatttcaaataattttaaaagaaagcgtaagtcacataaaatatgcccacaagcttaatttggctctctagccaccagttagcaacctaaacaaaaccggttcaataaattaaacacagtgttttctctgatgctctgaccatgtctgtctccatgctcagaagggggactcctctag

SEQ ID NO: 139210 - DNA, 170 bp, Homo sapiens
caggcacactcttgcctcagggtctttgcacatactgttcccaccatttgaaaggctctttcctcagtcatccgcatgcttacttcctcactgcttgccaatataatctcaaataccacctttcttaaccatgctacttaacattgcaaccccattcccagattttctat

SEQ ID NO: 139211 - DNA, 489 bp, Homo sapiens
tgtaaatgctgatttgatttccaggcttccctaaccaaactctatttaactaacaatgctgctaaaaactagagtagaaatttacctgtcctatttatgactcactactctcagatcactggaaatacatctcatctgtcacaggtgccttcccaaaagagaatcctctcttagtcacacaggtaatatattctaaagcaagcagcctcttcctcctattctgcatcatgagtatcatgacattcactgtcactgaagagttgaatgtttcttgtcctatgagagggaaacccttctctgactagctgcataaacaagtcatttgtgagctgagaataatctgtaattttattgccagctcttattcttaagctcctttttaagatgtcagtttctgatatgtaaagatctagttgcatgaggccagttggcctgaagaaacagagaagaaagagtacatgattccacaaagttagagaaaatgatata

SEQ ID NO: 139212 - DNA, 170 bp, Homo sapiens
ccttccctcacttttctttcgcaagtacatcagtcgttgaatttagggcccatcctaaattctagatcaccttatctcaagatcctcaacttaggtatatttgcaaaaactctattttattttcttttccttcttttttttttttttttgagacagtcttgctctgtcac

SEQ ID NO: 139213 - DNA, 514 bp, Homo sapiens
atcctatcccagtcctctccatccaagatctgcaggttggggcaccagggcagacttccagaacacaaaagggtagtgggaatcttggccatctggcatggagacgctcagcctgcatggcccaagctggaactcttctgcacaaacaggtctgtagctttcttcatcatttttaagtgaatttgaggagtgtggaacagccagagatcattgttttagctcaaatgaatttaagcaagatacggaaaatgtagttagatccaggttctcatgtgctattgacccatgtggctggcactcagttctctctccatctctctttcatgtgttactccctctactaggtataaagaatggtcacaggcagtcccaagcttcatccttacagcttgtaatccataaggtctaactatctgtctgtctgtctgtctgtctatctatctatctatctatctatctaactatctatctatctatcgctcttcctctctctcagcttccacatagaaatcca

SEQ ID NO: 139214 - DNA, 776 bp, Homo sapiens
gcatgcacagctacttgttctagtagtctgagagtggggaatggtagctgcagttgtgctaagagctggaatggactgagattaaccaaagcttacttcccaagccttcccttaaatgttgcaaatcttcattagattccagagttccaaattagttacatcagattctgccattgcacttgttgtggaggtggagagatagaattctggtgcttcacactcccacatcttctttgaaatttttaagaattttaaatattattgaattttaagtagttaatattttgcatgccaaattcagtccagcctttattctctgaaatgtttttctttagaaaccatggaggtagagctttgttttgttttgaaggaaatagttatcataaataatgtgcatttaccaaactgcttttaaaataaattctaggaaattctaatgcaaattaaaattcattgagaaagagtactttattgggaacatacaatgtatataacctgtttgtatcgtttttgttcatgtgtacatgagggattttgtttttataccattttaatatatactttttaatttagatcttattgctattacgttaggattgcttttatctggaggacattttcagcaaacctctatacattttcatttttgtgataaaaatataaatatatggtttgaagagtcatttttaaaaatgtctagaaatattcatattataacaatctttattgagaacaaatgttgaatgttttatgtaacaaatttattcactagagat

SEQ ID NO: 139215 - DNA, 192 bp, Homo sapiens
ctggggtatctggccatagacggctcatattcccatttggcatcagccatgtggatgtaaatagtatctgtatttgtttttttttataaagtgctctccagtttgccccagtccccaccactccctatgtgtccccaggacctcctgaactttctgtcctctaatgttagagaaatttttctctgtacccgt

SEQ ID NO: 139216 - DNA, 387 bp, Homo sapiens
agttgactgaaatttgagttctttttttttgttgtttttaattaaggcttttgctccttatgagagaagcacctgggtgaggagtgggcagctgattcctttctctacatagggccttcttcctgtcatattgcctgccccggtcttctggggagaactcagtggaccctcatggaagagagctcactactgagtacaaagccgtctgtgtttgaggcccccagctattccagactgaggtatcagcccacatttggcctccaacaatttcttaaaattgtagctgatttcttcttacccactcttggggtgggtggcccacctttgggtgagctagtttgaacatgtcttttcttcttagaggagcctcttcctccttggaattca

SEQ ID NO: 139217 - DNA, 199 bp, Homo sapiens
atgagcctggcctatgtgcgctaggtcaaacaaccgaaactacttcatgctggtagaaatcacaactacggtcatcttggaggtgggggggggtgtggagcttgaattctaaaaacgcagatttcgaaggaggactcctccctgatgtctgtactcaccagaatataagcttcataaaggcatggatgcccacggtcat

SEQ ID NO: 139218 - DNA, 642 bp, Homo sapiens
gggctcagtctggagataggtgcaaaagtggtaagtgaagggcggcggagagagaggcattacaagtacacgcacgcttacataatgaaactgttgagggattagaaatatgtgatccagaacataattgagggtggcaaggaacagtgaaatcaaacattcggtgaaagagttggtgctcttcaaggccatggatcaaaaaaaccctctgcacaaatccacaaattacatactttgattttcctgggaatgtccagaccgagtagaaagccctaggggaatcatttaagtttcacttttgaaaagcaaagactgttgttttccaggtagggcagatgctataaacagcaggcaaatgtgctttcccgcagcctaccttccagttcctccagctcagacgtcacaaagcccattaatctccagcctctggtgctacaaaacaattggaacctcaattactcctacccaaaatgtttggattgtggcttctgaaagttttccactcactcctgtgtatgccagagtcattagtagttggaactaagaaaacagattgtggatccagtgttcttggagcttgtccctctcggtgtggagagcctgttgttccaaattcaacagtatcgtccctctccttacatg

SEQ ID NO: 139219 - DNA, 409 bp, Homo sapiens
cagtgaatcaataaagtctggtgcactcaagaaattcaaggaatccaaaggtggtgctgtcctgtggtaaagataagttgcaaagagtagaatataatttttgtgcactgtgggctttttacttgatacagttggctggcccttagaggtcaagtattgcttttgatgttattggaatgttggaaaatatcagaaaatcctagaatgacgaatacgggtagttcatttggtgcaaatcaacccagctcaatttgttaatataacaaatagaatgtgtaaaataaagctttggaggtgggtgtaatattttccatgagacacttaacgtagtacgtaaatatatcaggcagcctagtgtgtcaagtactgtgggtatggtagacaacagattagttaaatctctgctctc

SEQ ID NO: 139220 - DNA, 104 bp, Homo sapiens
tgtcctttctaataaatcttcaacattgtgtcacaaaaaaacctatgccaactccctcaatgtatgggaatggtttattttaataaaatattggagtttaaagt

SEQ ID NO: 139221 - DNA, 107 bp, Homo sapiens
gcaaacaccagcacttgtgccagcaggtcctggcaggttaattctggggctacaggtagcttgcttggataccagtaatgttggcagtgggctgtacagttgttgga

SEQ ID NO: 139222 - DNA, 363 bp, Homo sapiens
ccgatatgcagtccagttgaacagagtagaggtaataaatgtttctaacaacaggtatttaaaacagaaccattaaaaatatattttactgcctgtgtaaaaaggaaaggtaacaacagtctttcatctcttctctgagttctgagtgagaaatacagtttcatgaacacatcctggaaacaaaagaatagattaatggctaggagtgtgaatgaaaatatctggacaacaagtaaagaaaaagtgtatcttaagtggttaagttatataacaatatacaaaaattgacagcttaatatcttaacatataaattagctatgtattttattaacaaacattagtgctgctttacttttattttt

SEQ ID NO: 139223 - DNA, 323 bp, Homo sapiens
ctcattctctcatcccacctgactagaaatacccacaggtgtagaggggcaggccaccccttcaatgccatatcatctcttcaccgacctttcccaatcacgtgctcctttccctacccagcttttggtcatgattttgcaaacaccctcaactccaagtatgtatgttgctaagactcaaatttatatttccagccccaaattctgtctgcacttgagactcctagtgcatacttcattcttggatatgtattaggcatctcaaatttaataggtccatttctgaacctgctctatgccctatatttcctgcctcagtaaat

SEQ ID NO: 139224 - DNA, 218 bp, Homo sapiens
ccctgggttctggagggtcccctcccctcctgctcttgagatcgccctaggaaagactcctgagtagtaagtaggtatggcactactcagctgagaattagatcaacccagaagaaaaggaacatgtttcactgaaacctgcaaagtgctttagaacatcttcagtcgggcgcagtggctcatgcttttagtctcaacactttgggaggctaaggtgg

SEQ ID NO: 139225 - DNA, 291 bp, Homo sapiens
atacgaaaaatccagttcctaaatcctgccaacccactgtgaaaactacttccaggttttgaacaggatattccttttggttaagaattaaattacacccaagtgttcaaaaaaataatctagtcacatggctccaaatgggcatttcttaaacaactcataaacggcctatttcacatggaacctgttacaggacatttccagaacagacataattagggctattcacaccaacaaagtaacgtcactattactggctattaatcagtataaattaatagccttatggct

SEQ ID NO: 139226 - DNA, 414 bp, Homo sapiens
taattactttaattgtaaatgataaaactcttcaatcaaaaggcagagtttgacagaatgtataagaaaaacacaatctacaagagattgtatatgctgtctacaagagactcatttcagatccaaagacacaaataagggatgtaaaaagacattctatacaagtaataaccaaatgagagtgcaggtagctacattaatattagacaaactaaatcaaaacaaggttgagacaaaaaagatattacacatcaataagtgtcaatatagcaagaagatataataatcaaaaacatttacatgcctaataagagaccacccaattatatgaagcaaaaaattgacagaattgaaggtaaacagacagttctgaaataacagctggacacttcgataccctactctcaataatgg

SEQ ID NO: 139227 - DNA, 316 bp, Homo sapiens
cttatcagcaggaacatgggtcacattttagtagaaatgatgatgctaaatttggttggttggtgtaggtgggaatcacctgatctctccatttgtaaaggcacattgttccctctgtaattagaaactaatatgtggggggttttccccactcattcctcatttctagttggtttagtttgtgggatgatattttgagacactgagtatctattccccaaagacatttcacacaatccttgcttaaaccaatttgttttgttttgttttgtttttgagaaggaatcttgctctgttgcccagggtggagtgcaat

SEQ ID NO: 139228 - DNA, 304 bp, Homo sapiens
tcatttccatctccttgagtgagaactggacttagtgactcacttctgatggacagaatatgaagacagctgtttttacagtggagcagacaccatcttaactcagaggtctggctgacatcaccatgaataagacatatcaatatcatgtacgccctgcaatgacgtgatgatagggcaatcacctctgtggtgttcttccccaaaatccacaccctcatttgaaaaaacaccagaaaaaaacaagttgagggacatggtacaaaatgcctgacttgtacgcttcaaaaatgtcaaggtcatg

SEQ ID NO: 139229 - DNA, 331 bp, Homo sapiens
tcacagcagcattatctgcaataacaaaaatctggaagcaacctcatgtacatcaaaatgggaagacacatatttgatatgtatcaaatggaatactatgcatttaaaatgaggaagctctatatttactgacacagaaaaatctacatcacaaattaagtcaaaaaagaaagccacagggcatgcatggtggctcccagcactttgggaggccaaggcaggaggagactgggagacgaccctggtcaacatactgagacccccatctctataaaaaaaaattttttttttaattagcaggccgtggtggcatgcacctgtagtcccagct

SEQ ID NO: 139230 - DNA, 250 bp, Homo sapiens
  misc_feature (15)..(15): n is a, c, g, or t
tctagaggcccctcnttatcaccgaacaggccggtggcctcaagggcagttgtagctctcttggagctctgggacctggtaccgatagtgtgtgagcagagggtgtcccaggcaggtattcagtcctggtggccccttatattctcttcaatgtagttccaacattggtgggagtagccttgccattaaggaatgtataatttccccgggggcgcaggatcgtgagatgagtaatgttggtggagtgaga

SEQ ID NO: 139231 - DNA, 391 bp, Homo sapiens
cttaatggtgtcccataaatcctataggctttttccttctttttttcctttttctttgttttcctttctttctttccccccaccccttggtctgcctatgttacttcaaacgacctgtcttcagaaattctttcttccccttggtctagtctgtctttttgatctagtcttgtattttttactttattcattgaattatttagctctagaacttctgtttggttcttttttatatctgtctctgttgattttctcattcaaatcatgaattgttttccagattttgtctaattgtctttatgtattctcctatttcttctgtcaaaccatatatttgtacccattagtcaatttctcttactctcactctctccctacccttctcagcctc

SEQ ID NO: 139232 - DNA, 549 bp, Homo sapiens
taccgtgtgctttccgttggtgatctcactgtttaaaatgtccaagtggtgtgaagtgctccctgacgtttctacacataaggcggctatggtgtgtgttaaagaagatccatccaggcatgagctgtggcattgctgactgtctttccccagcaatggttcagtatttgctaatactgcttgtggcaactctacgaaacataacttcatgaataatgagaactgattgtacttgcacatcaatattcacaatagccaaagggcggaaacaacccaaatgtccatcaatggatgaatcgataaacaatttatggtatatacacacaaaggaacattatctagtcataaaaaaggaatgaggctgggcacagtggctcacgcctgtaatcccaacactttgggaggccaatgcaggtggatcacttgaggtcaggagttcaagactagcctggccaacatggtgaaaccccgtctctactaaaaatacaaaaattgaccgggtgtggtggtgggtgcctattatcccagctacttgggaggctgaggcag

SEQ ID NO: 139233 - DNA, 187 bp, Homo sapiens
caccccagcctcctgagtagcttggactacaggtacatgtcaacacgcctgactaatttttaaatttttttgtagagacagggtctcgttatgttgcccaggctcatcttgaaatactggactctagtggtgctcctgcctcagcttctcaaagtgttgggactacaggtgtaagccactgtgccca

SEQ ID NO: 139234 - DNA, 199 bp, Homo sapiens
agggtggtgtggcagtagacaaaaggatgcctatttcaaacagcactgttagaacagcaggtcagcattaacacttaatccccaaggttgttgggatgaacagtattaaagtacagtcgcccctctgtacctgcaggttctacacctgtgaaatgcagtcctcagccaggtgtggtggctcacgcatgtaatcccaaca

SEQ ID NO: 139235 - DNA, 300 bp, Homo sapiens
gtttgtagggggccgccatgttggtttggggaggccaataagtgaagacctccgagccgctggaggcgggacatccggggcgtggtttagaaagagtgctttcgccgtgggtgcagagggtgggcccgccgggttgggtggggggcgtgtgatgacggtaatggcgacgagatgctcaactcacgcggcctcttttaatcctcacagcagctctgcgtggagaaactacagtaacgtgttaccacgttaaggcgggaagctgaggcatgggagtatttagtaacgttcccgggccgtaga

SEQ ID NO: 139236 - DNA, 420 bp, Homo sapiens
ccaacatccactcactgcctaagcctgggaccggtcatccttctttccttctctctctctctgtgtctcatgtccaaataccaagtcatatctaccctaaatacctctatttcttcaagctggataccgaatttcaacatgggagtgctcaaagaatatctgctgctgggagggttacagggctgggggctcatttcctagccgtaggagcatagctaaacactgctttgaatttaactttctgtttattgaggtgactttcggaggtgctttgatcgagattatgggaagtggttaaagacccctaacctctctgccatcactgttccttctctcagtccctgccaccaccatacccctgagggaggcagggcaactacacagcctcccacacagagtccctgccttcctgcttcttct

SEQ ID NO: 139237 - DNA, 172 bp, Homo sapiens
aatccacattacgaaaaagttacctgatcaactttataaacttctaaaatgatggacaattaaaaacttttcagtacttgctcactgttacacattcatttataaaatacctttacatggagaaataagactgagaaattaaccatcagattctattggagtatccctacca

SEQ ID NO: 139238 - DNA, 227 bp, Homo sapiens
gctggagtttgaaacaaattaagaagattctgtagtagtaatctcgatgagagatgatgccagttggacttctggagaaaaatttaggagctaaaattaaaagctttgaagattgatttctgagggaaatgagagtgaagatataatcaggatgacttctggacttctggctctcttttatactaatttatttatattcagtatctcaggtatgaaatttcatcaac

SEQ ID NO: 139239 - DNA, 274 bp, Homo sapiens
tttcaaagtcagtcattctctttttctgttggatattgaacttttaattaagaaatcgtggtagtttttaatttctgaaaatcttttctatttttagttctataattccatgatatttttcattaaaattatcttctgtctcttccattggttctgcttcagtagacatctctcttatttctgttgcactggtcatctttcttcccatgccccataaatgaatttaacttttcctggcctactcaagctatggtttcctcagcatctgccagca

SEQ ID NO: 139240 - DNA, 194 bp, Homo sapiens
gaggggagcaattctgtgtggtcacggggacagatcaatagacagaggccatcttgtctggagttcttgtgaatccaggtgacatggagattacaaggtgtgtgtggtagagggaggcagcaacaccttcttgaggacagaagtcaagcctctgttcccaagtattcctcactctgctgcttcttccaaacctt

SEQ ID NO: 139241 - DNA, 244 bp, Homo sapiens
ctcttagttgaggaatccaggttgtagccctgtaggttgactagatatgactggtcaaatgctttccagttccttaatggtaagacagtcaccctggccagtagaatgactgggaactattgtaaaatgtcatagtctaccactttcgcctcttcctctcttctcatgggtatgcgatgttagaatcaaagaagatcagagcccttggagacattaaatagcatgggcttccctcctcatttta

SEQ ID NO: 139242 - DNA, 191 bp, Homo sapiens
tttctctgtacgacttttcccattctctcgtggtgatgtcttcttcatggctgctacagtatcctagattctgcagcctgccttctctcaaaatgtctgcatacttttgcatctttctattaattgcatccctttcttagaaaagaagatcttactggggttgtggtgactttccagtatggactataaag

SEQ ID NO: 139243 - DNA, 519 bp, Homo sapiens
tacatttctgataatacataaaatctatcccataggttctttgatcctttaacttttcgataaagaaggtacagaaagtgataggaattgaacaaaactagtggcttcaaactttggcaatccaacacacatgcacacacacatacacacacaactgaaaagtgtcatgaaacaacatttatccttagtcatgaactctgatattttctataactttttaaatgctggttgtggctcactaatttgctttcatgatttagtaaaaggtctcaacctgcagtttgaaaagctgtggaataaaccacatggccaccaaaggcagaactagaacagtcttcaaaccactcagctccttcttcatgggttattattaaatcagaaagggcctaagtttcacttcttgctgtaaaagaaactgtacattccgtatcctcctcctttgccctccacagttcacgtgagcactagaaattcagagaacacccaggaaccagtgggcacttcctatgtatgcaactc

SEQ ID NO: 139244 - DNA, 473 bp, Homo sapiens
tacaggtgcactccaccacacctggctccagtgagatcttttggcccacactcacccacttcttactttcatccttcctccccaggaagccttccctgacctcactcttcctgcctgggttaggtccctgcctccatgttcccatgtgttttgttatctcacaataccagccactgtactgtacttaactgcttacttctccattaccctgatttttccttgagtatagaagtgactttggtttaccattgccagtggcatattgataaatgtttaccaactagttctctcttgagaaaggtgaaaaaaaaaaagaccatgatttatagtgtctgcccatttctgtggtgtaaatacccctaccactgtgaccactttcaagctaccaatgtaatagcactgaacacaaatttggggagagatgtgcaggaacacagtgttactctgtatttctactatgcagatataataga

SEQ ID NO: 139245 - DNA, 1003 bp, Homo sapiens
ttcctgccacagttgcctcacgtctcctccctcaaacctcaccttcccctcatgggccttctgtccgacttggggtacccctagtggccagacgcacaccctgggttcgaaactgggacaccagggtccccggggcccagcgcaagggctgatgcgaagacactttcttcctcggggacccaggctctgcttctctgcgacgtttttgtttttgtttttttcgcttttccccaggtgcctcaccttcccctcatgggctttctgcccgccttgaggtaccactagcgggcccgaagcgcaccctggtttcgagccagggacgctagggtctccggggcccagttcagggctgatgggtagggacgttcgtctgtgggggaccaggccccacttctgggcggcgcagtttttttatttttttctctgccccaggtgtctcacctttccctcatgggccttctgtctgccttggggtacccctagcaggccgaggcgcatgctgggctcgagccagggataccagggtccctggggcgcagcgcaagcgctgatgtgaggacagtttcttctgtgggggagccaggccccgcttataggcggcgcggttttttttttttttttcctctgccccaggtgcatcaccttcccctcatgggccttctgcccgcttttgggcacccctagcggcctgaagcgcaccctggtctcgaaccaggaatgccagggtcacctgggcccagcgcaagggctgatgggaagacacttttgtccgttggggacccaggctctgcttctccgtggtgcggttttttttttttttctgccacaggtgcctcacctcgccttcctcaaacctcaactgcccctcatgggatttctgcccgcttgtcttccgaggctgcggtgtggatctcgcactgcggccgcctcgccttggctggggagaacctcggtgggtaggattcagaggggcttttggtttcccattttccacactgaaccc

SEQ ID NO: 139246 - DNA, 441 bp, Homo sapiens
attcctgaagaatattcctttgtatgaatgtttcagaattagtttatccatttctctattgtaggatatcttggttacttccaatctttgtcagttgtgtataagctgctgtaaacattcatgtgcaggatttgagtggatataagttttcaaataccaaagaatgcaattgccagattgtatttaaacatacaaggatgcagatgccatacacacaaatatgtatgtatatgtcatgctcatatacaattttaaatacatatatgtgttctatggatatataagtatttctctactttcacagaaatgtcactctaaatcagtacctaggaagggtcatcattttcttaatctacaaatcaagacatgatatgagtggctgcatccttgtttagtacgtcctctattattgaggatgttttcctgtttcctttttcattg

SEQ ID NO: 139247 - DNA, 339 bp, Homo sapiens
aggaaaataaccactttattctgaggagaaaaataatgttagtcatataggataggcagggaagttctattaaattaagacccagaagaggagaagcctctttgggaacagctggatttctgtggcagcaataaaaacaaatgaacaattcagaaaagaggttgaagatgcaaaggagtttacaggagctccagggcaccaagggcaaaggagattgagccagatcaacaaacatactgagcccagtatgaagatgagctaattatggatacctgagaaggttgggcttcatatcatcactggggtgaactgggaagagaggcatggttgaattaattg

SEQ ID NO: 139248 - DNA, 309 bp, Homo sapiens
atcacataagccttgattttcataatgcagacagtattctctatatggctgtaggaatataagacttcagtggtgtttgcatagtaactcctttttcaccttctactacaagagcccctcttgtagctggggagtgcacccacaagatctaacagctgtttcagagctgctcattttagagtgattggtagggagttggtggctcagaggtcctaatcagaatgtgtcctgggttctgaatgactagcagactatcattaaccaaagtgctgggattacaggcatgaaccaccatgcccggcccaattt

SEQ ID NO: 139249 - DNA, 260 bp, Homo sapiens
agaatttcttctttctgtggagttttacctgttgctcctctggctgacctcccgatagatccctgtggtgccaggcaggaatggcctgcctggggacacagtgagctcccagggccttccaactgcttcctctacccctgtattttgctcggctctctaacttgactcagcttcaggtaaagtcggaaactcctcctgcacacaaaccttcagcttctccagtgggggtgtgtgttccagagaggagggtctccctttcc

SEQ ID NO: 139250 - DNA, 390 bp, Homo sapiens
tggcatttcataatctccttgttccaatgtgtctggggacagctaggcagactttacataagtacagattgcctctctgggcactgctgggagacttcatttgtggcaggaggagtgcccccaggactggtgagataatttgagctttaaatagctcctggcccttgaaataaggacagcatgatttaggggaaaggccagaacttgatctttgtggccttcggcacgctggcctctccttgcactggaggcagtcatgagggctgcaccgcggggcggtttgtcttcagcattcgcacactcagtaaagtatgccagagatgggtggcagcagcgcccaagggctcagctccttccaaagccaagtctgggcagttttttttcaggctg

SEQ ID NO: 139251 - DNA, 143 bp, Homo sapiens
ccaggaggagccacgggggtgattagaaatctgccttctttcttccatctggcaggagagatgttttcttttgttacgtgtgtaattaggatgatgagtgacttcaggcaacggcccctctcctggttgtggggtttctctga

SEQ ID NO: 139252 - DNA, 300 bp, Homo sapiens
agctgggattacaggcacccaccaccacgcaggctaatttttggtagagacagggtttcgccatgttggccaggctgatctcaaactcctgacctcaggtggtctgcatgccttgctcagcctcccaaagtgctgggattacaggcgtgagccactatacctggccactcttttaaacttagagaatgaaattgagacagacaagcataggtatgagatgaccagttaggaggaagttattacagtggcttaaaactaaatttgtggtggagatggggacttggggcgctcggccgggta

SEQ ID NO: 139253 - DNA, 428 bp, Homo sapiens
gaagctggcgggacaacgtgtggcgagcaagagctagcagacttcaagaccagtctgaccacaaaaaggaaggaaagaaggcatttgactttcttttgtgaaaactgaaacatcctagtaaccatctgactagtatacagtttaaccactactttgaactaaatttcaggaacatagtccataacagacaccctgtgattcccgagaaaacgcaacattttagaagaagacttatccaacgtgaagatttttttttacataaggcaatgaaaggcatcatttattctcgaaatgtgtcatgctctcagaagtgtggtcatatactgaatcaaagtctacaatcactcatcttcccacgcctgggaaatacagcctcatcatgtgaacaggccaaacattcaaaagacactaaaattcttcaattttcc

SEQ ID NO: 139254 - DNA, 171 bp, Homo sapiens
gctgggattacaggtgtgagccactgtgcccggcttatactgagagttttaaaattaatatttcttagattttttaaaatttatgtaggtttttaccatattttttcatagtatgtcagagtataaatgtactgtaattttttgagacattcagccggacatatttaggtt

SEQ ID NO: 139255 - DNA, 254 bp, Homo sapiens
ctcctacaagctttcattaactcttgcttgaattactgattgactaactagtgtctctagatcccctctttaacatctccagtccactttccgtatcacggctagaatgatagttttgaaatacaagtctaattgctttacatcctgttcacacacagtaatgacttccctggtcttgaagtatatatttttttaatttgatccaccaggctttgcatggtctggctcctgttaatcttgcaaggattactttg

SEQ ID NO: 139256 - DNA, 436 bp, Homo sapiens
tgcacctggccccacagtacttctgacaccagatgtgtgggaattttttcccaactgaccaattctctccacataccaactgggtggcttgtgatttgattcagttctgacactgtctacctgatgttaccatcagaacccacaagttaaagggctcagtcctacaagactgcccccacttgaagctagtcacaagtccaggtttgtacttctgaccaactggctataaagcaaacaaggtatgctttctctgaggtcactaccttcccagcacttcagtgtgttctgttcaccagcccagaagctcggctcatcacatctcaatgttcaagagttttgttttttaaaaaaaacagccttactctgtcacccaggctggagtggagtggtgccaccatggctcactgcagcctcaacccccaggctcagatgatcc

SEQ ID NO: 139257 - DNA, 212 bp, Homo sapiens
gggatcttcttagggaattggtatgggaagaccttgacgttagcattttatacactgcataacctcattactaagcaaatcttcttgtttaacattaaaactgggccttcaagcaaggtttcattaatgccacccttatattttattgattacaaatacatagatcctaggagacagggattttttttcttttcatttgacctaacccaggg

SEQ ID NO: 139258 - DNA, 518 bp, Homo sapiens
tctccagctggtactccaagacggagagtgcctaggccacaggtcatgagagcattgctttattagatcagtatctgcaagcaggtcagtgacagtcttcccaagacgtccttgagcccctcagagcatccccttctgcctcacgtccttgcaaaatgtggtttaacaagcaaatacttccaagaacaacctcatactgctttttcctcctaatttgtatttccagataaccaagtattacctcaccttcttctatttaacaactctttatttccctgtgtgtaacttgtttttaatattgtcaaaattactgcaatgcaaatgaggaacatcagggatccagcgggaccgctgggaatatgtgcttgttccgtgttgaaatgtcagtttcatttccagcctctgaatgaaggcagtgaccgagcatggctactgtgagatgcaaacactattcaattaacagagttacatagaaatgggctcaaggacctggtcttccctggacgacagaagtgtca

SEQ ID NO: 139259 - DNA, 385 bp, Homo sapiens
ccctgaaccactgcaggtgtgctgaggcggctcacctagcgcaactgctacaacaacctcatactgctttttcctcctaatttgtatttccagataaccaagtattacctcaccttcttctatttaacaactctttatttccctgtgtgtaacttgtttttaatattgtcaaaattactgcaatgcaaatgaggaacatcagggatccagcgggaccgctgggaatatgtgcttgttccgtgttgaaatgtcagtttcatttccagcctctgaatgaaggcagtgaccgagcatggctactgtgagatgcaaacactattcaattaacagagttacatagaaatgggctcaaggacctggtcttccctggacgacagaagtgtca

SEQ ID NO: 139260 - DNA, 268 bp, Homo sapiens
tggtggcttgcgcctataatcccagcactttgggacgccaaggtgggaggatcacctgaggctcaggaactcaagaccagtctgggcaacatagacccccatctttaccacccctacatccccaaaattagccaggtgtgatgtcatgctactgagaaggctgaggtgagagggttacttgagccctgaagttcaaggccccagtgagctgtgatcatgccactgcactccaacctcagtgacagggctagaccctatctctgaaaaa

SEQ ID NO: 139261 - DNA, 268 bp, Homo sapiens
aagttcatgaacttgtaacactcagctcccctaaaataaaatgaacttatatacgaaagtaagtactatagatttagtagggaaaaagggatatatgaaatgctcatttgctgcccttcaaaaatggaccctgaggttttcaatgaacatcatgtgtgagaaatcagtttctaagctcgagaaacagcaagaggaatatctagaagaactttaaattagaaccacatacacactggaaaaacaagtacattttgttataacaagtgaa

SEQ ID NO: 139262 - DNA, 195 bp, Homo sapiens
cccataaacaaagtgtacaccggctcactattctcacgtttgtaaggtctcaaagagcccacagaccccaggccaagaggccttgatccaggactgtggggaagacttcctgctctgagaagaggctcagagaaggtgcactgcccaaagctcagggaagacagagcgaggcttgcaggtggcccttccatggtg

SEQ ID NO: 139263 - DNA, 367 bp, Homo sapiens
caggctgagtcccacctgtccagctgacgtcacagcctcttgcttgaattggcatgggcggtgggtgtgagcccctctggtgaggacagcgttggcagctgctaggcactgtcccccttgggcagctgtgggagcagagggaagagagactgggggtacccgccttcccagatggagcgggctgctcatgggacttagctggagtttccaaggagactgaggtttgggggtttctgtgagctggccggatgttgctgaagtgcctctgccctctctggcctctgtgcccttattatgtgtaattctgttctgcaccgccctgctgtgtaaacttggcaagttctggtcccctctcctgcttgtagtt

SEQ ID NO: 139264 - DNA, 185 bp, Homo sapiens
aggtccgtaggaaatgagctcattctctcaggctcctgcttgctttgctgcttcaagacaagggacagtgtgtgcataagtcggggctattcctctgcaggtctgttccctgcactctgggggaggagtccgttctagcttgcccctctgcctccattccccagaagtcagggctggcacccctc

SEQ ID NO: 139265 - DNA, 119 bp, Homo sapiens
agtctattagatgtctatcaccaagcaccattggcacctcaaatttttcatgttcaaaaccaaataaattcattatctatcttcaaaattttcttcttgtactcttaataaattggatt

SEQ ID NO: 139266 - DNA, 388 bp, Homo sapiens
cgacggtctttaccctgaaaaattgtgatgccagacagtaatttaaatccacacagaataacaaagagttccagtaaaagtaattatgtaagtaattaattacaaaagatggtataactgtagagttcttctccttccttctctgaactgatttataaagcaattatatagaacaatatgtatataattacattattcggtttataacatacagaaataaaatatatttggaaaaacagcagtccctccatatcaggagggaggggatacattccaagactaccagtggatgcctgaaatcagacacagtaccaaaccatatataccacgttttttttgatgtgataaccaagatgcctactaagtgactaatgggtgttgcctatat

SEQ ID NO: 139267 - DNA, 476 bp, Homo sapiens
cttaatttaactcaaaatgtaaggattttcttttacctacaggatacagcttagtgtttaaatttgcaggccctggagacagaaaataagggtctaaatctatgctttgtcatttactagctaggggacttgaacatattacctactggaagcttcagttacttcatttgaaaatggagacaaggttgcaaggtgtggtggctcacgcctgtaatcccagcactttgggaggccaagaagggcagatcaggaggtcaggagattgagaccatcctggttaacacggtgaaaccccgtctctactaaaaatacaaaaaaaaaaaaaaatgagctgggcgtggtggcgggtacctgtagtcccagctactcgggaggctgaggcaggagaatggcatgaacctgggaggcggagcttgcagtgagccgaggtcctgccactgcactccagcctgggcgacagagcgagacttcgtctc

SEQ ID NO: 139268 - DNA, 389 bp, Homo sapiens
atttacaagatacactatgcgttggagaatgcacagtggaagggcactggcctaggagtcagaagaccaaaggactcttctcccacttacgctaccttatcaccgtacttgaacaagccccttcgctctctgcacctcggcttcttcatcaatctgatggtttaattcatcccccaaacctctgtgaactcccacatgtgccagatgtggttctaagaaagaaatgactaagagtaatggataagaggctgcgcccatccctcagtagccctgcaccaattccactccacccagcccactaagcactaacggagagaatgcacaaagaacagttttcaaacaagtatgaaacagagagggtccttgagggaatacatgcttcacaaaag

SEQ ID NO: 139269 - DNA, 380 bp, Homo sapiens
ggaccagactttgaatgacaggccaaatttggaaagtatattatgctcctttgactccttgggatcatagaatctttgatctggaaggactctcaaaggtcatccggtttcattctctacttggttctggaggaggcccctatctctaattaatggaaactgaggattctccttattggctgcattttaaaacagattttgctcccacttgtaggtggtaaaaaggaaatatctggattaggagggcaaacttctgcttttaggcagtaccctgcattgagggatgtccaaatcaccttgtctttatttacacatccatacacaatggaatgctatgtagctgttaagatgaagggggtagagcaataaaaacaataacc

SEQ ID NO: 139270 - DNA, 512 bp, Homo sapiens
cgcacgcctgtaatcccatctactggggagaccaaggcaggagaatctcttgaaactgggaggcagaggttgcagtgaaccaggattatgccactgcactccagcctggactacagagtgagactctgtctcacaaaaaaaaaagaaaaagaaaaaagaaagaaaaaccataatattcccctgaaaccaggggaaaagttctctcccatagttcttgagaacgaggatatagtcaaatagtaaatgctattctctgcatcatatgcatgtttaatttcacaacattatagggcagttgcttgctaaagtccctcaggttaatctgtcgaattataacaaaacacatgtcagtttaatctgttctccagcagatgagagaaaacagtcctggtttctagctctctcatcctttagctaaccaaaatcagtttttatattatatggaggagtggatgaaattgcataacttcagctaattctccataaatattactcctctggccaagttgttt

SEQ ID NO: 139271 - DNA, 260 bp, Homo sapiens
tgtgtatgtagctatatcccctccaacacctaaggcaatgcatttcacatcttgctgagagcagataactcaatacctggaactagaaaattagaatctaaaagacggaaggcatctaaagaccagttcccatcatgccacagctgagaaattggagacccaggtggttaaatcagatattgagttaatgtcagctggaatgcagatgttcctactctgagttgagtgccctttcctctgtcaggttgcttgttccgctg

SEQ ID NO: 139272 - DNA, 400 bp, Homo sapiens
ttttataggggacttccttcagctaaaaactaatttttctttgttaaacatggattttctcattttggttttgagaattactcctatttctcccaagtggactcataaaatctctgggccaaattagtctaacagttccgatctatttttataatccaaatctataaactcacaaaataaagttatcttaccaaggaaaaacttctgggctggaagaaaaatagccactatgatatagggaagctagatttatctcagacaatggaatactctattctagagaataatatattgaaatacctgaaaaataatgggacaaactgacatcaggtgcttcttggcaagatgcaatgaggacacaggatctcttttttttgagacagggtctcactctgttgcc

SEQ ID NO: 139273 - DNA, 348 bp, Homo sapiens
ttttataggggacttccttcagctaaaaactaatttttctttgttaaacatggattttctcattttggttttgagaattactcctatttctcccaagtggactcataaaatctctgggccaaattagtctaacagttccgatctatttttataatccaaatctataaactcacaaaataaagttatcttaccaaggaaaaacttctgggctggaagaaaaatagccactatgatatagggaagctagatttatctcagacaatggaatactctattctagagaataatatattgaaagttatcagcaatattaagatccatttatattatacataagatgccctttac

SEQ ID NO: 139274 - DNA, 227 bp, Homo sapiens
tagaataagcatgtggcttccaaaatggaataattaatgataaggacataagaaaactcctcatctttccacatggagatatgtcttctgagtgcgtcaaataaaaaacagaatttccaactgttgatttattggtttgccattatgactaacccagcatgtttttataacagcccctaccttgacatacctatagtttggtgtatatccattcatcaatcctcatg

SEQ ID NO: 139275 - DNA, 137 bp, Homo sapiens
cagcacgcaagtcaatcgtagttgagtttgctagtgtttttggaatgaatgaatgaatgagttcttttgctttggagtctttcactctggctgtctctgtgggagacctgtgggcagtaaacagttatctacaaaaa

SEQ ID NO: 139276 - DNA, 322 bp, Homo sapiens
cctgccaccatcctgggcaacttgagaatccacctggaaagtgaacacctaaccgaaaattccttccacaggcccttcagtcattccacttctccaggagcctggtcccatagctgctccctgggcctcatcatctcccagaattgttacatctcgagttgcaaactcctgtgtcctgtgtcctgaccagtgcctcttccctttctccccctctcttcctgtcatttagttttgttgaagcttccagttccctggaccctttcttagttttctcccagtttccctcctggcttcacctctccgtcctgcccagattgcatga

SEQ ID NO: 139277 - DNA, 298 bp, Homo sapiens
acacctcatttcagttcatatttttctgatgcttcaacatcccacaatcaactccagcctgggcagcagagggacagtgagactgtctcgaaaaaaaaaaagtgttataattttattcaatgcacaaaacaaccttgtatattagcatgataggccatgcttttatatgtgtttatgaatgtgtgtatgtgtgagtgtgtgtatacacatttgtgtatacgagtgtaagaatacacacacaggagtttttattttttattatttctctttctattttaaattaaatttttaacaaaaa

SEQ ID NO: 139278 - DNA, 259 bp, Homo sapiens
ctccttctggacaaagagcagggcctggggcacccgctatgtgctttgcaaatgactaatgcacaaaaataaacatgtccttgattttcctggtaagtcctggcttcaatgatcgtacttcgctctactcaaactttttaaaacaccagaaacataactgtctggcaaactgcctgtcagactgggaacggcccaaaaatcccttttagccagtgtgtctaggtcagggacgggttgtcatcactgaatgtattacaga

SEQ ID NO: 139279 - DNA, 288 bp, Homo sapiens
ctcaaagaaacttacagcaataaattgtgaataagatttgggaaggggtcacggtaatgatggtggttcataaggctacaaagggaagaccatgcaagtcttataaatgaatatatttggtctatctactactaatgtgaagatgctaacagattttatgcaaagcaggtgaaacggtagatttttatttggaaatatattcacaataattgactgcttcctttgggaaccacaggtactttgggaatcttttttgttttttggttgagacagtctcactctatcacc

SEQ ID NO: 139280 - DNA, 168 bp, Homo sapiens
gaagatagctgtacttcaccatgatacagtaagaggaactaaactaaattctttacaaaacaaacaaacaaaaaacaaaaaaacacacacacaaataaaaactaactgcagacaaaatataatcaacagtgattttttaaccattgacaagaagctgaggatgctgat

SEQ ID NO: 139281 - DNA, 390 bp, Homo sapiens
tggcacatgtctgtaggcccagctacttgggaggcttaagtgggaggatcacttgaggccaggagttcaaggccatagtgcactatgatcatgcctatgaatagccactgcactgctacctgggcaatacggtgagactctatcttgtaattttttttaattaatgcctttttaagagttaaaatcatgtactggttaatttcactaaaaccagaaattagtggaaggcttgattaagggaggctttatttgatgttaacttaccattccatagactataaagaacattataaaaaaaccctctaaagtgacacatgccccaaatgaccaagacataagcaaaccttttaaattactcatctttcatatgtgtgtttgttcccctactat

SEQ ID NO: 139282 - DNA, 356 bp, Homo sapiens
gaaaaccaaaatatttacaatagcattttcccaaaaagttaccaataaataccatttctgaaaccaaatttctaaaaggtgcatgattttaaggtagtttattcttgttaaaaacatagtaacagattaaaatttaagaataaaaaataagtgagaacacggtttttgatataaaagaattttttgagtgtttgaaaccgtttttaatccaaaacctgaaatacatagattacatgaacacccaggatgctttattcttacaataatgcaatgtaaatatttagatatctgaaacgaagtatagctagattatctagtataattagatatacctagtcttatgcaagtagtaagcc

SEQ ID NO: 139283 - DNA, 554 bp, Homo sapiens
gcttctgggtaaacacatacaaacagtggcaaagaccaagtacagtctctcgcctgtgctgtctcatgggactcaatggtggtgaagaaatctcaatcggacaccagaggtgggggcaactctgcaagctcacctgctggacgtgagaatgttggaacgttccagttggaaggttcctatgcctagcctgtgtgccatttcatggcagatatgtaagaaaggaaatggccctactgtagacagcttatggggcccagaaaggcactgggctttaaagagcgaaatgagtgtgtcatttccacatgaaggagaggcaaggaaaagccccacaaaattcctgttacccgctgaactccaagctcaccaaccagattcatgagctttctcacattttccatttccaaataactgttgtgttgaatcagctgtgttaatgcctttattctttgttttttttttttagacggagtctcgctctgtcacgaggctggagtgcagtggccccatctcggctcactgcaacctccgcctcccaggttcaagcgattctcctg

SEQ ID NO: 139284 - DNA, 436 bp, Homo sapiens
tctcagtctcaaccacggatgcaaacaagttttatctgtctactgcgactttcagcccttgtcaaaaatgccacaatcacgggttcccatgccacatgtcatcatctccgcttctgcacctggatgctcagttaaggctcagtcctgaaaataaactgtttgtgaatgaggaaatcatctccgcataattggggctgctgaagagcgtgagatatcattccaattgaacagtcttctgaatttttaccctgtgatctgaggagtggtgcatctaatcaatcacctaaataatgattcaatctcttgttgatgtacccatctatgggccttctatagacattttctccaggcctccagtgttttccctatctcctggaagaacatcagcacttcctcaggagtgaatcaagtaagtcatcagcaccagctctagcac

SEQ ID NO: 139285 - DNA, 692 bp, Homo sapiens
ggacataatatagtctaagtccatctaggatcttctgttttaagagacaggtgtaaagatttactctcaaactgcaggatgggtggaaagtattccagatcaaggttccagttctccctgggagcacccacatttcttttaaggtttctagcagagatgtaatgatgaaattactcacaaaagggattagatgcaggctggtagttgcagttactgggttactataaatttcgtgtattgatgttctacatatgtggtaagaatttatttactgtgtagtatgtttaaacatttgtaagttttatgagctagttcctcctgtgtaagctgacaattcaagttgttcactgttttcctgtgacagttattatctggttataaaattatcagataaaaataagagaaggttattactttttcaaatacaacatgaaagtataaaaaagcagactttcctttgtaattgcataacattgagataaatacttcagagtaatttcatctgatacttattaaaaatcattttcatgacgattaaaaaaaaaagggttcccaaccctttggtagatcaattcagaccaaaattagtttcttgaaaattaagcacaataaatatttaaagcacaaagaaaaatattaggtaaagaaatcatgaagtacttagtaattttccaagtagaagaacagtaaac

SEQ ID NO: 139286 - DNA, 413 bp, Homo sapiens
cacggcagcttagtctgtctctgccaccctttgatattccagatgcaagggcctagagggaaggacccacttccagttttctgttcttacagcattaactatcatctcttcttctcctctttgcaccatttttgaagcttgggatacccctacctcttctgttacagaataagattggttgaggggggccatggctaagtggatgggacaggaatgaatttgtgtgatagacatagcagaggcttggggattggaacagcattagtggacaaagtgaacacagggagcagtgctcacagatccatctgcagacagcaggcaaagggcacagaaaccagtggaagttggtatcatggtaactgggcttcctgggaagaaatatgacctgtgttgatttgggaggggagatacag

SEQ ID NO: 139287 - DNA, 313 bp, Homo sapiens
gaatggcaccaggactgcagctgtgtgcagaggaagggttagacctggacaggtcgtgtttggaggtatgacacgggggacctgcaatggctgtgtgcgtggggtgtgtggggataaggcacagtcaaggaggacccctcagctgtttggccgtacagagaaatggtgggctgttttctgagatcagtccttccaagtgcttttgaggcattcttaaggtaattagtcaaccaacagtggttgtagtgaaaaaaagtgattttaaaaatgcattagttgatgactgatattcatacctgagggtagagggaga

SEQ ID NO: 139288 - DNA, 221 bp, Homo sapiens
tccaaagctacacactgagactaggatgacaacgagctacctactcaggattttgcaaggaccaaaaatcttttcttactttacaatactctcaaacagaaactattttaaactacatggttaattcaaccttgtggactggatggtcatcaaaatgattatataattatttcaacatagttgcatttctttctttttctttgtgtgtgtgtgtgtgtgtg

SEQ ID NO: 139289 - DNA, 442 bp, Homo sapiens
taagctatgcatcctttgattttcaaattgattataaaatccttagtctcatctcttacaatccctggtctaaattttaaatgtgggggatcattttgtctgtgataagtaccatcattaaggttaatagaggtgctggaggaacatctgagtcataaaggtaaggacatttgggggatacttcacagagagatgattgtgcaagtggtatatgaatgctcaactggaatgttttccagtctaaatagataaatagaagtagaggaagattctctaggtagagggaacatcttgtactaacacaagggcataagcttttctgggaatgataagaatccctgcacagctctcagacagaatttatgaaggacgtttaaggatgcaactagaaagatagattaaggtcacactgggaaattccaataaataatattaaatcagc

SEQ ID NO: 139290 - DNA, 397 bp, Homo sapiens
cagaggatcctgtgagccttaaccctgctctggcacctcagctctaggttcttgaggcatcctgttccttcttctccaacctctgatcttcctacccaccctgttcttctctttcatattccccctcccctctgaatcacagttattcatggactcctctatagttttctatctttccttacaacccacaccctcagaacctcacctgtaagctcacaagctatttgctgatttgggaattttcttgaataaagactacccactccggccgggtgcggtggttcacgcctataatcccagcacttgggaagtccgacaagggtggatcacttgaggataggaattcgagaccagcctggcctacatggcaaaaccccatctccagggtaccgagctc

SEQ ID NO: 139291 - DNA, 402 bp, Homo sapiens
tttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgacttt

SEQ ID NO: 139292 - DNA, 214 bp, Homo sapiens
gcataggaggtacgtacctgtggtcccagctaggcaggaggctgaggcgtgaggattgcttgaacctgggagttggaggctgcagtgagctagtatcacactcactgcagtgagtgaataagccgagtgtttggggcacaaggagagctgggagtttatcggacaaaagtggctatgagtggtttgattggatgatgaaaactttgggtcaaag

SEQ ID NO: 139293 - DNA, 346 bp, Homo sapiens
gccggtgcgactcgtagaggaatccccgtccaaaccgtatcagaactattaatagaagaggctccagggatcgtgtggccccaaacccctcattttatacggaaggaattaagatgatgaggagctttctgagaccaaaacttaggtctctctgcctccctgcactgtgctttttttttttttttaaaccagaacaagcatggggaagagggcaaaaagcatttagcacaaaatctcattaagaaattgacattcatggccacctgatagtgtatgaaacactctttaaaattcaactgcttccccatgtttgttctgatacggttttgagggatcctctagatca

SEQ ID NO: 139294 - DNA, 374 bp, Homo sapiens
caacaaaagaaacctattggcctatgttcttgataaataaagacgtaaaagtcctcaaaaaaatactaacaaaccaaatctcctaaacccagcagcacattgaaaaaaattattcaccatgatcaagtgggattcatccgagggatgcaaggatgaatcaatatacacatattaataaatgtgatacattaataaatgtgatacatcacatcaacaggatggaggacaaaaaccctatgatcatctcaatatatgcagaaaaagcatttgataaaattcaacatctttttgtgacaaaaactctcaccaaataaggtatggaaggaatgtacctcaacacagtaaaggccatacaagacaaacccgcacccaat

SEQ ID NO: 139295 - DNA, 235 bp, Homo sapiens
agttcctgcctgaggccctctagccaacttccccttgtaatctctgtgatagggatctcatttcactccaggcaggggctgcccactgcatgagctagcagcctgcttttccttatttgctgttttatcctattgtaattttcatccacctatagaaccgtgctcccgggcgtggtggtcacacccgtaatcccagcagtttgaaaggccaaggcgggcagatcacttgaggtca

SEQ ID NO: 139296 - DNA, 475 bp, Homo sapiens
tgacagcacagggaaagaacatgatagaaatagactttcagaaggaagggccttccataacaaggaatgccatctgtaatccagactttttcctcctcaggaatccagtcataggcaaatctctatgaatcacagataaatggaaagaagggtgggagtgtgtcaggagtaggatgctgaaaatgtgagtagcctgttcattaattggtcccttggaaactgagaaggcaacgtggcatacatgcaatttccatggaatgatggaagactggttgtagttagtatgatactataatgctcagatcacaacggggtcacccttattcatgattgagcattccttcttattagtatcccaatgtgaaattgtttctcaaaaaaggagggggcgggtaatttttgtacaaaaggcttttactccaaaataaagtggcttctactgtatttctcctctggagccttgccgctggctcca

SEQ ID NO: 139297 - DNA, 427 bp, Homo sapiens
gggggccctgggcccggtcagtcctcagcggctaggctgaggagctgcgggaatgcaagcggttcttcactttttgtcttgttaaaggggtggtggctctgaggagcaggcttgtctgtctgttgagaggacagtcggacttccagtggcctgtctgctggcacactggacaaggactctttggcactcaagggttaggatacacccatgcccagtggccttctttgccacacttaaaacaaggcccggagggttgctgctatcgggtcttttgtgcccttgggtgatacggctgggttgatggacagccgctgctagaagctggtatttagcacgatctctttgggctttatctaatttattttgctcatccctgttattaaagactttgaaagccaagttaaggaggtctcgttgtggggtctga

SEQ ID NO: 139298 - DNA, 281 bp, Homo sapiens
tcagaggagaggagaatggcgtgaatggggagaaagaacagaacaccgcagaaaagacgctggagctcatctctgtggccccaacgacactaactggcccaggtcacactggctggaggctggtctggtttctacagaggctgaaagcagcacacagtcacctcagtctagaaacagaagcagacaaaaaggcagaggtgggaatcctctccaacaggacgaagtagcggtcaggaatagaaacacagggacacagctccccggcaagagctcaaatccac

SEQ ID NO: 139299 - DNA, 412 bp, Homo sapiens
atttgtcttttctctctggaggctttgagagtctctctttggaggtttgcattttgaagttgcactacaatctgtctgggtgtggatttatttttgtcactcatggtgatttttcaatcccagaactcatgtctttcttcaattatgggaaaatctgcattcaatatcttagcaaatattgcttctccttcattccctccattctcttcttctggaactctgcttggcatatactggaatctttccatctatttcctgtgtctcttaactaatctttcataatttttattcattgccccgggttgggtctctcatgaattcctcagcactggcttttaattcactaattcttcaattatgtccagtatcaagtcaatgtcatctattgaggttttagtaataaatctaaaac

SEQ ID NO: 139300 - DNA, 298 bp, Homo sapiens
tgaactggctttctctgcagctgccaggagatatcacctctaagtgtgttaccgacaacttggaacgtatcacaacatcctcagacagctccttcgcttctctcaatgagccatgaggatacagaaaggagggtcagcaacatgaggctgaagctcttgggtcatcataatgtagggaagaccagtgcatgtcaccccccaggtggcaatgaggaattgattgctggtctcattgcactgacaaaacctcaggcagtacgtttttgcacaatccatgtatccatccatccaatcattc

SEQ ID NO: 139301 - DNA, 788 bp, Homo sapiens
ggaggcgtcggtggcagatagaacagtgagatgtgcttgttttgagaatgtatatccataatgggaaagaaatgaggggttctaaaagacaggtgagaggttgtgtcctacatggaagtggtcatgaaaggaagaaaggatagagtgggcttgtgaggcagggagaaggaattttccatggtctaagaaccacttgccttgagttggaaaggactggtagaacaggttttcagaagaagaataggtgggagtgatagatgagaaagacaagtattggctgtctggagcggagactggaacgtgtgcaggcgctgaggctgcctcttttgctgttttgtgggcgcagacgtttccttgggcaatggggtcagatgttttttggtgccctttgcagtggattactctggctttggctgtaaggagggcagttttaaggagagcctttattagacccagctggtgcctgctgcttgttggtgggagaaacccccacgcctttggtcacaggagccttctgctttgattgttgtggtatgagagcagaggaaaaacacagcttgagagctttccccaaaacaaatatacttctagttgtttttttccagtagaaattttatagaaattagggtgcttagagaatttaagaaccatgagtaagtcccccaaatgcatcctactagctttttggagaaaacttctatttttcccctttgaaagacacaaaggtatggaataacaggtttgtttatttaggcttagttataaaatttatcaaaatagctacactt

SEQ ID NO: 139302 - DNA, 146 bp, Homo sapiens
tcccactcctggagaggtaggcagcgagggacactggcgttgcagggcccctgggacaggctccactcctcccttcttgctctggaggtgacacagtctagggatctagtgaggaatgggacctggggccagcgtgcttggacaag

SEQ ID NO: 139303 - DNA, 167 bp, Homo sapiens
ggcattcgagatacagagaagaggattaggaaagagggaaagaggtgagtttgtgcaagagcaggaagtgcccttctcttacccccagaccacagtgtgggggtttggaggggaaagagatggagggacgagctggggccaatgatcaagggccatgtgtactacac

SEQ ID NO: 139304 - DNA, 182 bp, Homo sapiens
cttgatccagagtatacaaggtgttcttccttgtttggtacatgtctatgctttggtaaataataccaagtaagggtattcagtctgtgttctttccaatgctgagttctgttcattcctttttttctttttttaacaagcttttcaccagagtgagatgatgaacatatccaatcaacaaa

SEQ ID NO: 139305 - DNA, 1082 bp, Homo sapiens
ggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgcaggtcagagaaagcaggacctgcctgggaaggggaaacagtgggccagaggcggcgcagaagccagtagagctcaaagtggtccggactcaggagagagacggcagcgttagagggcagagttccggcggcacagcaagggcactcgggggcgagaggagggcagcgcaaagtgacaatggccagggccaggcagatagaccagactgagctatgggagctggctcaggttcaggagagggcagggcagggaaggagacaaagtccaggaccggctggaggggctcaacatcggaagaggggaagtcgagggagggatggtaaggaggactgcatgggtcagcacaggctgccaaagccagggccagttaaagcgactccaatgcggaagagagtaggt

SEQ ID NO: 139306 - DNA, 265 bp, Homo sapiens
gctttgagtaagacccaaaagggcttttgctagggctacagagaatggggcaaaatcagggaagtagtgatgaaacgagatacccagaagcaggcccctgaacagaaattttccttggctgcagcatcccctttgcttaccttgatgcctgggactgaaatagaggagatttcagccttggaatcctgaattcattatctttttcctacttactaacatacttagtctttcatgctttcattcaacaaccacttactgagcaaca

SEQ ID NO: 139307 - DNA, 492 bp, Homo sapiens
agatcgagctcggtaccaccgtatatgtacgtatgtaggaatgcagaaaatcaaagtttttaaatttagagcctcaatagttataataaagtatgtggatgagaactttgcgtggctttcctaagaatgtacttgagtctgggtaatcttccttgtgctattgcttttgctggaaaccatcgactgaactccctaagatacagtaaggctcatccttagaagtagaaatgcaacaattacatgtggaatgcaatcgtgactttaaaattagtcaacctgttccctaacgcttccctacaaacacactccttcatgtagcacttttaggatagattagaagtgaaggatctcattatttttttccaaaactgctgtggaatagcagctctgtggacatataaccaattttctctgagaaatagtaattctgatgcaagtcctctcctctcttcctttttactccagggatcattgtcacaacattctgaaact

SEQ ID NO: 139308 - DNA, 290 bp, Homo sapiens
tgttgcccagcctggtctccaactcctgagctcaagcaattggcccacgtcagcctcccaaagtaaagtgctgggattacaggtgtgagccactgtgcctgaccagaacagcagtcttctgaatctatatttcacatggggcctagtctgtccctgcaatgctgtgagggacagaggtaaagggtaagtcctcctggggcaggtgaggccattctgctccattggtcaccaccctgcccagcttggtgtcctgcccaacccatctacggataaatgggcacacaaatgtg

SEQ ID NO: 139309 - DNA, 294 bp, Homo sapiens
ctgacatctgaaatcacaagtcttcaggcagctccatacctctcttgtgtctcattagtatattattttatctaagttgccattaacttgaatttcactttttttttttttttgaggcagagtctcgctccattgcccaggctggagtgcagtggcatgatctaggcttactgcaacctatgcctcccaggctcaagcgattctcttgcctcagcctcctgagtagctggtattacaggtgcacaccactactgaccggctaattttttgtatttttagtagagacggggtttc

SEQ ID NO: 139310 - DNA, 193 bp, Homo sapiens
ctcccctccccagccaaaggctacacatgaagatgaagtgtgttcagacatggaaaaggcttaaacaggccctggctcgcagtgagcctccgatgaaagtcggctatttctgatgcctcttaccacagcctgtgaggcagaaattctcaggcttctttttagagctgagaccaagggggttcagagagggtga

SEQ ID NO: 139311 - DNA, 305 bp, Homo sapiens
cttccttggtagtcctgagtgacttcctttatgtgacagttacgaggaatacctgaaattatagtggtttggttaaattactgttagtcaccaggcctattctaaattagaaaaataaagtgcaactctaaattatccttgagtactggtagattaggaaaaataattgaatgaaaaccactcataatcatcaaatttgttataaaataatttctgtcactataaaataatttgaattaagagtttacttgccaaatattttcctttttctggacttctgaggatgctgtggaaaaataattgtc

SEQ ID NO: 139312 - DNA, 255 bp, Homo sapiens
gtgtgtctgggactgtgtgtgtgatgtgtgtaggcctggcatgatcccacatatatgtacccatgtctactaaagtgtcagctccacgagggcacggatttttgtctgtcttgttccatactctgtccccagcacttaaaacagggactggtgcacagtcagggcccataagtcctgaatgaatgagcgcatgaaagtgtgtgctcatgcctgtgtgtgcccacgtgccaatgcctgtgtagacgtgtgactgtt

SEQ ID NO: 139313 - DNA, 288 bp, Homo sapiens
cgaacacacacacacacacacacacacggcacactttcaaaagtagccagcacgtagtcggccttaagccatgcatgttacctccaacctcagattttctctctgtctgagtgtctgtttgcagataacttaaaatcacccatctgcatccccactcaccctccagaaagcaaacgtggagagctcactctgcagaataaaatcaagaacaccacggttgtagctgctgtggactcggcggtctgagcagcctccccgagagccgtagttgctagtagaagtaagatt

SEQ ID NO: 139314 - DNA, 153 bp, Homo sapiens
ccaacctggcagccctagaaggtatatcctactcccaagaggagatatttgtgattctatctcctaaggagagaacagcaaacagctaggaaaaaacccagattagctgcctctgacaaattatcaagggcattctggctgggtcagttgagt

SEQ ID NO: 139315 - DNA, 967 bp, Homo sapiens
ttacaggcgtctgccaccacgcccagctaatatttgtattttagtagatacagggtttcaccttgttggccaggctggtctcaaactcctgacttcggttgatccacccgcctcggcctcccaaagtgttgggattacacatgtgagccaccacgcccagccaaaaatgcattttaatataacctcaataaacctgttgtaaaggtgaaaaatcattggtggaccattttaaattagcggctgtctactattttgcactcactagttggcaaagcgttaattttaggaagtgttaacatgccattgttgggagtgactatcagagctttgaaattatagttgggtggggggttgtacaaaggatttctgtaagataactttcattaatcatatacttgaggaaatactggaaacttttatatccatgagttattaaacagtttttaggataactttattaataaaagagaatctcagcttaatactttcaaattgtttgttaacactctgttcagcagtaaagagccattctaccatgaaaaaaagttaatcttgttcattgctgaatttctatcccctagatggggactctgcacctgaggtatataataatgtttgttgaacaggtagctgcaggtgtaaacacaaacattattctggtgttagaatgttatccaggttgtaagtgaaaaccactcacctgtttcttgagcagaggttttaacattgaaatgtgcagagcctcgctgataggaatggatgtaggtctgctaaaatttaaccttgcttacattgctgttgaaattgggatgcaagctgtccaagcacattgtgttaaacttttaagtttatagtcatttatccgttattcacttttttttttttttttttgagacggagtcttgctctgttgcccaggccggagtgcagttgtgcagtctcggctcactgcaacctccatctcctg

SEQ ID NO: 139316 - DNA, 346 bp, Homo sapiens
tcctggcacagagcacaggaggcacctctgcctgcactcaccgtccagggccctcctccgtctctgcgatgccaccctcatttcacagacgaggacgctgagggtcaaagctgtgagccacatccctcgacaaggctgtgagcccattccctgtcttcctgcctccctgttaccaccttccaggcccccgctctctggtgcctggaatgagcattctggagttgtcagaacattccttgaccttccaataaaaggggtacaatctaaatacaaagtaacatccggggctacaaaagcgaccactgtggccatcacctatgaacctctaagaccccaaatcaacaca

SEQ ID NO: 139317 - DNA, 319 bp, Homo sapiens
ttggtcctctctgggtctcactttctcctgtctaatggatgtggagggcaggtggcttaaggaaccctcagggaccctctgggctgcaaggaccctggcagggtgggaaggacagggaaggactgaacatccagactggggtgggggtcaggggacaggaggcagaggaccaggggggtcagttctgctaggggagagactggctgaggtagattgtgtcacagaaagaaaaacaaaacagctccaaggggatggacccctccctcatctgactcctctatcccagtgaaatgaagggacaagccagtggagcaggggg

SEQ ID NO: 139318 - DNA, 330 bp, Homo sapiens
ttggggcctgcgctagggcgggagcggcgcgggctggaaggagagcactccttcctgtgtgccctggggctcctttagtgtgcgggagcctacgctggaactcgcccaccacccactgctgcgagctctcaccctgccgaggagctcagtctggtaggagacaagcgttgtaaagcgggaaagttgaatttccagggccctagtgggttccttcctggaaagacttactgatatactgtgtgaaaaacccccattctttccctaagtagttcacaattcaagagtgggagaaagaatcgtagacgaggaaagggcaaatttcaagtctcc

SEQ ID NO: 139319 - DNA, 511 bp, Homo sapiens
cttcgtgggctcaagcggtcctcctgcctcagtcttccaagtagctgagactacaggtgcgtgccaccccactacacattaaatttggggaagcactgctttaactctgtctcactgcagtccaacgtcactacacccccaagtcaggacaatggactctttcaaggcagctctcccactaagaaagggccatcactcttgcaatgtcctgaaaatacttgtctaatgttatatctggcccaggacaatattccagatgagtcccaagtccctcactcctttcagcatcagcacaaaatccacgcctccccctggctggaaatatgtgatctatgaccacagtcaaacataattcctccgtggatcacttgaggtcgggagtttgagaccagcctggccaaaatggtgaaacctcgcctctacgaaaatacaaaaattagccaggtatgatggcgggtgcctgttatcccagctattcaggaggctgaggtgggagaattgcttgaaccca

SEQ ID NO: 139320 - DNA, 744 bp, Homo sapiens
atctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatc

SEQ ID NO: 139321 - DNA, 880 bp, Homo sapiens
gatctttgcaaggacctattgtgttataatacagtctatgaaaaatatcaatatttgcatttgatcacatttaaaaaaatcacattcttttgtttgaatatcaaagctaatatgtgagtgatttccctgccaaatagcacaagtagcctttcctgggtgtttatgggcatttatctggttaatgattcccatcatagtgctgtcacccatgccattgctaaacttatacagtaacttttttgttttcacctcagcatatgttgagagtaggaaatagataggactatgccctcaaattttacgtttatatgatgttaatcctaaaggtccttgtgacttctgaagtaaaaactcagtgttgtcattttacttactgaattgttagctgagtttagagttgagtttacaatggagtaaacaaggtgtttagtttgatgtatgcttttagtctttcagaaaaaaatgtttatacttggaaagaatagtttatttacccatctggcctagtttagacaaaaacacagagtcaaatgtcaacagaattctgaagttataaaaatgacagtgtggctttttttttttttaaccttccacctggtgcttatgcccaagtgcctagctttctttagctctcaactaataaaggtaatgtttagataacatttaacgttaagttgcattgtgtttatgatcacatatctcaaatattggtacacgaaactgtacaacaaccttttttattagattttcctacgaaattccttattatattccctaagatagctttttcccaccttcttcttccttctcccttctcaggtgctccaataattccaacccctgcagccagtgactttattatatctttttttaaaaatct

SEQ ID NO: 139322 - DNA, 509 bp, Homo sapiens
tggcctttgatgaatgatgttaggttaacctgagataaaggaaatccccaatccttctaatctgcccctctccacctggacccaccacctccacccaggcttggggagttaaggctgatgtagatggaggatcaattggccaaaagaggtgaattctctcctcaagttgccattcccttactacaagaacctctgatcccacacagtctactggatctctgggtatcaaggaaatgtcataaatctgaactcactttacaatgtcaccatacagaaccaagtctgacagattacgaaggcatgaagaagtggcttgggtggctttagccccttaatctgtttcagtgtcccctgaaactataccaagtaaatacacaattgagacttttttggttaaaaaaggtgtactatgtaaatgcagcttcaagcagttatgtgcagagtttgcaaggaaataattatgactcagtaaatccatacccaggaaaagtactgttcacactcgggag

SEQ ID NO: 139323 - DNA, 570 bp, Homo sapiens
aatgttctcaagtcccatgctcccctcttctttctctctccaccctccttccattctcttccagtaaaaaagtgataaccaccaagtgtctgccttgaacaaaaagttatgacacagatgctcccagtgttggaccatcaagccgaaagcacgtgcacaaagcagctgatgcaagcaccttaattggacggccaccggtgcggactgagctgggctcatgaaccttccaggcagccaactttgcaatatggtgctcgacctttctccattcgagcttctgccgagcagttccttaggtctcagatccctttcaccttccacagacgatgctatggaacagaaaaactgctgctcaaatcctaaataagaatggaaagtgcacagtatggccccatagatctttctttcccttcctgccatgaagccaacctgaaaacaaagacatgatgactcttgtgtaaccacccgaagaggctgacaattaccaactacgtgaggtagtaggcaattgtcacatgctgggctgcagagatcgtgcttaacttgtttattctcatagcgggacagtta

SEQ ID NO: 139324 - DNA, 275 bp, Homo sapiens
cttggtctcctttccagcagcagcaccagaatgtcacttccacctgcttaaaacctttcagtgcgcttaggacacaatccaagctgctccatcagctctctgggccccacaggatctggcttctccctgcctggctgtgactgcttctcccacctcttcccagccgcactggccttctttctggtcttcacacataagctcactcccacctccgggattttgcacttgctggtcccttagtctggaatgttcttccactacagcaagacctgttc

SEQ ID NO: 139325 - DNA, 717 bp, Homo sapiens
actggagaaattcaatgaacccaaaagtttgttttttaaaaggatcaataaaattgacaaacctttaactagatggtttaggaaaaaaagagaaaagactcacataactaaaatcagaactgggtgtgtgaagacattattactgcttctacagaaataaaaaaggattataagacagtactgtgaacaactgtactccagtaaattggataactgagatgaaatagacaaattcctagaaacacaaactaccaagactctgtctcaaaaaaaaaaaaaaaaaaaagagacatacatttaaaaaacaattactagtttaaaagctggtattgtaatttagtttgtaaattctaacattttgttttctatataatttaagctactcatgtattactagttttactcatgaattactggcttgtgttttagggcactcaatacataaagatgtgattttgtgatatgagcaactgaaaaggatggggacagagctgtaaaggggcagggtttttatgttattgaagttaaacttaatataatcaagttataacattatatagagaattggaaaactggagaaaatcaatgaaaccaaaagtttgttttttaaaaagatcaataaaattgacaaacctttaactagatggactaggaaaaaaagagaaaagactcacataactaaaatcagaactgggtgtgtgaagacattattactgc

SEQ ID NO: 139326 - DNA, 446 bp, Homo sapiens
tctctctctccctgtgtttccttctctctctctctttctctctctctgtctgtcccctgccaaaggcattaaaaagagatgggaaccactccaccaagcatgtgtgtgtggggtgagggggtcctaacccacggcactgctttgctggggaaacagcttttgaacaagacccctggcacaaatgagatgaggttagtgatcgcagtttaattctcaatagggcacagcgtgctctgtggatatgaaatatacaatatggggggaaatggagtcctttctagaattagtttttcctcttggttaatgagggtcagaggagaatgaaggcataaactgcgagctaagtaaaacccaacaggccgagccctccagggagagactgctggagaggggccagggctgccttggctttcccacagggtgaccagatcacaggaggttagaga

SEQ ID NO: 139327 - DNA, 205 bp, Homo sapiens
gataaatcgggcttcctctttgtcctataaccgataattacctggtcagaagaaacatgcgatacttgacctgcaatgaaagtccacttgtctggccttcctggccctagctgggtttttcaaaggagctcccatactggtttggcctcagtcagctgttaaagaattgagggacttctgagttgcgcaaccctgagtcaatgtg

SEQ ID NO: 139328 - DNA, 462 bp, Homo sapiens
gccacttgggaggatcctgcaatgtggaggaatggtcaggacctgggtttcaatcctgactctctgctggcttggtgatttggggctgtgccttagttctcccatcggcaaaagcatcacgatgatagtaatctagctcacagttgtaacgatcaaataaagtaatagtaatctagctcacagttgtgaagatctagataacatgtgtgaagtgctcagaacagtgactggcacccaacaggggctttgagtgttgatgccaattaccaatcttccagtctgtaaaaaggttgtaccaaatgacccaagctagtcacaatgggaagacagtgacaagtccccagtccctgcacttaaatgccatgtactcaagttattgataagtaataagtactgataaccgtcctttattggccatctactgtatttgagaggctgaacaccccaattccagcgcttatg

SEQ ID NO: 139329 - DNA, 500 bp, Homo sapiens
ttgccctttatctactcttcacaaatctctacaagctaagtatcattatcctcatcatatagcaggaaaaaatgatttacaaaaacagcaaattacttggatattttacatagctagtaagtggcagagctatgatatgaagcctagtctatctgactctaaaacatggattctttccacatgtgcctctgttcatattgattcgtttgctagtatcaggaggcctacaatttacaagaaggagcaggtcctaaaatgaatatatgatctgtttatgctataggcacatttcacaatgctaggggaaacatcaactgatgtctgtataaggaataagagacagtcagagagtcattaaaaaaagaaagaaaaaaagaacacttgaatttataacttcacatctcccaagcaaaataatcaggccccgatggtttcactggagcaattctcacaaacctttaaaaataaattaacactaattctacacaatctcttctagc

SEQ ID NO: 139330 - DNA, 535 bp, Homo sapiens
attagtcactggcttggtttgctggtatttgttgttgagatttggggcttagctgccatttggagcagatggaaggaagataagctgaaaagggtggcaggggaggcattagtgggaaatcctgcccacgcttcttgaatgctgtatttgccaatagtgtagatgctggatttaagccaatgagtccacctagctgctttgtgtaaaatactttctgttgttgctcattgtgtttgggggcaatggctacctgcctgcttcacaggcttgctgtgaggttgactgaggcaacacaaagtcttttgagctccttggagaaaattcaccatgcaagtgcaaagtatcaccattgtatcatggtaatgagactcccaccagcttaaaccagttaccaaggagagatggggcatcaaacaagagaagccaaagctgtcccagtctcaatccaggcaaatgatgcttcctcactcaatactaatcctgccctggaggtaggtgtcagtagtcacagatgggtggtccatttggcccccag

SEQ ID NO: 139331 - DNA, 472 bp, Homo sapiens
agagcatgccccgtttccccagggggaaaccgaggctcaggaagctgaggcatatccccttatgtgacctagtctgagctgtttcagacacacatccccatgttcactcaggatcagccatctcaggtggccacacccagcgggggcggggggatgctggcagaggcctgtgtgtttccaaggctgtcctctcctgacatggatgggggtaccaggcctggccccccatcactgtcagaaaggggtaggcgcggcctagcagacacagctgcacttctgacgacgaccaccctgaggtccccagggtgacgtccacaccacggaacaagcaaacagccacttcgcatgaggtgtacaaagaacagtcagtgatgtgacaaggtattctccacctgcgcatgtaaaaagagttgggatcaaaaatggtaggaatatcacgtggcaaaatgtgtttttgaaaacggatgtcttg

SEQ ID NO: 139332 - DNA, 431 bp, Homo sapiens
gagtgagactctgtctcaaaaaaaaagaaaaaaagagagaaagaaactccatgtcctttagctgtaccccttatctccacatcccaccaggacccaagtaaccactaatcttccaaccattaatcttttgtatttcttttacattgcataagtacttggcaaagtgctagatatatttattaagagattaatatgtataaacagttgcatcatctaacttaatccttatcataactgtgaggtctgagtgtttattgttatctcaaagctgaggatattgaaacttaagataggttaaaaaacttgtaacataaccagtaaatgatgaaactagcattgtatccttgtactatcatttaaaaactcatgctcttaacctttctaccatatctattgtagtaaactgaattttcgaagctatgcaatatcta

SEQ ID NO: 139333 - DNA, 474 bp, Homo sapiens
accctcatcccgggcttcagcctccagagcatgggaggccacatatctgtgtttttagatgcccccacctatagtgctttgtgacagaagtcccagccaactaacccactgagtctccaggttatcacccctgccaaatccacacccgtggcctggcactcaaggcctggctccctggtagctttccctatcaccgttaggcactctttcccctgctgccccaggagcccagttctcccgcctggagaaggagctgctccgccttaaaggcccctcctctccatcatcctagcagcccagctgccataactctcctgcctggagttttccagacctctcgggacgttgccggcaccctgtagcccctgtggccctgcctccttcccattcccaacacccaagccagggctgccctggctgagcacccccggccctcagtacaaatcccaggccccactgcacctgcatccggct

SEQ ID NO: 139334 - DNA, 295 bp, Homo sapiens
tgaatacaaccaatgtattgtatcctagaaccaaagtgtttacaacatattcaacccaggtggatctaccattatggggaaaaaaatatgtaaaaagtttaacactctatagcttatatgtaagcaccaaaaaaacaaacaataaaaaccaagcatggtatagagttctcaatgctaaatcatccatgtgggatgtcacatgtccatctctgattatctttggtgcacagttcttaaataagaccaatctattccacatccttgctagtaacctttgcatgcgtaacagattttg

SEQ ID NO: 139335 - DNA, 186 bp, Homo sapiens
tcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtat

SEQ ID NO: 139336 - DNA, 237 bp, Homo sapiens
gggtcagcttctgctgtggggctcagtggagtcacagggcctccccagctgcttagggtgcctggggtggggacctcactataagaccatgctaggcacagcgctgccaccgggggctcccaagggtgctgctgaatctgagtgtgtcccgggcagcaccacctggcttaggactccaggacactggggctgatggcagcgtaggggggaagctcccttgtccctcttggtgaccgt

SEQ ID NO: 139337 - DNA, 575 bp, Homo sapiens
ctcctcacgttattactgtcacatattttaataagtgggacagtactttcaagccccaaatacattattattgtttttacagccaacattcatagactttccatttccagtgcattctttcctatatttccatgttaaagcagaaagcaaaaattgcttgccctacttaaaatactttcatgacagagtaaggaagaataactgggaatgagagttgggagactcaggtcctgggaaaaagcccatctgccatgaacatcaggcaaatcccatttaataggggggccagttgcacatccaacaatgcttctagttcctaccgggtcctgatgaaagctttagagccctctaaggagaccccaagaacccctgtcttggcctttaaactttaaacaacttcaaacgtttcaggcttataagcagggttgcaacgtaacagaatgtcccagcagctggtcagccagagttcaggggactggctgagagccaatggctgtgtgtttgcgccatctggtggctatttctgctctggttcactaaggaatttcctggcttgttggggccagggatgcctc

SEQ ID NO: 139338 - DNA, 174 bp, Homo sapiens
attagcaaaacacattggcaataattgcataagataacaagcagactgtaaaaagcacacagtatgacgatgtccttgggacaaactgtcatttaaaattcatgtttttgtcttttgagtttgtctattgttcctctccagcagtgaagtatcaaggctattttacctcctcat

SEQ ID NO: 139339 - DNA, 308 bp, Homo sapiens
tgtggggggtggagtctgtgatattcttaaataggcatcccattcacaacttgatagtaatatgcactggttgataaatggtgctttcttttcatcttgaccacaaactctgagacttctttgggaaaattgtgatctgtggaaattggctgtaatatccataaacatagtttgcagagtgttcacatctactcagctgttggctcatgtattaaattttaaaatgtgtacttatttttctaggcattatcttttgtccaggttttgacagtgctttcaggtccatctaaataaaatttgaaacctac

SEQ ID NO: 139340 - DNA, 292 bp, Homo sapiens
aagtggtcttcatggctctcatctttaacacggggtagcctaggacccctctaggaccaccttgttactgcttttcatgtattatctcattgcgtcttccaggacggagaagtgggtcctggctctgctggccgtcattcctcccagagggatgggcagcaggaacctgtcgtccgtggtacctgccgggttccaaccttggtctgtctgactccagcccccccacagtgtgaccgtccgtggtacctgccgggttccaaccttggtctgtctgactccagccccccccaca

SEQ ID NO: 139341 - DNA, 495 bp, Homo sapiens
tttcaaagtcacagaaggacaaaaacatgccctgctaagacggcaggtgaactttagagaataccacggaggagaactagtatcggtactggactttcagccccaggtccaccaagccagtaaagccaaatgacttacaacaaaaccctacaacaactacaaagatactactctaaagccctgtctacagtcagattcttgactataaatttgacttagaacagaagagccccaaatataccagctagtccctttacagtgacaggtaaaagctacttactacacttactacctgccagacactgtagtaagcacttgacacaaatggtcttatttactcttctccgtaaactcacaagctagaaaataccatcatccccctttacagacgggaaaactgaggcttagagagtttaggtcacacagctaagtagcaatggccctgatatttgagaacctaggcagtctggtttttaaccactgggcctacactgc

SEQ ID NO: 139342 - DNA, 138 bp, Homo sapiens
tggcggtcctgtacctcaacggggaacattcataaagaaagaatgtgaccatcagcattatcacaaagaggcactcattagttggttacatggttgtcactcaaatgccagctcttttctccgttctctatgcaaatt

SEQ ID NO: 139343 - DNA, 521 bp, Homo sapiens
gttaatatgacaaagattgtcaagtggaattaaaaatgagtttattatttatatgagaaacagcttaaacttaaggataatgaaatgttgatagtaaaaggatgagaaaatagatcagcaaacttactgttggacaaaatagactttttggcagaaggagataaagcgggctacttcataataacaagattgtgctcactaggaagataaaacagttctaactttacatgtatctaatgacatattctcaaaatacacagaaataaaagttgagagaactataagaagaaacagtttggccattagagggagttgtaattgtctgggtaaaagataaggacctatggccgggcgcagtggctcacacttctaatcccaacactttgggaggccaaggcgggcagatcatctgaggtcaggagttcgagaccagcctgaccaacatgctgaaatcccatctctactaaaagtacaaaatcaccctggggtggtggcacatgcctgtaatcccagctactcga

SEQ ID NO: 139344 - DNA, 394 bp, Homo sapiens
cgcagcagtcagggcccctagccgaggctgcgcaacaagtaaatggagggtaggggctgagatacggccgactgcaggcagcgcctggcagggacccccactcatgccccgggctccttagagtagcaggtgggcgttactcagcctagtcaggtgggtcacttaattaatgagaaaaggaaccagatgaacaccccggggagtagttcccacggcctggggttgttcaccgggtaagtgagttcttatttgtaaagcacgtaggtgaaggccacacaggcagggcgaagtaaatgtttgcagaatggtcttgccacccatcacctggtaaggttttgaagctgttcatctttgacatggggtcaaggcatttctgcagacctgagtatcccgc

SEQ ID NO: 139345 - DNA, 297 bp, Homo sapiens
agttcttgtcggtcttgccattcctgctcccaaagtgctccatggcttccacgatattcatgccctgtttccccttgccaaagatcacatggttgccatccaaccactcaatcttggcagtgcagatgaaaaactaggaaccatttgcgttgggtccagcattttccatgaacaagatgccaggacctgtatgcttcaggatgaagttctcatcatcaaatttctccccatagttggaattgccatcaactattaaggcatgtgaagtcaccaccctgacacataaactctgggata

SEQ ID NO: 139346 - DNA, 437 bp, Homo sapiens
gcactgattctgatgacaggaagaggatgatgttgtaaaacgactgctgctgagtcatatgccagggctgctatgaatcacctgtcagtttgttgacagtatgctttgaaggtggctcagttatctagcatgctctccacctcaaccaaatctaatccagttggtcaccagatgcaaggaaaccaaaatgcaagaggaatcgccaccatagtctcagccacctgaattagtatctgtggatcctgggagaccaccacatggagacaaagggtgggaaattgaggggttggtgacactagtttgcatttttaaaaaactgaaaacaatgagagagactcacgccatacttactgaatcataatctgtcttttaacaagatcccaggtgattgatctgcaaattaaattttgagaagcatggatctgtgattcattggc

SEQ ID NO: 139347 - DNA, 420 bp, Homo sapiens
ctgggccatgagcagaaccacagggcctgggatctgtggccagcaccacccccctagcccgtccttggaaggagagtcccctcctgtcttgggatcctgtctctccgtggcagagttgagagctgtttgtcacaagagggaggtgagcaagccaggagcatgacggcgatgctctctctggcctcctacatctgttccacttcaccccagacaaacccagccaggatccagcccgaaagagatggcaatggtgccttctgcccgagaaacaaggaaacctcgggctccctgctcatggcttatattgttgctaggattactggaagcaaaaaagacagttcatccctggagccagtgactgaagaatggatgacaaaatgaggtcatctttctctctagtcaagtccctatgctcaagac

SEQ ID NO: 139348 - DNA, 1147 bp, Homo sapiens
tctgggcgacagtgaaactccatctcaaaaaaaaaaaaaaaagggtctaccgttagtggacacctttagtcttccaacgagatacttccacctcccaccttgtggttaaaaaatgcttaactttgggctgggtgcggtggctcatgcctgtaatcccaacactttgggaggcagaggcaggcggatcatgaggtcaggagttcgagaccagcctggccaatatagtgaaaccctgcctctattaaaaatacaaaaattagctgggcatggtggcaggcgcctgaatttccagctactcgggaggctgaggcaggagaattgcttgaacccaggaggcagaggttgcagtgagccgagatcatgccactacactccagcctgggtgacagaacgagacttcgtcccccccaaaaaaacaaaaagcttaactttgaagagatttggtcttctcagatgcctcctataaaaagaaacaaatgtgagaaaaggtagaaaaggccttttttgtagggagcaattttttctaaaaaggcttttcagccaagaccctctctcttacaattctgacaccatatcaacttttaagactacttttttcttagaatgcttcttttttgccatttattgcacaaacaataatttggggggggactttaaaaaatcataatcaggccaggcacagtggctcaatgcctgtaatcccagcactttgggaggccgaggcaggtggaccacatgaggtcaggaattcgagaccagcctggccaacatggcaaaaccccatctccactaaaaatgaaaaaattagctgaaataacacagctacttgggaggctaaagcaggagaatcacttgaacccaggaggtggaggctgcagtgagccaagatcacgccattgcactccaccctgggcaacagagcaagacgccatctcaaaaaaacaaacaaaaaatcacaatcagtgagattaatgtttaatgaacatactgttattttttatttttttaagagacaagtctccatctgtctcctaagcagagtgtagtggcgcaatcatagctcattgtaacattggactcctgggctcaagtgatcctcccacctcagtctcccatgcatgccaccacaattttttggatacagggt

SEQ ID NO: 139349 - DNA, 439 bp, Homo sapiens
cagggaatctgccactcataactccatcagtcacctgctgcttccgcttccatctcaacattcagtggccaattcccaccttcatatcccatctactcagggcaggaaagagacaggcaacgtcgcctatgactgcaccccaacgggttctgagacacacacaggagtgcccccgcaccccggtgtaaaagccccttctggacagagcacaagatggcagagaggagctgcagtaaccacaccaaactctgaagtgagaggcactgacggccactgggagccgtcccaacctgggatgtgctcagggacccttgctcactgcccttggcgaagctgcaggttgaccagtcctttccaaaacagcttcacttgctgggcgcagtggctcatgcctgtaattccagggctttgagaggccaaggaaggaggactgcttgag

SEQ ID NO: 139350 - DNA, 468 bp, Homo sapiens
gacagggagactcctgcagggtcagaaatattctatatgttcatctaggtggtgattacacaagatctatacgtatgtaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggccgttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcagga

SEQ ID NO: 139351 - DNA, 672 bp, Homo sapiens
aatgggcatgtaaggaagaaaagcatgtcagaacacatgtgcaattgtgagagcatcatgaagagctgtgaaggtaacagcttgatgaaggagagaaaagaaccaaagatggctgctgttttgaatccagctgactcagagactattggtacaataaatcgcattagggaggtctgtgtgcgtgcgtgcgtgcatgtgtgtgcgcgtgcatgtgcgaggtaatgaatgcagaagactgaagtacaaatagaaggttgattaggcagctagctggaaatagatgtgaacatgttcaggcaattagaatgtggtgccacagctcaggttgtgttagggattcagaaagaagagaggtcagaaccttggctttcatattaatttaaggcacagaaggaaaacaaggagcaatagaaagaaacagagacacaaccattcaaaatagataacagccaggaaagtgtgttaccaaaccaagaggtgagaatttccagatatcatatcttgctgtataataattaaaatttatctatctctatgtaaaaatggtattatacataggacagaaatcaccaattaagatgaataagagtaccatatttaatcaagtgcatacatctgttaatatccattttcagaatgtaaacagcttaaaataaaagctgacagaagtcc

SEQ ID NO: 139352 - DNA, 1585 bp, Homo sapiens
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccacc

SEQ ID NO: 139353 - DNA, 4194 bp, Homo sapiens
  misc_feature (3911)..(3911): n is a, c, g, or t
  misc_feature (3914)..(3914): n is a, c, g, or t
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttggagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaaaaaaaaaaaaaanaanaaaaaaaaaaaaacgtgtggtcgcagcgactgaggccacgaaaaaaacacttataagaccaatcgatggggaccggggccccaaagagaaggacacagggaacacaggggtgcccagagaaacacacgggcaaaggaaaaagcatcttgggatatcccagaaaaagaaaaagcgcgggaggggaaaccaaagcgttcagaaacaaatccaaacgaggagtaccaggggaacaaacgggagaactacaagagagagatacaagaaaacgtagcatacaagt

SEQ ID NO: 139354 - DNA, 4803 bp, Homo sapiens
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttggagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaagagtgcctgctattactacttgtattcaacattgtactgaaagtgtcaacacagtaaagcaaggaaaatgaaaaagcatgaaaaaaaggcatatggaagaaacaaaactgtcattctttaaaggttagatgattgtatgtatggaaatccaatatcatctataagcagattattagaattaagagtttagcaaatttgcgagctaaaacatcaacatttaagtttttctaagtaccagcaacagaattaaaaaatagaattttaggctgagtgcagtggctcacaactgtaatcccagcactttgggaggccaaggagggaggattgcttgagtcctaggagttcaagaccagcctgggcaacatagtgtaagaccctgtctctataaaaataaattttaaaaaagaaaatggaattttaaatatatataatatttaatcataactaaaaatataaagtttctagaaataaatctaataaaaatatgcaagacctttttggagaaaattacaaagctttattgtaagaagcagagtttaacccttttcccatttagaaaaaaaaagtgcagctcactgccagcgctcatttaattttacgtaaacacactcttggaggctgaagcaaatcttactgattttcaatgtgaaaataaaatataaaaactattcttggagttatttctaaacagaactaacatcagaatcatctgaatcatcagaatcatctctttcagaaaaatcggactcatcgaatgaatcttcggctaactgttgagaacgatgttaacatcacgtgtaggaatactacattttccaggatttgacattttcagcgatcgagaattactatgttttgtaaatggaaataccactactaaagacagaatgctataaatagaatga

SEQ ID NO: 139355 - DNA, 211 bp, Homo sapiens
tttttttgtatgagtacttgttggttattttggaattttcaggacattgagatattcctctgcttccttctgcacagatactgataattcatatggtcttgtagttgtcagtgacttcttcctacccacttgcattttgggcctcatggagatactccatcacctggttttcttgtagctattgtaaatgggttttggtttgacccttcct

SEQ ID NO: 139356 - DNA, 289 bp, Homo sapiens
  misc_feature (31)..(32): n is a, c, g, or t
  misc_feature (53)..(53): n is a, c, g, or t
  misc_feature (66)..(66): n is a, c, g, or t
ggtatagagtggccatgtgatgtcagagaanngatggagtaggtagcttcaanggcccatccttcnacagaaacaaaacaacaaagccaaaaatccaatctgtccccatcccctattctacctccagatccagacaaacaaggggtagggaaaggctatgttgccttctgaacttagagcagaaaggaaagaaaatgtcccctgctctcacagtgaccacagacagcatctcatgtgtgcccatcttcacatggccactcaattaccgggataccgatgctcagaattc

SEQ ID NO: 139357 - DNA, 488 bp, Homo sapiens
ttttttttttttttttttttgctttttgcttttttgagacagggtcttgctctgttacccacgctggagtgcagtggtgagatcagggctcactgcagcctccacctcatgggctgaagccatcctcccacctcagcctcccgagtagctgggactacaggtgtgtgcaaccacatctggctagtttctgtatgttttgtgaagatggggtcccactatgtggcccaagttggtcttgaacacttggggtcaagtagtcctcctgctttagcttcctaaagtgctgggatgacaggcctgagccccgcgcccggccagcctcctgtgcgaggttgtgtgggactctgtcatggaacccagtatgccttcatgtgctggcttgtttgttgactctgtagttaatgggctgccccacgtggacaggcactgggtcatccatgtctctgtgtacaggcagaggctgctgcgggtacatctgtgcacatggc

SEQ ID NO: 139358 - DNA, 345 bp, Homo sapiens
tgcatgcttcagtcacacctatccaatgaagtctccataaaaggcctaagaagacagggtgaggagagcttctggacagctgaacaggaggtggctgctaggaaggtacaaaagaactctgaaaaggtggcgcaccccaattccacgggaacagaagctcctgtgcttgggactcttccaaccctagtcctacatatctcttcatctggctgttcattagtatcctttaaaatatcctttgtaataaactggtatatgtgtttccctgaattctgagtcaatcaaatacactaatagaagccaaagagtataagaaccccaacctgtagagggttggcaagatgt

SEQ ID NO: 139359 - DNA, 176 bp, Homo sapiens
caactgggggcatgagaagagagacctccagaggtgagtaagagacatatagtagggaaaaagagtgtacaagagcaaactttagctgtttcaaaatttcatacaaaagaaatttcatactaagtcaccagttttcaaccctaacagactcaactcaattccttttttttttttaa

SEQ ID NO: 139360 - DNA, 369 bp, Homo sapiens
cttgttgcccaggctgctctcgaactcctgggtccaagtgatttcacccacctcagcctcctgaagtattgggattacaggtatgagccaccacgcctggcccctgaagattaaattctttattggatcatctgcaaattcaaaattcttttttcttttcttcttgtttttttttttcaaatagggacggggtctcaccatgttgcccaggctggtctcgaactcctgagcttaagcagcccacctgccttggcttcccaaactgctaggattatagacatgagccaccattcccagcccaaattcaaaattatttatttctaactataggttatagtacaaagtaagaattagttcagtaatttaaat

SEQ ID NO: 139361 - DNA, 298 bp, Homo sapiens
gactatctctaactgcacggaaactggcgtttccttatcctcatctgtataatggcaacatttctctgctgcttcaaaaaatggtattaattctaggcagggaaataagaacacccaaatgttcttcagtgtctctctctttctttgacacacacacactacccacagggacacagcaaagccctggaaacatatcgtacacatacggcctttactctccaccacttcctctccactgacagaggcagccatgctgccaaggtagcaacccccacatgaaatacaaaagagtggaggc

SEQ ID NO: 139362 - DNA, 296 bp, Homo sapiens
gttcaagggattctcatgcctcagtcccccaagtagctgggaccacaggcatgtgccaccacaccctgctaatttttgtattttagtagagacaaggtttcaccatgttggccaggctggtctcgaactcctggccgcaagttatctgcccatctcagtttcccaaagtgctaggattacaagcatgagccagcacgtccagccattgtaaggagaattgtgttcttaactccactttcagagaaagtgactttttacttcactggaagcaactggagtcctctgctggttgctgt

SEQ ID NO: 139363 - DNA, 202 bp, Homo sapiens
gtgtggcccatggtccctcccacttctcaaaccttctccaaagtagagcagaataagcacacatggaggaatgtgcacaaggaggaatgtgcgtatactgtagacacattaaaggatgaaggagaaggacagaggaggcgggaggaggaggaggagagagaggtctgggtgaatgtgcgtatactgtagacacattaaagga

SEQ ID NO: 139364 - DNA, 595 bp, Homo sapiens
tgggtgatctagcaggatccatggagaccaggctgaggatgaacagtaactgaggaaggagagcagtgccacctggtaagtgtagggctgcccccctcaggaggccccctttacattcagcagctatggctttgttttctcttgttgctgttgttttttgttgttgtttttgttttctattgattttttttctaaaactttctattgaagtatattaggttgaacctaggctcctgtcctcactgctatagccagaggggctttgggaaggaggcagctgtgaacaggtgggtatttcaaggggtgaggcagggcctttggaggacctgggcccttgccagggccctttccactgtccccaccacactggagatgtcctggcggtcagtgttcttctgtggccctgctgctccgctgcccgaagactcagtaggagaggttcagtcaagacccagaactgtaaccctgacaccaacgcgggtgaggaagctccctgcccaagccccagagcatgtggcacaggcacagctgtacatggacaaggtccttgggcgcatgtggtcctgaatggcaggcgcatcagggtctggatgcg

SEQ ID NO: 139365 - DNA, 301 bp, Homo sapiens
tcggccagattttctatgaaaaacaaggatgcgtatcttataaactagtgtaattattttcttattttatatatcaccaaattgttctgttatataggatactaaagatggctctgaatataaaatgtgcatatcagggtactacaaaagagtgtaatgtactgagtgcccaatgaatgtctttattcttaaagatttcatagaagtaaatattcttttcttatcatacattatactgaaactaatccttactttcatttaagaactcttagcaaagcaaaaggaccatacgcatagaaaa

SEQ ID NO: 139366 - DNA, 426 bp, Homo sapiens
agactgtacggggtgaaggagggtgtcttaggaagccactgaggcatcgccagagcccgcacgggcagcgtcaggcaccccaggaggtcatttcacatgttctacaaggacatgttttcagctctccagttttctagtggaggaaaccaaacctcccaggtggtcaacacaggcgtttgccccacatgccaccaccaggtagccacgggtctcatgggtgactgggaatgggaggggaaggaagaagctcttcttttgtggaatctgatcacagggaaccctctcccgcccggggctcagaatctgatcacagggaaccctttcccgcctggggctcagaatctgatcacagggaacgctctcccgcccgaggctcagaatctgatcacagggaaccctctcccacctggagctcaagatggtttc

SEQ ID NO: 139367 - DNA, 558 bp, Homo sapiens
attatgtagtctatttggtcatctgtgcactctcagaacgcagcaaagggtaagtccacaagggtgcggaaaaagcttagagggaaaaaatatatgctgtagtttttgcgttgtgcttttccgtatgaatgagtaatagcattacacaaagaacccctacaaagaaagagctgaggtaattgcctcatgacattagtaaatgatttcagcacataaagggaactggatggcagtaattcaagcagtctaaaagactctgaaaaaggccacaagcactaaaagaaccatagattgctaccaatttagagaatttaaattttctaattcacaagatagaaattagtgtacataattcaataagcaaattttagggtgactgacatcttatcaggtgatttgtgaacaaaagacaaattatttcccatgccaactatttaccatattttccagactatatgatactataaataaagccaaaatatctgacatattttactccttaatcctttttattaaatccctcaaaaagagcagctctaaattttcatcagttcagta

SEQ ID NO: 139368 - DNA, 266 bp, Homo sapiens
cgacggtctttacccttctctaaagaggatttttgaaaaaccctgaacagcttaaagaaaaaataattactggctcaatgatggaaatgtaacacaacatagaattattaattgctgttcttgttacaagctactctgtcgttcaattgttaaaaagagtaagcagtcctgctctcctgatcatttttattttatttttttttttaaaaaagagtctcattctgtcacccaggctggagtgcagtggcatgctcttggctcactga

SEQ ID NO: 139369 - DNA, 223 bp, Homo sapiens
aatataaccgtggctcactgtgatggcttgactccttggagccttaaagacactcgggcccatgactgtaccaagatctcttaacccatctccatttaactgcctctccagattaaccaacgccctctactcctgctgtcaaacacactgatggccactcatggcaggaagaacgctcagagattgtaggctactttccagcctccctctgcctctgccccca

SEQ ID NO: 139370 - DNA, 158 bp, Homo sapiens
cagagataagtaatcttatctgtgcccagggcttcagctgtcatggctgtgcacgtggttccctagtctgtatctgtagccctgacttgcctctgctctagacattccattggttcccccatgctaacttggtaagtctaaaacaactctgtttcaac

SEQ ID NO: 139371 - DNA, 476 bp, Homo sapiens
gcttcagggcttggggaggcagcgttgttttagactggctggaaagtcatgctgagcagcaagaggacagatctcttttagaggagacagccccacctggctgcaccctccaaggaggccacagggcatatcatccaggtgggtcaggtggcactggggctcacagtcaagccatcatcaggttactgcctctgtttcatcactgtgaaagttaagccatgatccaggtctctgggtcttcctgagcaagtcaatgcagagccaaagcctgtgcacaaatgaataacctcacaaggatgagagctgtgtgtgattgatggctctacacaaaccatctcagcaaaggagttcagtaagagccttgtgagcatatgacactctccagctctactaaagtgatagatgggttcacacggaagctactaaatgggcctcattgcaaaggcatggcttcaaccatagctggacttcaggga

SEQ ID NO: 139372 - DNA, 434 bp, Homo sapiens
  misc_feature (301)..(301): n is a, c, g, or t
  misc_feature (365)..(365): n is a, c, g, or t
tacattttctcaaagggtcagataagctattttctagtagccctgtttatctccctgtatgacaacaacattagatttttggatattggcagcttcccagcccttcctcagtcacatccagtgcacatctgggcataccatgtgctttctgtcttggcagcagaaggacattcaaactggtctccctgggctcaggagcactgcccagggcagatagagtctcccatgcctgccccacttgcaccacagctgaggactcagcagtgagctctgggttttagatgtggtggacacgccctgngctagtgtggcaggacaccccctctaggagggatgggaatgaggccagggctgtcctgggcagnttctctttagctcaaggtgttgcattctctcggaggaatagaaaccaagcttgggcactttcaggcagt

SEQ ID NO: 139373 - DNA, 493 bp, Homo sapiens
cccctctcctctctgcagccaaacccgtaacctcacagcaatacagcctcacatttaggattccccagcacggagaaaagaactagaaatctcaaatatggcaagtgactccaaaggccagaaaatccaaagggcctacggcatatgattcacgtaacaatctctgcccaagagactttcatcttccctcttaatctcctgttccagctgtatttactctgatatggatttttttcatttattcatattttcccatttccttctacggattcacaggaaacctctaataatctaaggaaggcaagggggcttaaatccaatgatctcaagaaccccatcccctaataatcatgatagtaatactaacagctaccatttattgagtacctactatgtaccaggtacagatgaggatactgaagttcagagaagtgatgacatttgcctaaagtcacccagcaaaggagtgtcaaagccagaattctgtcctgga

SEQ ID NO: 139374 - DNA, 303 bp, Homo sapiens
tggtgtctgacccggagagggctgagcaggtcggaacgctggagaggccatgaaggggatgccgagaggtggcagcagtctggggagcagcgggagggagggagacctctggatggggcagatgcacttcaaggagggacggcaacaccccatccagcagtccttagaaaacaatgtcaggatgggggcaaaaactctgtctccatgggttaagagggaaaagaggattaagcaaggcaaaccagttagacttttttaaaagctcagagacgaagggaaaaaaggggagctatctcatgctgg

SEQ ID NO: 139375 - DNA, 222 bp, Homo sapiens
gctcaagagcaggcagagaaagcgaacccagcagggagactgagaagtgattaatgaggttggcagagaagcaagtcaacagggaatggatatgcagggaagtaggggcaacatcagggtacaaggaaaagtgtgacccaaaacccagcaaagaggacacacaggcatcaagccagccagggacaggcaggagttcagttttgctgaagtggagtggaggga

SEQ ID NO: 139376 - DNA, 290 bp, Homo sapiens
gcagaaaggcatcctcagatgcagaggctcagaaaatctcctaatatctttctgaataaagttcctgcagtacacagtccctagtacacagaaatgaaatgcaattaagaacccaagaagaggccaagtgcattggcttatgactgtaatctcagcactttgggaggccgaggctggtggatcacttgggcccagaagttcgagaccagcctggggaaaacgatgaaacccagtctttacaaaaaacataaaaacttggccaggcatggttcctggggagggtgaggtgg

SEQ ID NO: 139377 - DNA, 393 bp, Homo sapiens
tattctccagaaatctcaatgtcataaaagacaaagaaagaaaggatggggaactgttccagattaaaggagactaaagagacatgccaactaaatgttaacaggtgatcctagactgatcctgtcctggacaaaaaaatgaagtcatagaaaacattatgggtcagttgaaaaaattagaatggccgggcacggtggctcacgcctgtaatcccagcacttcaggaggctgaggcaggcaaatcacgaggtcaggagatcgagaccatcctggctaacatggtgaaaccctgtctctactaaaaatacaaaaacaaaattagccaggcgtggtggcaggtacctgtagtcccacctgggcgacacagtgagactccgtttccaaaaaaaaaa

SEQ ID NO: 139378 - DNA, 440 bp, Homo sapiens
aaccatgagccaattaaacctcttttctttatgaattacccagtcttaggtattcctttgtagcaaagcaaaaagcctaatacaagagtggtctgtagaattattttcctctcatgaaaactctacctgcacatcataattgctagggtgtaccaggcaatcttgcagcctggcacaagctattgagtaactatcgctataggcatttttaagtacgattctcttgttttccataaatttaaaaagaactgtttatctgctgagaaatggtatatcatttgtgtggtggcctattttctatgcatgcagccaccttccaatttgactttagggtcaagttgcttttctgattcatttagctgagtagacttaagagcaaattgagaagagaaacccatttaaatattgtatcatgtgaaaagggtgaaatctgtcactga

SEQ ID NO: 139379 - DNA, 188 bp, Homo sapiens
agcaaaattgtctgaagagcttgttaaatgtgggtttccaggctccacagtaacccattgaatatcagatcttagttcagcactatttttcctgcctgtttgctcagacactccatgctccccactcttattcactgaaattaaagtgaaaagggaaatgggtgcatttttgacaagccctctggtga

SEQ ID NO: 139380 - DNA, 337 bp, Homo sapiens
ttagggatcagaacaggcaatcacacatactaatgctgaaataaaatcatatttccaggtctgctagtgttgtctccttcaccactgccctccatcatagtcctccattcagagctgacctctacccccagctggtcatattgcttttccttgctgccccagtacaatgagcaaccatgggaatacagtctcaggatacccaggttttcactatactgaagagtttacatgcaaagctcatcatcttctctcatacagcaggtccccatttctaactttgatagcattctcattcaggagggaagtcttggatggttgttcactcctgattcttttt

SEQ ID NO: 139381 - DNA, 598 bp, Homo sapiens
gctccaagtcgcctacactgactgctccacctgcagccgtccatgctgggaacaggtccagttttgccaaggctgatggaggagccctgtggggctgtgatcagagcccagcgtcccagtgcacctgccgatgccctctccagcctctggcttccttccgttggctgtccttggagggctgtgcttcgtgggcaggcgtttggtgtcctgagcatgcagactgcccttggagtggtgggcaggattgttttagcctaaaggggttccacatctgcacgggagctcttgctgatgggtcactctggcaaagttcccccggcgggttccctgtgagaaggcacctcacggtcagttctgggtctggtgagtgttctcctgcaggctccacgcttgagccaggttctgccggaagaggcggcgttgggttcccttggtggatgagaggcgccgagggtcttggtggctccatgtgcccccaagggcagcactttgcatttcttgggagacttgaagatgactgatgtcattttagtgagcacggtaaaacagcacctgttagcggcttataccttgagctctgtctctcttcttggaggtg

SEQ ID NO: 139382 - DNA, 591 bp, Homo sapiens
ggtaaaaacagactgctcccaaaacagcaggccatgaggtgaccaggtccagcccagcccagcctgcagaggaggagccctgtggggctgtgatcagagcccagcgtcccagtgcacctgccgatgccctctccagcctctggcttccttccgttggctgtccttggagggctgtgcttcgtgggcaggcgtttggtgtcctgagcatgcagactgcccttggagtggtgggcaggattgttttagcctaaaggggttccacatctgcacgggagctcttgctgatgggtcactctggcaaagttcccccggcgggttccctgtgagaaggcacctcacggtcagttctgggtctggtgagtgttctcctgcaggctccacgcttgagccaggttctgccggaagaggcggcgttgggttcccttggtggatgagaggcgccgagggtcttggtggctccatgtgcccccaagggcagcactttgcatttcttgggagacttgaagatgactgatgtcattttagtgagcacggtaaaacagcacctgttagcggcttataccttgagctctgtctctcttcttggaggtg

SEQ ID NO: 139383 - DNA, 293 bp, Homo sapiens
catttccctgtgatgagcccaagaagtccaggttaccaggatgcttatgagaaagccaagggtcagtccttgtctcctgggctactggaaccatctcagatgcatgcctggaggctgtggggctcctcagcccctgccatgcccagggggtcccagaccgctgccagaggcagagggactggggcttggacagccaggaaagtccttccacacactgtagctgcagttgaaattccacagccccatttgagccccagagcttgtcctggtcactctcaccttctctctccact

SEQ ID NO: 139384 - DNA, 259 bp, Homo sapiens
ggacattaggcgcgtctggtattaggcgcgtgctggtgccatcatgaaaatacagctcatatatacagctcctgtggcgtgcaggacgttaccatgtggtattgccaatatgggacattgcactcatgtgtatacacacacatgcacagacacacatgcacaggcacatgcacacacacagatgcacatacagacatggacacagacatacacacagacatggacagatacacagacacacacgcagaacgcgcctaat

SEQ ID NO: 139385 - DNA, 285 bp, Homo sapiens
aaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccaccactgactcgtgg

SEQ ID NO: 139386 - DNA, 256 bp, Homo sapiens
gtgagagtctctgtctcgttctctctctctctctctgtctcgctctgtctcctctctctctctccctctccctctttctctctctttctctcacccgtctcctcctctctctttggagtttttagccctggctcttaacctggttaccctctgttctttcctttaattatgcttatctggttgtcatctggttacttaatattagggatgccctcaaccaagaaactttttttcttcccatctcctcctttgttca

SEQ ID NO: 139387 - DNA, 604 bp, Homo sapiens
ccgctttccacccaccccatgggaggagcatgaagacctaggtctgtcttgaagattaggtagaatttggataggcagatgagtatggggcattccatttgaggtgaattgcgtaagtaaaatgagaaggcagcaataaacagagtgtgcaggccaggactggtgagccagttccttccagggctggatctggagctctgttagcagaaaggagatgaggaccaggcctgggctggtgttgggaagtttaggggcaggccttcctgagtcatgttgtgatggaatctttgggttgccttggggccatgggagcagtgcatgcctcttctggcacatgagaagctgctcagggcatctccatcattagccctccaaccagaagcctagctctagtgtgagcatcaagtgggtggttggaggaggccatgatttgtcttctataatattgacctcaaagcctcccctgctagcccttagtaaatcaggcatgtgtgaatgtgcccaaatcactctgatatatgtttctttttggcctgtaccacttctcagggtaataaacgccatgtctgagtctcctagtgcatggagtgggagctggaagagg

SEQ ID NO: 139388 - DNA, 887 bp, Homo sapiens
ttccctcccaaattcaggtgctatgctgtacggtgaggttacaaagaggcattagatggaccctgcactcaggatgtcctaaaatgatttgtttaagcaatataagatgatttatgttaatggatgtccaagctgcctttacaatgttgccatcttgttaggaagtcacaaccaactcagataaaacattgagcaaacaatggaagattgatagtaattaagtgagagtgagtaagggtaaatagatcttgtgtgttgggaatagttagggaagtgattagtggagattagagggaggtttattggaggagcatgaagacctaggtctgtcttgaagattaggtagaatttggataggcagatgagtatggggcattccatttgaggtgaattgcgtaagtaaaatgagaaggcagcaataaacagagtgtgcaggccaggactggtgagccagttccttccagggctggatctggagctctgttagcagaaaggagatgaggaccaggcctgggctggtgttgggaagtttaggggcaggccttcctgagtcatgttgtgatggaatctttgggttgccttggggccatgggagcagtgcatgcctcttctggcacatgagaagctgctcagggcatctccatcattagccctccaaccagaagcctagctctagtgtgagcatcaagtgggtggttggaggaggccatgatttgtcttctataatattgacctcaaagcctcccctgctagcccttagtaaatcaggcatgtgtgaatgtgcccaaatcactctgatatatgtttctttttggcctgtaccacttctcagggtaataaacgccatgtctgagtctcctagtgcatggagtgggagctggaagagg

SEQ ID NO: 139389 - DNA, 413 bp, Homo sapiens
tgtttttcatcttcctctctctgctcttcctggattttgaactctcttgaagctactcacatggatgtgaactgtgatagatgactgactcctagttcaaaactttgatatgatgcagtgactatgattcagttgcactgagcaggttatatcaggtagagagcacccacaaaatctcatgatagacaatactataatgaaaagagaagggttctccagaggaaggtatttttatgctagtaaccacagaacttttttgataaggccaagaaatttactgagcttttttgataaggtcaagacatttgccagaaaagaggcttgtctcggcacatagtcctggagtcttgatggttttcatttgtagttgttgcagatgaggaattatttgttgcttagctgtttttttcttg

SEQ ID NO: 139390 - DNA, 501 bp, Homo sapiens
tataatgtgtgatgacaccttagtgaaatcactttctccttttggaacaagaatatctatagtgaatatgttatgctgtcttatcataaagtgtgggtaatcagaagacagataaattatctctttatttcacaggccacaaggaactgtactcaaagagctgtacttaaggaactacacatcagttgtcttccctgcacttgggcttgatttaaataatgagattttgggctttgggctgatgctgcaatgggatgagacttttggaggctttaagagacactgagtatattttgcatatggaaaggatgtgtattattggaggctaaaggccaaattgtgttgtggactgtttgggataattgttatgtgttaataggtaattacatactgcttaattcaggtcttcacacttccgttgagtgatttttctaaaatacaaattggatttcaaagctacctaaggctacttactatagaagaaaatgttcaaattctgca

SEQ ID NO: 139391 - DNA, 462 bp, Homo sapiens
agacaagacatattctctttgttaaaagatgtgagaccaagaattcaatattacctgtaaatattttttcaagtttaaattgagacagaaaaggaaagcaaggcttaacctcaggaaaattagagatttgcaggtgtctataactagtctttgaaaatgtcattcttcagttatttcttccatgaataatttgtaatattttccagaacttttgctaatataagaaaatggagatatgtgaggtttttgtattcatgaacagatacaatagggaacatttggaaaagatagttggatcaccagattagtttagctgctatgctatctctcttacagtaactatttcccgaggcattatgtactgttcaaaataattatcagtgaagaggtctgggagcatctctcccagtcatttttcttccaaagaaataaagttctatatatttttagtaaaccgtatgt

SEQ ID NO: 139392 - DNA, 792 bp, Homo sapiens
ctgaccatccacgtgttcattcatttgttggacagaaattaaacatgcatctagcacatgcaatgtgccaagcttctctgtaggccctggggtgccacagtgaacaagacaaatgggaaccctgtttacagggaggttactggttattgtgggggagaaactgtcttccttcttgtgcttttttgatgtcgtttcctggaagtgttccccacactcgctccactccagccactctggcttccttgctgctctttgaacacacctatttaaatgtgagcctctctgcctccaaactacagcctccatgctattccgttttccaccttattctcctccagcacttttaagtaccatctgaccaactacagtttggttcattttcttttaatttccctgtgtctttccatgaggatataagttcctcaaaggtagtaatttttttctgtcaatttcactgctgtctatggccataccaccctgaatgcacccaatctcatctgaatttcactgctttatcccccatacctggaatcatgcctggcctgtattaggcactaagtatttgttgttgaataaaataaataattttggaagataagtgtttcgaagacagtgatatagagcagcatttctcatggttgctcgtgggaaattttacaacccatgggacaccggcaatgtctggagacatttttcttgtcacagccaggaggttctacgggcacttagtgggtagaggccagggatgccactagtacaccagacagtccccccataacaaagattcatctg

SEQ ID NO: 139393 - DNA, 425 bp, Homo sapiens
ccccaaagccaggggacctcttccttcctaccagccatggactccccaccccccagtgccactccgtgcagcccaggaagctgtcctccttggggctttctctgtctcccagcccgaggggagcatgtgaggccacactgaccccggctggccctaggcctgaggtctggcccagggaggccctgctcctggggctgggggtcctccatggtgggaccattctggggcagaagacccctatctctgccaggaggtggggggggcttgctttccctctgccttttcaacatactgccagccccggaggacagccacaggggcccatttccttttcctgcagttcccagagaaacacagaaaaacctgtaggctgtgccctgggctttggtggggattggcggggtggaggagctgagttgatgggc

SEQ ID NO: 139394 - DNA, 121 bp, Homo sapiens
tgctaggattacagccgtgagccactttgcccagccagcatcctgtgttctaagcacctattgtctttacccaaagccaaatgacctctctgctcagggcagctcagaactaaaaggaaaa

SEQ ID NO: 139395 - DNA, 531 bp, Homo sapiens
attctcctgcctcagcctcctgagtaactgggattacaggcgcgcaccaccacacccggctaatttttgtagttttagtagagacggggtttcaccatgttgaccaggctggtctcgaactcctaaccttgtgatccgcccacctcagcctcctaaagtgctggaattacaggtgcgagccacctctccttgcctgagaattctatttcaaacacagaaggttgaatatttatagaaaggaaaaaaccctttagtttaagaaaagtaatttctaattgtccacagctttttgtcagagtaaagatattatttggaccagggtcacaacatctgtaattgtgagtgctctgtttttcctatcaagaatacctgtcaggtgtcctgggctctcttgtcccctggaatccctatctaggttctacagcaaatacgtaaactctcttgcttcttgactttctacccaacctatgctggtgtctttagatgtctacttgttagaggacatacatgtgcagttcttcagttttggta

SEQ ID NO: 139396 - DNA, 239 bp, Homo sapiens
agttcagataaggattgtggatctgtataacaaagttcaaactcatggaaacaccttcactggaaggttttctctgtctcttaaaagtgattttttctaaataaaaatctaaaattactggccaggtgcaggggctcacacctataatccccagcactttgggaggtaaaggtaggcagattgcttaagcccaggtattcaagaccagcatgggtaatacagtgagaccccatctcttc

SEQ ID NO: 139397 - DNA, 270 bp, Homo sapiens
agttcagataaggattgtggatctgtataacaaagttcaaactcatggaaacaccttcactggaaggttttctctgtctcttaaaagtgattttttctaaataaaaatctaaaattactggccaggtgcaggggctcacacctataatccccagcactttgggaggtaaaggtaggcagattgcttaagcccaggtattcaagaccagcatgggtaatacagtgagaccccatctcttcaaaaaatagaaaaaaaaaaaattagcagggg

SEQ ID NO: 139398 - DNA, 388 bp, Homo sapiens
cacatatataggtgtactacataaaaattgaaacaaataacatatagttcttccaatttcccttgtatgacctctttctttagttgttacagtgcttagttcccagtggtggataaataattttgccaaaacaattgaccaaacatgtcatgccaacaaagggtatcaaatgattatctgggtagtgccttagaattccaaatatgaacagacgtaaagaaaaaataaggacactaacaaaacagtattggctttattcataaatttgttaggatgtccaccaacacacacaatcacaaatagattactaatctttggtaatcttaattttctcaagaattgaagggtgtttagatacagaggacaatgaggggaggtggatttaaga

SEQ ID NO: 139399 - DNA, 861 bp, Homo sapiens
ctcaaactttctggtctcaggacttcttgtacccttcacaaattattgaacacccaaagagctttagttatgtagattatgaatattaactgtatcaaaaattgaaatgacattttaaatgaaaaatacccatatttttaacaaattgataagtattgttttatcagttttgcaaatcactttacatctagctggatttttgtatctgtttctgccttcactttattgcaaagtgttgttttcggttgaacgtctgaagaaaacctggcctcataaataggtgattggaacaaggggggagtgttttacgtagccttttagatcgttgtgggtgttctttgatactacaaccaaaaatcaagtggtagtttcttaaaggctagttgcaatgtgggatcaaactttttgtaccatgtggatcagtgaactttttgcactctgttatgttagaattcgttaatctatcttgtactttgaatggatcttttacccgtgaatgatttttgtaatatgctattgtagtttggaaaatactggttcaccgagttctgcagatcttctagatgttctcattttattatgcagtattttaaaaatcaccactaatctcagaaaagtttttaagttttgggtatcgatcaagttgaagttggaagatacaagttttccaaaattctaattatcacttgaaagacaaaattttattgttggcgataaatactgtcgttttacttgaagtgacagtctcatttttttcattttcaagaaaatatctgcagatacccacttctggataatagtttgtctttatttacagtaaactgtttacagtactttcaagtaaaaatgttttccatgaaa

SEQ ID NO: 139400 - DNA, 344 bp, Homo sapiens
aagagcctgtcatgcagtggggagtgggggcagtgtggtggcacctaagcaaaggggcagagacctccatgtgggaaaaggcttggagcattcgaggaatgaatgcaggccaaggtggcttgagctcctgggagaggaagagcaaatgtaacagaaagagacagtagcatctaagaactggttatttctacctccccgactttctgcactgctagaatacacctggtcaaaatcaaaggggtccaggggagggaatgcagagacttggttaagctttttagcaggaaaagaaaacaaaaaaacagaagaaaaaatagaagtaaaaataaacaaatgtcaccatg

SEQ ID NO: 139401 - DNA, 384 bp, Homo sapiens
tccatctccacacttcagccagagggattatcaaaaccctttgataacatataacagacatcctcatgctgtataacaaacatccccttaaaactgccattggctatgtttgtaaacatgagatttggacaggactcagtggagcaactcccgtctgctccaggatgcctaggacctctgctgggtagacaccaatggccagtagacagaaatctctttctcctcgcggcaaatctgacttgggatttgtagaggtcattgtcattcatgagctgatatttgcttctcttcagctcattgccaagtgtcccatccacatgctatctctagcatggtgctttctgggtagtcacacttcagggcttcaagagaatgttctcccaa

SEQ ID NO: 139402 - DNA, 165 bp, Homo sapiens
ttcttcattagtgttatgttatattaatgtcctaagtcagttaactgtagcaacaacttataagttttttattggcaccagttttcatttatgttcctgggaattaaattgactgaaaaactcataagttgttgctacagttaactgactttaggacattaatat

SEQ ID NO: 139403 - DNA, 331 bp, Homo sapiens
ctacttcagcgtcctgagtagctaggactacaggtgtacgccaccacgcccagccaatttttttgtattttttcgtagagacggggtctcatcatgctgcccaggctggtctccaagtcctaggatcaagtgatgcacccacttcagcctcccaaagtgctgagatttcaggtgaatcattgtcactttgatttcatacttgttagcaggaaagtgcggaggctgcttctgctggtactgtgttgattttttgtatacattggcgaggtgagctagtccctggttgtgagctgaggctgccatgttcccatgtgtgcccagacctttgaag

SEQ ID NO: 139404 - DNA, 125 bp, Homo sapiens
aagtttgttccacaggtcctctgggcactaatccctagccagctttcctacattaccaggatatccccttaaggacttccttcattcaaaataggcagaactctgatggtttactagacccaagg

SEQ ID NO: 139405 - DNA, 482 bp, Homo sapiens
gtgcagtatgccgtggggttccgataccccaactctggaagtgcagagaggacacagggaaaccaagggctccatcttcgcagaattggccatggagtatcagcacagggatcccttcacaaccctagacctgtgcacccccagtggttaggagcaggttctctactgatcaggcttcaggttctgactctgtgcagggaggctgttagtgaatcccccctgttgatagcaaaaggccagaagggccaaaactatccccctcttcccttcttcttacatcttttaatgtgttaaccatcaaatcactggtggacagtgcttcccagaaaccactctttgacctgattttccccaggctgtgagaaaattaaggactttgaatgagcttttcagaaggtgaacatattccactttaaggcctttctatttatttttagtttatgtccttcctacttttttggcattgaaaattccgttcatga

SEQ ID NO: 139406 - DNA, 283 bp, Homo sapiens
tcgcaccattgcactccagccccggcatcagtgcaagactctgtatgggggaaaaaaaaatgcagattcagactataaagaactgtctaatcactaagaagtggattgttttagggtgtattaattcttcattagaagtctcatagcaggggctctgagtcagggcaggcacaaagatattgttttactgggtagatggtagaagtaggtcgtcctccaactacaagaatgtgtgactggcaattcataactctttatattttactgcactattaaaatactt

SEQ ID NO: 139407 - DNA, 447 bp, Homo sapiens
ctgacaccctttgtctcgctctgaaggcagcaaggcacctatgttcagtggttcaagtacactcatcctcctcttcttcagcccaggatatcttctatcctgacttcacccagccatttattgttaaagccactgcctccatctcagctgtaaaagtcttactgtctggtcaacaggagtaccagaatttattctagtacacagcaccttttcctcccatagtgcattagaatcagaatgcagtcatttgtgtttttaaaaactttttttttaagcacagagatacctacttcagatctaagccattaaaatgagaaatacttctgtgatggaaaaacacaaacataaataaataaaacataaattctaccatgcctagatggaccttattcatttgtaacattggaatttccagtggttccatgcgggcacctagaacagaaaata

SEQ ID NO: 139408 - DNA, 390 bp, Homo sapiens
gagagagagagagagtggcgggaggtgggggggagagagagaaagagagaaggagtgggggagaaaaagagaaactggaaaaaagataaacagttatagaagagagaatggatacatgaagacagacaaaactgaaaactggaagcaaaactgaggaagccagaaatgttgacagatctagaaatagactatttccttgcctatttgtcactgctttctcataaatgcccatttatttttcaccactggtaatggaaagtatttaggaagagagggaatgatcagtcagggaaattcatctatagacattcattacgtttccttgcaatttgtcactttcccatttcatggaatctcaaaacaagatgctaaaatcatctctatactact

SEQ ID NO: 139409 - DNA, 166 bp, Homo sapiens
ctatgcactggcatttccaaagcaacaccatagatcttttacaagcttccttttgaagattcttatggcaccatatttttatctgaagaagacaaatagtaaaagtaaagaaacagcatcattggcaagggtggggaaaatgcattctcatatactacctgtacaa

SEQ ID NO: 139410 - DNA, 551 bp, Homo sapiens
  misc_feature (143)..(143): n is a, c, g, or t
  misc_feature (149)..(149): n is a, c, g, or t
agaagcatgccttggaagatagtcttctaaactaaagatgtagttagagaaagttcctaagaggagacaatgcccagccttggtaggctggccacaggggcagaagagggctagggactgcctaaaagagggtcaaaatattntattgncattttgcaattatatattttttgaatgcttttcctggtaaaataagttttcaaaaaatatcatcctgtagtaacagggatactttttaaataaaattcaaaagtaagttaaaataaccaattttactttctttttcacttatttgaatataaaaagttagcaaattctttttggatgacatcaatatttattttcccctatgcttcaggctggcctacacactctccatcaaaggagaaaccgcgagaacaattttattgcttctgtttcattggaagttttggtcctaaattagccttataaccttcttatgatattattcaaaaaagtgtttaggattcaaaccttgtctcagcagagtccctcaaactgtgaactacacaagttccaagggtttattt

SEQ ID NO: 139411 - DNA, 419 bp, Homo sapiens
cctgcctgcacttaggcaattgaatgtagtgctttaaatgtataccaaaaccctcaacagggcatcaacaatgtctggcagtgcagctgcttcttcactttcccaattaaaaatgcgtttgctggctgggcgcagtggctcatgtgtgtaatcccagcactttgggaggccgaggcaggtggatcacttgaggccaggagttcaagaccaggctggccaacatggtgaaaccccgtttctactaaaaatacaaaaattagctgggtgtggtggcgtgtgcctgtaatctcagctacttgggaggctgaggcaggagaatcgtttgagcccaggacgcggagtctgcggtgaaccaacatcgcactactgctctctggcctgggcaacagaatgagactctgtctcagaaaaaaaaaaaa

SEQ ID NO: 139412 - DNA, 279 bp, Homo sapiens
agacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtggg

SEQ ID NO: 139413 - DNA, 130 bp, Homo sapiens
tgagggttggcacctcccatcccactatcttgctgatgtcattctctagatagaattttatttgtctttttacccttagcacaaagcacaggatttggtacataaatatttaatatacatatgttgatgg

SEQ ID NO: 139414 - DNA, 491 bp, Homo sapiens
tgcatctcagtttcgggacgagagaggagtcctttgggccgggcacgtgggctgcctgaatggctgctctgttcccagcctgacagctgtgcagccgggtgcccgccttcccccacaggcccggagtggggcttgggcttggggtggcggcagctctcacagctccagggccaccagggctggggcaggcagctgtgtcccatgcaggccttggcctcagcagcccatgggactcggtgtagccagggaggcttcctggaggaggggtccttggttcatactttgttccatgagccctatcacctctctgtccctggctctgagctgggtgaccccagggtccccaaaagagccccgtcccagaccctgccttcagagtcttgttcttggccaggggagcggatagaggagcagagccagacataaacgttcccgttgctgtgtgtgtcttggggaggaggaagagaagctgtggggtggggctttggagg

SEQ ID NO: 139415 - DNA, 288 bp, Homo sapiens
ccctgcagacctatttgtggatcaagcttttgatccgactcacaagggatcccatcaacaagaagcttcttggtggtgtgtcctttcactgggatgtcactgttgtctctttgtcactcgttatgtatgtcaccacgcattgaggcacccatgaactctatccttcaggacagctgaggtggcatgaagctgccatttcttgttctttttctccatctggttcttcttcctcttcctcctcttcctctttctttctcttttcttttcttttctttctttctttccacc

SEQ ID NO: 139416 - DNA, 275 bp, Homo sapiens
aaagatatggatgaggtgggactatcatcatgtacaaagatatctcatttggcacttgatcaggtgaagaattattttttgtctttcttcctgttgtgtatgcaaaagacatcttaaatgacttaacttgaactaggagttgatcaattgattttaaaaacttggttatagtaaaaagcattaaaaattgatgacttaaacattttactttaatcaaaatatatagacatacatgcatttgttagttatttggttacagggcagtggttttcaac

SEQ ID NO: 139417 - DNA, 125 bp, Homo sapiens
tagggaaggtacagtgaaaatacagcattataatcttacgggacccccttcatatatggcgtccatcactgactaaaacgtccatggtagggatttgtgtatctagacatagagaaggtacagtg

SEQ ID NO: 139418 - DNA, 180 bp, Homo sapiens
gtattgtgccttcatggatacacattcaacaactcctcccactttgaattacccactggtgcagatgaaattctggttcagagtcctgtaggtggtaatggtatgagggtcaagggcatgtgacttctctctcctctttatctgcactctttctttatttgacactccataggaaactat

SEQ ID NO: 139419 - DNA, 453 bp, Homo sapiens
ccgttctgtcccatttcaagaggaagacgtagcagtcgcgtgtagaagtggccaaactcctctcaatttgggctcagtggcaggtttaatggcatgggtagatcaaactttccgagcctgtggacttgattgattgaggttgtgacatttatttccaaagcatccttcaaaaagttggttatagactaaaccaccagtttcaaatctggggtccccctgactctaatagtctttgaaaggagtgatgggcagggagaggagggggctgagagagaaacgaagtgttttgaaaactctaatggagattctacttagcaaaactaaggctgaatgtgctagctaaaaaggtcaggtttttctggcttaaaatcaatcagtaatacctgcaggatgacatcctgaccatggcctctgagcctcagcttggtgtggctaccattagcctctcctctg

SEQ ID NO: 139420 - DNA, 634 bp, Homo sapiens
cacagtcacacctcagggtgagccagctctgcaataggatgcactgctttgtctgcagcctcacagacctgaaatgcactctcatgtcctgtgcctcagtgctggctgggccttggtcctattacatcttgaactcaaggtaatacatcagtggccgggattcacactcagaaccaccttgaaagtctgtgctgttaccaccatgtcgcagaggtagaagtagatgtctgtataaacaacctttgggtagcaggtggtcagttaggcaggaaaaatagttctgctacattatatatatcaggagtatattgacaggaacatgtgtgttgggaatatatatgtcagtaacagcatgaagaaagaaaggctttgacagttctgagcaagctacatcacacatcttgctaaagtttttgctatatggaattggtcattctagagatgtcagttacctagcacaagaattgcaaagaacaaggttggcaatggaaacccttcctaaggcagagaactatgtgtttaagaacaggggctcagcagcagatgcctaagctacacaggctagggcaagccactgccctcttgcgtctgttttctcatctacaaaatatgaaaaataactgaattttcttca

SEQ ID NO: 139421 - DNA, 491 bp, Homo sapiens
tgggtacccaaggctgcccgtgactggcctggtacatccacctaatctcagcttcatatcagaaagctaatgctgccccacaactaagctgcattctccaagactgtatcaggagtaaaggtgatattctcatctccaccttctttacactgtgcctctcttaagtggttccgaaatctgaaaaacaggtgtgctgtttaaactccaatcataagcacctcaggacatttaaaagaacaactaacgtttacccagagcttttattagcccactggaacttcctaataacctaacacagtcagttaattagcaaatgatgcctaagcacctattattaagcactcacagccgcgcaccacaccaggcaatggggggcggtctgtatcattagcaccattttacagttgggaaggcaatcagagtcagtcactctgcggtaggccacaccaccaggacacggcatgcaagcgtgccacccaggtcttctgact

SEQ ID NO: 139422 - DNA, 667 bp, Homo sapiens
ggcagctcacccagcagtccccaggagggggcctccggtcagctctcacataggcttaatgcagagcccttttgtaacaatgagttgaggttagggtacccttcaaagccctgggaccgttttaatgttgaactgaatatagaacagaaacgatgaaaaatgtggtgccggcagctgacacagtgtttaccaaagcaccagtcatgtggcagtagatgcttctgggtgcctactgtgtgcaaggcatcattctcagtgctgagaacataaagatgagcaagccatgttctttgccccagaaggagagaaagaattgtctgtagtaaagagaggagagccacaattacctcgaaatgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgcccgtatctcctctttcccctttttcccctttgtcttcatttggttcccctccctatagggagtttaggacaagaagaggctaaagtttcactgatgagccttt

SEQ ID NO: 139423 - DNA, 728 bp, Homo sapiens
ctttatgccagtaccacactgtctgcgttactgaccctttgaagtaattttgaaatcaggaaatgtaagtccttcaactttgtgcttttttgcatcatttgtttttggctattctgggtcccttgaattagaatggattttagcatcagcttgtcaatttctctaaaaaaaaaaaaggagctggaatttaataaggattgccttgaatctgtagatcaatttggggagtatgacctccttaacaatattgtcttttaatccatgaacatgggatttctttttatttatttagcaggccttctttaatttctttcaacagcattttgtagttttcaatgtaacaaacttatgtactttttttgttaaacgtattcctatttgttttattctttctggtgttgttataagtggaattctttaatttcattttcaaattattgattgccagtttagaaatacacttgattttttgcatattgatattattatatcctgcaaccttgctgagctcatttattagctttaatatgtgtatgtgtgtgtattctctaggattttctgtatacaaagtcatgtcatctgcaaatagagatagttcttcctttccaatctagatgcctcttccttttctatcctggcagacatctttaggaactatcttggttcttctagggaaacgtgaaaaaactggtggccatttgggcattgggaatttcatttctatgctg

SEQ ID NO: 139424 - DNA, 223 bp, Homo sapiens
atgagacaggcaggggtgctcaatcaatgtcctgggtggggccttttcattatccacagtgatcagtttattctgaaggtctcaggtcagcttcctgcttcaaaatatcacaggcccttatagggtatataaaaattattataggatatccacagtttgtcatactttactaaagtagtctaataattagatgaagttctgaatttaatattcagttgtatta

SEQ ID NO: 139425 - DNA, 620 bp, Homo sapiens
gtgggaaacagtgtttccaggcagagagaacagcacgtacaaaggagactgttgggagggttaaatgaaataattcatgtaaggtacttagtaccacacatgaatttcacaagcagcagctggaatggtggtgatggtgatggtgatgatgaggactcacaggccataatgcctcatggtattagccaattattgtatcctctactgaaaaaacagccattggaagaagggacagagcaggctttctgcctgggccagtgtggcctacagagatgctccaaaacaactggtgattaactagcaccactgggtcccccaatttgagaataagggagcagcgatgactgaggaaaagccaagtgcgctcaacatggcaggggcaggaaagcagatgggcccagcaccgcctggattcttaacagcttgctcaatctaggccataatttgcttctctgtttgcaatcagaggagaccaaccggcatactttcatttgacagtcaggcttggaaagaaaatgactcaatgtcacagggccaccctgtggcactgctcagagcagagcccaggcctctgaacttagattcatcccttccgcttctccagtggtccacttcctcat

SEQ ID NO: 139426 - DNA, 224 bp, Homo sapiens
atctgttatcttaaggagtatgccaaaatctgattagtaaaacataacaaaggtagatttatttttcatttctggctgttgtacaaattgtcagtataaaatactctaaaattgttgtggatttaattcatttttttcttaacctcaaaatttttgccagtacctctttaatcattgtattctttctttctgcttgtcatctcataattttctgttatttgcct

SEQ ID NO: 139427 - DNA, 740 bp, Homo sapiens
ctgaatgttcctttgtcttgtaaaacttaaataaatttgtatgcttttctctgctttttattataagtgcctcagcgtgaagcttgagacaagtgaggaaaggctattatgaccttttctctcctgcagctccaaaaccaccacccacagggaatggaggaccacagtagcattttgtctgtgtgccctgagaggggagagagttgcagagaagcagccttcacccccatcccagtggatagagtttcctgaggttcggtgacaccaggaatggcaactagttggggcatcctgcaggggaccccaaccgggtgaaagaccaagcaggaaccggtccacgacagctaggaactgtgctgtgggtcagcccacaagaccactgatgaactcatcacaagttccaaaacattcttaaagtctgctgcaggcagtggctagagaaaaacgaaatctaaataatttcaaatttatattctacccagttctgactgttaaatcttcaaatcagtaagtcagaatgttcatcaattataagcgctttttttaaaccaaacagaccacagtaatgatgttcacaggcagtgaaaatcaaggcttccattatatataccaagtcatatggaactctatccatcaacatatcaacattatatttccttcctaaaatgtcttcaggaaaaaatagagcaagggagtaaacgggagcctatcgtttaggagtgtgcatgaattttgcaaag

SEQ ID NO: 139428 - DNA, 360 bp, Homo sapiens
attgtgctgcccagtgactgtctgtgtgctgctcccattcagcaatctgtgccaggcaaggtgctagtgctgcctggctgcaggaaggctaactggacctgacgtggtctctacctcaggggctcatggtatacagaagacagacacctacgtaggcatacatcagtgctgaggactcttctgggtaaccatcagccagagaatccgcagaagaaatccagctctgcttgagcaactggataaaatgatgcctaaggtcccctgaggttctaagcaccgaccaagggagatctgggatgggaccacagacagaagaatgcccaccagaatggcccctgcccatcctgtaacatggttttc

SEQ ID NO: 139429 - DNA, 126 bp, Homo sapiens
acagctgttgtaaagggcttgatttcttaatttgactctcagcatggttgttgctggtttatggcagaaatcaatttctgtacattgattttgtaacctgatactttactgaatttgtttatcaaa

SEQ ID NO: 139430 - DNA, 297 bp, Homo sapiens
actagcaactagtttactcatactttcagttctgtaaaattaaattatttaatatgtgcagcaattgctgttttatttatttatttatttttgagacagagtcttgctctgtcacccaggctggagtgcagtggtgctgtctcagcttactgcaacttctgcctcccaggttcaagtgattctcctgccttagcctcctgagtagctgggtgtggtggcaggtgcctatagttacgaggctgagccaagatcacaccactgcactccagcctgggcgacagagaaagacttcatctc

SEQ ID NO: 139431 - DNA, 523 bp, Homo sapiens
aaggaaataaggtaagaccctaatcttaaatgatgcatatacaaatagcggtagcatttagttatttttatggataaaatagctttttaagttaattttctttaactttgatgctgatggcacaatagcatgatggcacctctgtgtcattataaaatgtctatcatctccttacggactaaaagcaggaaagaaaaaaaaaagtagtcctgtttcaggctccaaagtgaggcaccgatttagcacttgtcttctcttctgaatttgcagctggagataagctaagaattgggcatgaagaggaaaaggaaggaaaactcaagttgaaataacgataagcaaatgctcagagttgttgatgtcatcctagacattgttagagaggcaaagacagtatcagtcattttgacaagccccttctgttcactgttactgctttcccagggaggctttctttcacatttaagatgagaaatcatattcctctccacccacaatttcccctttctttttttcactttgt

SEQ ID NO: 139432 - DNA, 263 bp, Homo sapiens
cactagtgaacccctgctgctccggctccacacttctcatgctggtccttcctcagtgctcctggggacacctcttgcctgtcactgtctgttggaatcctggacattcttcaaagcctctctcagatgcctcttcttttttcctttttatttattttttttgggatggagtctcattctgtggcccaggctggagtgcagtggcgcaatatcagctcactgcaacctccacctcccaggtttaagtgattctcctgcctcag

SEQ ID NO: 139433 - DNA, 395 bp, Homo sapiens
tttagttcaggggagcttctcattatgtctggttagtttgctaaggaaatgggtccctgttcatctgtccccccaccatgtgatgaaagcagctcactgctgttaaaaccccatggctccctgaaccccagggacgcctttcgattctggcccatgtccaggtctccccttttattcctctttctcctcatccctgacttctcccctagtcctgagaaggagacctgtcattaggcaggacccacgaggagctggttctgcaaacagagtctagtctcttctttctgtgcgctgtcatatcttcctaaggctgctgctatagaaggagcccctatctagaaggtgggagggaaggagaatgggtaggggaaagatgcaggagcagtgacttggat

SEQ ID NO: 139434 - DNA, 449 bp, Homo sapiens
ggtgtgttcctgtactgtcatgactccatttaccctaattaacgcacctgtcttctcccttgtagttcagtgttcttgcagcccttatgataatcgttgtgctctatactattaccgccggtgcataagaagccgtagaatccctctgaaaaatactcatgcctaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgagattacaggcctgagctgtgtaatttcatgccacgtgatacagcccagtaaaaaggaagaaaccccacgggtccagcgtctactcacagagatg

SEQ ID NO: 139435 - DNA, 459 bp, Homo sapiens
gaaggcagggctggggaaggaacagtgcgctaggcagagggaatagcagatgcaaaggccgagaggtaagacagatcaggcacatctgaacaatggaaactacagcagctggagcacagggttctgctaggtgatgaagcacaaggctgaagagattggcagatcctatgcttaaacacctcacaaaacacatcaagaagtttcagctcacatcaatgcattgctggctggcaggctgtaaattggtgccactttcaaaaactgtttggcagcatccacaaaaaataaaacatgctgaccctttgattccacaattccacccctgtgtataagccagaagaaacaagcgcttgtgtccaccaaaagacatgcccaagagtgttcttcacagcacattcataatagccaaaaactgggatcaatccacttgtccatcaacaggagaacagacatggtaca

SEQ ID NO: 139436 - DNA, 806 bp, Homo sapiens
agaatccttcatttttagtatacttttaaaattgaacacacacaacactttggttcctaaagtaatgataacaagaaattaaaatcaaggtacagtatcatttatatgtagtagtacagagtaaccatgacttactaggtgttatgatgaaggtgtatgtgtgtgtatatgtgtgcatgcatgtagataagtgtgtgcatttgcacacataagagttttaagctgctcctgtcatttattgatggtcaaaggtttcttttggctattgctggactcttaagattgtcttgtaattgtctttttgttgttgttgaaaattaagggtgtatattaaaggtagtttttacccagatcttatatgtgtaatagctcacatctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattattgttgaacttgcattaattacatcgtgcatatatggacatacaatgtcatctgcagaatttaggattttttattgttaatttttatagtgactgtggattgaggaattaaaattagcatgcttcatttataatagtatttctagtgtttcattagccctaaaaatgtgataagatcaggaataagattggaatgaaaatttctccttaaaatggtacgtct

SEQ ID NO: 139437 - DNA, 802 bp, Homo sapiens
aaaatgagctgcctgcctggcagttttgttgtggctgggccttcacggcaaggacctaggcacggagtcctggttgagctggtttactccatgaaaacgaacttcagttctttggcttgccccctgagaatccctgtacaacacaaccaatctatttccattgccctaactggagagggaaccagcattgctgaatgggggtattgggggaagcatggtgggggaagggagaaggacttaggaaattaagtccttgtgagcaatgaaggtcctaaaagagcaatggaaagacactgctcttagtttaaaacaagtttgtacattattcttaattttcatcacatttgagtatctgatagacatgggtgttttgctgggtaggagaaaggaatgggacttacataccacatttacctctcactcttgagagaaaattaaatcttatcaagcatttggcatatatacttttgtattgaatgcccacaatatgaggtattcagctaagcaggaatttttgagaaggaatgagatttttttgggaaggttaaattgggagtatagtagaataaatatttgtcagaatatgtcagttgttttcctaagttgataacttacctagtctatttggaggaagggaggcgagtgttcttgagacaaggaatgaagtgcaggctatttctggagtagtggagtaagggcttggggtggaaagtggaggagggcagtcactgctgtttactttgcatccactttggaatgatgagaaactcagtttcttagaagaaatagtaatgaagagatg

SEQ ID NO: 139438 - DNA, 422 bp, Homo sapiens
tatggccgttacaggaggagagcggctagcataattggttgcatcacttttattaggttgatctgcaaatacattcagcaaggaattgttctggtgtgtggaaaagcaggacaaagcgctcccatcaatctgctctgacagccctgaggtttgctatgtcacctatgctagattcaaactcccgtgctcaagtgccaccacacctggctggcttctgtaactagtctcatgcagtctatggccacctctcctggcaacaactttctgagtaatacttgctttcatgaacattacccccccttccctccaagtcagccaaaataccagtgccagccccattagaaatctagccttcaccactgcatgtgaaacctgcaatgtggacaactgatttcccttttatatttaacccgagcgctgct

SEQ ID NO: 139439 - DNA, 551 bp, Homo sapiens
acatcactgaggaagaggcattcgagcccaggcttgaatgccgtgagagaacagtttatatgaatatggggaaatgaactgcccaggcagttcatgctgaggaagtgctgtggccctggactgtaatgaacccagtacatcattttatatttaacacatgagaaactggacactaaaaggttacacagcaagtgagcagagagcttggaatgcacacagtatgatttcagagcttaagcctttgaaggttatgctcttctgcttttctttttttttttttttttttgagacagagtctcactctgtcacccaggctggagtgcagtggcgcgatctcggctcactgcaacctctgccgccagggttcaagagattctcctgcctcagcctcccaagtagctgggattacaagcacctgccactgcacccagctgatttttgtatttttagtagagatggggtttcaccatcttggtcaggctgatcttgaactcctgacctcaagtgatccacccgcctcggcctctcaaagtgctgagattacacgcatg

SEQ ID NO: 139440 - DNA, 336 bp, Homo sapiens
caaaagattggacacccctgctttatagagtgatgtgtcttgaattgggcctcaggaatatggtggaacttagcttgcatagaggagagggaaggcagtctcaacaggaagaatggcaaaagcaggggcggagaacctggtgtgttaaagggacagtgagggagatgtggtgcagagggcttatactggtttatagtagttagcaagtgtaaagagatttgctagcttggaatggcagactctggattttgagattattttcttagcagtaggaagttattgaaggcttatgaacaggagagtaatagagaaaatgtatggggaaagtcagtgtat

SEQ ID NO: 139441 - DNA, 420 bp, Homo sapiens
ctgcctctctctctctctctcactctcacgctctgtctcgctttcacgctctctctctgtctcttgtcctggagtcagcagccaaaattaacagctgcatactgattctcctctgcgtggaggaaatccaaagcatttgttaaaatactgatacaaaagggaaaataagcattagtcaaacaaaacatcacagaaatcttccaaatctaccgcatcctacaggatttgctataaatattcatttttataaatagatcaaagaaaccagtaaatagaatgacttgttcatttgtcagattggctttgggttagtgctgctctgggcatgctggtgcacagggcagagacgggtctgaaacccaagtcttccatcttcagacctgtgctcttctaaacccacaaacactctacaggatcaaa

SEQ ID NO: 139442 - DNA, 197 bp, Homo sapiens
tttgggctacacacatgaggtgcacccatacatgagtgggaaggtggcaacaaagatggaggagctccgtggtccttatgctgcttctcctctttcttctacaatcacagaagtggaaatgttggactgaagcaaagattccagtgcccagtccctgactttgttaatgttgagaactaacaacaacaaaaaaaata

SEQ ID NO: 139443 - DNA, 226 bp, Homo sapiens
ctttgcctgtaaagtgaagacaagaatatcaatcgcgtaaagctatagtgaggatgaaatgaggtcatgtactatgttagtattatttttgtagtaatacaatagcagagcaaattgatacttgcccaggacctcctaatttctgccttaacctggcatctagcttagaacacattaacatagttaataacttatattatccaaatttaactcagccaagacccca

SEQ ID NO: 139444 - DNA, 423 bp, Homo sapiens
agagacttctagggccctgggaccctgacactgaggaggagcaaactgaaggggagagtgggcacattccttgttggctgctgtggtgagcagcagctggtcgttgtcagtcaagctccggaccactctgatgatgctcactgcattttgatggagtaagccagggacattaccactgtgtttgagccatctgaagtattcctgggtgggtctgcagttggcagcccgtgatcctttttccattcaaggatgatgcaaaggtaaggggccaaggctgagctctgtagatgcctgtgagagcctcctggtctcaagaggtcataccaagggccttggccaccaaggtttcgtgaggaccttgaggtggtttcgccatcacaatgtcagacgtgtcacacaccatctggtatgtcctcactgtat

SEQ ID NO: 139445 - DNA, 503 bp, Homo sapiens
cttgatttcttcaattgtccatgttttgaaataggagaaatggcttaaaattccccctcattcttttttccagttcaaatgacttgctggggtgaatatgatgaagttttagatggaaagtggacatttagcttttgaaaatgatccttcataacaactgaactatctgtatacagtattgtgattcaccaaaccatatataggacaatgcttactcttctgcaaagggttcattctagagtcctagttttggtggccctactctttgatgggaggtcagatattgttgggaggctggtaaaatgcacaaattagaaggccttgaagggaaactcaggactaggaagattcagaagtagatatgaccaagcaggtggaatacgtcttggttattactcagcagcaaaatgatgctaagatgttatccccaaaaagactgttttacttctataggaaaaggaccctattttctcaccaaaagaaaaaaactacaagctaaaaaa

SEQ ID NO: 139446 - DNA, 472 bp, Homo sapiens
ctggccctatcctgctcctttctatctcggtgcttttgtttctcctgttctgcctgccttggatggtccccttttcagctctccatagtctaactcacagtctccttcaagcattggccaaatgacacctctttgagaatgtcagtcccgcttctgagctgcagtgcctgtttctttgcaggcacttgaaacagtctgccgcttagcttggttatttctggttcagtcttgctttcccttagggtgggtatgcagtggttaaaatcacagattccctagacaaggacagcctgggtttctgtctgtcttctgtggttttctagcttatgatttctgtgagcttcagagggagatgggcatattagctctccccgggtggcagtgaggactgtgagtttctgtatgtgaggcatttgaaacaagtgctgtgtaggggaggatccatatctgattaatcttttttttttttttt

SEQ ID NO: 139447 - DNA, 234 bp, Homo sapiens
acagtagcagcatcagctcacagacttctgaggggtatcttcaactgtgctgcccgtttttctcatacactttttcttgactagtttaaatcccctttgattacctcctctgacagctcttcatccaggcactgacccagctctgggcctcagcttccccatctctaaaccgaaggggtttgcctgggatttctctaaagctatttccctcccaaattgtcagttacattttcc

SEQ ID NO: 139448 - DNA, 334 bp, Homo sapiens
ttcaaaatgcattagaatatctccccagcactctatgtgccactcaaatagcttaactgcatgtcaaagaagcctaatgctgacaatagatcaaatcaacccgcgagcactaagagatttgccacacaaaatctgaaacaactgcaatttgccaattaatttgggacaccactttcttctaatctccattaaaagtgagttcataaaagtcattcctttttcccaaggatacatttcattctggcacttatcaataccaccacgtctaccccccacataatcaccaagtccacacaaccctcattatctactcggcctcagtatcacttctctt

SEQ ID NO: 139449 - DNA, 364 bp, Homo sapiens
gttgttttacctttttaaacacggcaactagaaaattctaaattacattggcagctaaaatctatggctcacataatgctgctctacaatgctggtgtgaactatcacgacactgttatactattattctttgttttatctctgcctcactcactagacagggaacttaaggagaataggaagagtaccttccactgctacgagagatgcttggtacattacaaatattccgtaaatacttgttgagggaatgaagctatgaccaaaaaaaaaactaaaaatattcaatgattctgaaatatttaaaaaatcactcaaaatcatgtgctatattgacttgcccacaacactagtctgtttggtg

SEQ ID NO: 139450 - DNA, 186 bp, Homo sapiens
tcctgggaactgggctgtatcttttgaagacatgtgggaagaagaagaagaagatgatgaatataggaagaggtagagaattgcaggagaaccatggggtcgatgatggtgtcaaccaatatgaagatctcaggcagcaagtgtttccgaagggcaaggacaaggtaagggctggggcactgccca

SEQ ID NO: 139451 - DNA, 311 bp, Homo sapiens
ctcagtgatcctcccgctcaaacgtacaaagtgctaggattatagatgtgagatactatgttaggatttttgtattcattagtggggttggactgtagtgtgtgtgtgtgtgtgtgtgtgtgtgtgtgtgtgtgtgtgccatctttggtcaggtgtcattgatgatttttttgttccatagaaagaatttagaattttttcttttctgtgctgtggaacaattgaatagtattggaatacccactctgcctgtctagtagaagtccttgtgattgtcagtgcttggtgcttgtggagggtagctctttgac

SEQ ID NO: 139452 - DNA, 254 bp, Homo sapiens
ggctagcacagaagctggggacaggactagaacagaccctccctcacaggcctcaggaggaaccaaccctgccgacaccctgacctgaacttcagccttcagaaccaagagacaacgaatgcctgcagaaaccttcaccctggctcttgggtttgggcaggtccagcctgcagaggggagcggatctcctcctgggccctggcctgccctccctggctggcatgtggactaggggcctgggggctcactggatg

SEQ ID NO: 139453 - DNA, 415 bp, Homo sapiens
ggcaaaccctggggacgggaggcagggagtggcctggggtcaggatgccaagtccagggctctgggtcctgctggactcagtaacctgggaggcatgtagttctcctccagtctcaggcatctttagggacctggtttccacactccaaacctcctccctttgtgtctggtccccaaattacccaaataagggcaagaacccagtcatccagggaccctgggttggtaccagtctgatcccctaccttggcatagctcccccaggctcagcatccagaggtggagttgggagggactggcttcctgcacccatgacagtgaggaggaatggggaggggcacccgcctccaacagcgttagtcctctcactgcccccagccagccctaggaggtctctagtctcttgtaccctgcg

SEQ ID NO: 139454 - DNA, 438 bp, Homo sapiens
ttatgttttgtatgcaatcatcttttcaacagtattttatgtaatcttttagaaaatcctaagcaacttcaaatcacataggaggtgcccaataataaaaaagaatttactaaaataatttctataaaaacaatgccttcaacacttctaatatataccacaaatatccctgacatatcttcccaatacacactcacagttgcacagttggggaggggtgggtaatggctcttcacatctgtaaagatgatccacacttaaggagatcactcctcccttctaattcccagccccaggggaaggtgaggatcaagtgctaagagtgcctttccaacctcatccgcatgcttcggcgacaccgtagcctctgctagtccctaaagatgacatgtaattttcatgtctccatgccttcactcgtaacaggatgcttgccta

SEQ ID NO: 139455 - DNA, 394 bp, Homo sapiens
cctatctcacaataatgtaatatgtaaatttcatcatcattctgcttaattaacagtagttactactgttgtcattatttttagaaccagaagtatagcagcagcagactaacatggcagttaagagaaaggacttcagagttcttgccaaacctgaaatctggatcaaccacttattagatgaatgagttaacctctctgagctttgctttcttatctgttaaatgtagataataagcacctcacagggcttcaagaatagctaattagataaagcatataaagtgcttagcacagtgccttgcatgtagaaagtatgcaataaacggtactaatcatgacaatgaggaagagggggagaggcaaggggaatacactgactttgggacagaca

SEQ ID NO: 139456 - DNA, 247 bp, Homo sapiens
attaaacttacccaacctattgccaatcactgaccccaccacttcttacatggaggtgtaagattatattcacagcaggctatgcacagtggctcacgcctgtaatctcagcactttggaaggccaaggcgggtggatcataaggtcaggagttcaaaaatcagcctggccaacatagtgaaacctcatctctactaaaaatacaaaaattagccaggcatggtggtgcacacccctagtcccagct

SEQ ID NO: 139457 - DNA, 527 bp, Homo sapiens
ggcaggaacaagagcagatgcctggggtgtgtgtggcgaggaagaaaaggacacagagattcacagggcagtgcagggatgcaggtggaggatgggaccatctccgctgagcactctccttccatggggaccagtgtggccagccctgtgctcccgggagggaattcacagaaacacgggtcatggtgtgtgagtgctacccacattttcctactgagcttaataaaaacagcaaagaaatgaaataacgatgaaaacccttccttattgatgatgagaccatagttctataagagggtttttctttgcttttgttattgaaaagatcaaaaaaatggaatgctccaagtttgttttgttcttattagtaaggatgccctgagtatttttacctcaaggcttaagatctgaatgtttttctttctgctacagaaagtctatagaggaagtgggcaggcagcagctgtccagcccatcataccccacagcagaggggaggctggggcgtgggcactggtccgcctacc

SEQ ID NO: 139458 - DNA, 387 bp, Homo sapiens
agttgaagagaatctgaaatgactttaatattcaccaggtctattcatttataaactggttttatacattcataaaaaaactgaaatcaaagatagaaaagcatttactgttctaaaggggaagagaaaatactgggacatgacaacaatttacttcaaaatgatgaccaacatttcaaggaccctgatgacctgacataactacttccagtaactttgttcttctggccaggcttttcccaggacaatataaaacgtgagaaaagagtgctaaacaagacatctactttggtctggcaaaatcaggcttgcttaaatgcataacattacctaagtaggggaaaaaaatgttactgtgctagttatttatattcagatccctttaag

SEQ ID NO: 139459 - DNA, 123 bp, Homo sapiens
taaaaacatcaatttagcctacccttaaatagtaacgcatttgtcacccccagcccaaagtggtaaaagggcatacacatcacaaaacacagaactgggagagaagttactgccctggggaag

SEQ ID NO: 139460 - DNA, 322 bp, Homo sapiens
gtaatttttaagagtgtaagggtgtctgagtccagaaagtttgagaattgctcttagacaaaaaggtataaacaagtgcctgttgtcagatacactttctttttctcaatgggtaaactcttcccagcttctgcctgcatttggtctctctccagagcattgaaaaatggtgtttttgtccagattttataggaaagtttatctgacaaagctgctttgccattaccagaacccaaagtgctgggaaatgattttaaaagggaaggaaatggcaattattgagcaccagctatggtattggtatcatgcactatagttggga

SEQ ID NO: 139461 - DNA, 349 bp, Homo sapiens
aaagctcaggaagggaggggagacagggaaatcagttagaggctgactaggattttgctttgtcttccgtctggattgcaggagctccttgcctgcacctctattatggttcttcccacagtgcattataattgatcatttgcatagctgtatctccattcactccttgagggcaggggccaagtcttgtgcatctcttcatgaccagagcctggcacacaggagtgctcaagaaacattggtatcatgtgaatgagtgaataaatgaatcaataggtgctgagcaagtgcaactccagtttgccccaagtaacctctctgatgggtatatcagagataaatcctactc

SEQ ID NO: 139462 - DNA, 660 bp, Homo sapiens
ttttcccagtttgtgacgtatgttttcaccccctcttcacgtggtgtctcagagatgttctgaatttggaggaggagacactgactggttatttttacagcggtgtttctggtgtcatatctaagaattcatttctgaatccaaagccacgaagattttcctctgcgatgttttgcgttttggtctggggtcctcttgagtaaccttccctgtggggtgtgaagcttggattgaggttccccttgtggtatgtgggtgtccgggtgtccgactgtcccagcatcagctttgcaggcgcgcagcgttgcctcagcgtcgtgactgtgccgtgtgcgggctccgttctggaaccttcctccgtcccactgctgcacgtgtctgtccgttcccgcggcagagctggctgcggtgagaagcctccgacttgggcgccgtgtggaactgtcggggccattctggtgttgggctgcctgtgtgtgaatcttagactcagcctgtccttgctctgccgtcctgtgggaacgtgtcttggactctgacgtggtggtgagcgctggtcccgggaccacgtggactgtggcccccaccggcctcccgtggtgcacgctggagcgacgtggtcacttttgccatcccgtgctgagcttctcagttgtgctt

SEQ ID NO: 139463 - DNA, 304 bp, Homo sapiens
aaatgctataaatcaaggctttcctctcctctgccatcctacctcccctgtgcccccagcccagagcttcttgtcaaaccttcaccagcattcccctgatcaggcccccacagagcttgaccaaaccctgcttgactcagcgaaccctcttttgtgtctcccaccatctcccctcttccatcttagacatcaatttcacggccgccctacctacagccaagaagcctatggacagggtcatgtgtaggtccctcaggggctgaaagcacacccatcctgagtgtactgttcacagtgcagctga

SEQ ID NO: 139464 - DNA, 263 bp, Homo sapiens
cggggttttaccatattggccaggctggtctcgaactcctgaccttgtgacccacccacctcggcctcccaaattgctgggattacaggcaagagccaccgcgccctgccgagaatttgcatttctaacaagttcccaggtgatgctgacactgctggctcatggaaccactgctgtagtattttccaaattatcctgattctaagaaccacctatgacctgtgctgttttttcagtggttactggctcatgtcacataaatt

SEQ ID NO: 139465 - DNA, 345 bp, Homo sapiens
gtattcattcatgtatttgatcctcaccaaagtgttataaagtggtctcatgtgacagataaggaaactggggcatacaattgactgggatcacatagctagtaaataacaatgctgggatttcaacctagacagccaggctttaagaactggaggtagctgggcacagtggctcacgcctataatccagcactttgggaggcggaggcgggtggatcacctgaggtcaggagttcgaggccagcctgaccaacacggagaaaccccgtctctaccaaaaatacaaaattagccgggcgtggtggtacatgcctgtaatcccagctactcgggaggctgaggcag

SEQ ID NO: 139466 - DNA, 252 bp, Homo sapiens
tgcccattttgctcaaaatctctctctcctcactcctacaccccccttcagcaacttgctgggattttttcggcgtaacgtagtgggtctgggcaatccccagaacaggaaccctcccagcagcccaccacccctagtctataatcacagtcgacttcaaccacaaacacctggagcacggaaagcgctgccccacccaccaggaaactccgcatccctccacatgaggacccatcctgcacccgggagcag

SEQ ID NO: 139467 - DNA, 352 bp, Homo sapiens
gcgtcttctcttttctaaggcagtaaacatgaacagtcatttaacacatttattgtgcaattattatgtccaaagtatgttgctagatgttgtttgagtataatttgggaagattttcatcaaggctagtaaaacttatttttgagttttagttttcaggaacatttgttcatccacagttcattctccccagtgagagaaggcattagaagcactgcaagacgtttggtgactaggcactgattattcctgaatattgctaacatttaacaagtagctcaaggtggggaagaagggggtaagatgaaaatgaaaagaaaaaatagtgaaatgtttaaataaatcatatata

SEQ ID NO: 139468 - DNA, 303 bp, Homo sapiens
tcagccggcccgtttcatctatggtcacttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaa

SEQ ID NO: 139469 - DNA, 367 bp, Homo sapiens
ctaagaaaagcctcctttcacatctcctggcatctgcttccaaattccctgccagcccagagctgtctgggcgatgaccagaatggagagtgaggagcagaagatggagatggggccacacatgccccaagctccccccaccacacccaacccattcatcaagactagcttcatggatctgctagttttccactgtgggcactgggcaaggcaggccagtaggagaggggccatctccacgcaaaacctaatacctggcagatggtggtgagggcagaagatgccattctccggggagactgcgaaaggaggaggcagccctggggctttcattggaggccagaagagatgagggagggaagtcagg

SEQ ID NO: 139470 - DNA, 247 bp, Homo sapiens
gcaaacctatgagaagtgctgttctctggaaatcattttggtaaagatgaacagtagaaaaaaaggagaaaaagcttagaactatgcagactggtgctggttctaccatagtagtccgagtttagcaaataatactattagtcgagatctgcttaggtgtttccccttaattccctcatctgcttactttctcggtctctgtgctaactgcagtgtccttaagaacactgtgaatctccctccctgg

SEQ ID NO: 139471 - DNA, 219 bp, Homo sapiens
ggcccacagggtttctcccatccatccatcagtgcagccaggatactgcagctccaaccgagctctgccactaacctggcctgtggcctcaggctagtcccatcccttctctcatcctcagtttccccgcttgtgaaaggaggactgggctagatgttgtctcagtgccttctggctctggggtctgctctgccctttcccaattcaccatggtcttgg

SEQ ID NO: 139472 - DNA, 370 bp, Homo sapiens
ctttatgggaagtttattaattatggacttaatttctttaatacataagtgaatagtcagatcttctgtttattcttatatcagttttggtaaattgtgttttctaggaattttcctgtttcatctaaatttccaaatctgttggcataaagtcattcataatattctctcattatatttttaatatctgtaggatctgcagttatataccctttttcattcctactattggttatttgtgccttctttcttttttcttcacattattgacggaggtttatcatttttacaagtcttttcaaagaagcatttctttgcctttgttgattccactttgcatttatattctttatttttttatttttatttt

SEQ ID NO: 139473 - DNA, 163 bp, Homo sapiens
tgggctacaagagtgaaactctgtctcaaaaaaaaagaaaaaacaattgctggccatggtgttgcccgcttttggtctcagctattcaggagcctgaggtgagaggatctcttgagtccaagaggtcaaggctgtagtgagccatgtttgcgccactgcactg

SEQ ID NO: 139474 - DNA, 378 bp, Homo sapiens
cgcgccactgcaacagcctgggagacagagtgagaccccgtctccaaacaaacaaacaaaaaacaagtctttaggcatcactgaggaacacctaaaatggatacagcactaactagacaccctcgaccctgactccctaataaaagcgtcagtcttttgctcaatatcctgacctgacagcaaaccaataaagacacggcataaccaaactccacaaatttttggccaaataaaagaaacacacgcaacgctaacattaaaccttttctatggccgcttcacgataagtattacaaaatccccagaaagagtttattcacctagctccgactgtcgccatacaaggttaatgttagtgtgcagtgtgctccgaaccag

SEQ ID NO: 139475 - DNA, 219 bp, Homo sapiens
agagcaggttcgctgactgtaagaaacgtaccccctggtgggtgcggatgctgggggaggtgacggtgaggtgggtaggggatatatatagcctctcaattctgatgtgaaccagaatctcctctaaaaaaagaactttttttttttctaaaaagtgaaaaaataaggagaaacagacaaattcatcatcagagggggagttttgttttggttcttgtt

SEQ ID NO: 139476 - DNA, 380 bp, Homo sapiens
ccgtaatggtcagttctgaaggttgctggggttgaacagccttccgttcactgtctgggtttgggattccagcgaaagccttcataccctcaagagaatggtggtgtgtggccgggggctcctgggcctcatgctggaggctggagagttagagaattggggcatgaccagctcatgttgttcagacctggtctggtgtttgtgcctcgtgtggtgtggcgggttttggcatcagaaagcctgtatttaggctgtacttcccccttcccagtgtgcctttgtgggccacttacctcacttccccgttgctcataaacgttagctcacttcccagttgctaaatagttgccaataaacaacagcaactattattattcata

SEQ ID NO: 139477 - DNA, 447 bp, Homo sapiens
cttgcagctttacaagacactaggaggaagtgtcctgtccttgctgtcttttcccttgtattttagatgggaagctaaaactggaggggggcaaaaaccaggcccactaaggctaagcctgaggacagggcagaggaaagcacaacagatttactttcattcttagaagacagtggatggaaaagtggatttccaccaacaaaagacctggcctttttccctgagcaggaaatactgagctgctgtggtcttgccctccctgcagagccggcctaatggtttacccatggtaaaagcgttgcagccaaagagagcagaagagaaaactgggaagctggtgtcagattttctactcgggcatatctttggcctaggcccccgcagcagtcacgggggaaggcctggaaagccgcagtctaacaagatgcctgacattgtgaaatgcct

SEQ ID NO: 139478 - DNA, 396 bp, Homo sapiens
taagctctgctgccctgggcctactgactcctgtcctctcactgtccttactgctgtcctctcctgggctgatggccgaaaacgcctccctcacgggctcctcaccctaagtaggtaggtctctcccaccttccatctaattttcacagtcccatcagaattttctttataaaggctggtatggctacctaagttcccgttattgcccagaagataatcccaaactgcctaatatggtattgatagctctcaaaatggggccatcgagtaccccccttacactatctcccattcgtttatcccatctacaccgagattcagtcaacctgctttgcttttcccaaatagtcaaagatgacgcatgtttcccatcctctgttctgtgctgttcattca

SEQ ID NO: 139479 - DNA, 541 bp, Homo sapiens
tctcaaaatatgcacagatcattggcatagggagcgcaattatttctgctgagttcagcagcaactgacaacttcactcaggactcccagttatcagaagccaaggcatttaaatggtttcacttgggaattctaacaagttttttcccaacaatcttaagtctacggaaaaaaattagaacaagacattcttatttagggcctgcctaaagggagcattagtattaaaatatgctgccatgcatgagaaccttgctaaaactgcctttgagtttcttgtttctctggcttaggagactgccccataagttacatgaacaaaaggctcacggcaaatgtctaatccagctggctttctcctggtcgccagcaagcctcaagcctgccactttctttggccataatcagcatgtgcttaaggaatgctgactaattccaacgtttgtccaggcaggacacagggaggtaaatccactgccaaaaataaaaatgcattccaaagtcgagtattaggtcactctgagatgatgtactattttat

SEQ ID NO: 139480 - DNA, 433 bp, Homo sapiens
gttttctaggtgggtgatcatattaaactacaaacaatgatactttagtctcctttccaatatttatatctatatttaaaatcttactatgttgacaaaataatagtaaatattggtgatgatcaacaattgttccttttcttactactttctttactacaaatatctctattgctttgccactgagtatgaggctggctattgttttgacatagctatttttcactaggttaatcaagaatctttctatatatggtttaatacaatctttaaaaattaataatacatatttgaatatcatttccttcatgtactctctaagatttttttttcttgttcattcccaatccagttccacattatgtggtgtttattgtctactatttatgtacttaaatggcaataaatctactttagtgaggcagagagttag

SEQ ID NO: 139481 - DNA, 316 bp, Homo sapiens
atatagcgcgacacatttaagaacgaaaacagaaacaaaaataagaaacagtacggagatctatgctgcaaagtcgcaatggggcagctttgcaggcaactcccactcaagcaagagactgaagagatctcaaaatagctgctagcgctggccacacgcagccctccaacgaggcacggatgctcccgcacgtgagttttggtcttgaggtcagcattgccattacccccctcatttccaaactattatgacgtcaagtatatgtgtctgttgctagaatggagaagatgagggactgttacaaagtatccacatg

SEQ ID NO: 139482 - DNA, 291 bp, Homo sapiens
ctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaa

SEQ ID NO: 139483 - DNA, 203 bp, Homo sapiens
tatattctgcctcggtatcttttctggaagtttgtattctttccaaatctcagaagtcatatttgcttattgtaagtaaatttaaatgtaaatctatattctaaaagtttctaaacggtcttttgccttttatctctatttctcctgggataacaaaatcgacagtagtgggatttttatttggcttctcaattataccaatg

SEQ ID NO: 139484 - DNA, 105 bp, Homo sapiens
ccatagcacccccattcattctgcctccacagtggccagtgcacagctcccagaccccctatctgagcagctcctcccctgctcgaagcctctgatgagtcctta

SEQ ID NO: 139485 - DNA, 830 bp, Homo sapiens
gaaacaaggtacatctgggcaggaatgcgcggcgcagacaggttgccgcctgagatcccgaagtgtacccagatcccgaattccttagagctctttagccgagcactgtggcaggagcgcggcgcccggaatacaagttcatggttccgagccggcgggcgaagggcagcgcgatcccccgccacctttgctctaaggcgcctaggggaacctgggggctgccgcggtgagagctccgctcccactgggaacattggagtcccagttgcgaaagcgacccgcctagcttccgagggacttctctgcgagcaccgcaggcgtgtgcatttcttcgaatctgagaattccagcgaactcgggctctaccagagtttaagtcggcccctggggcgtctgtttgtttattggctcttaagggaaaaaagtttgaagatctttaaccagcctcagacctggcgcgggcggaaatcccggaatctccccaagcaaaagtgatataacttcaagtcgttatataagtggggggctccttcttcccctccctacgccgagccttctcattatcattccgggagtaaaatgtgtctcgctcaacatagttttaaaatcgttattattattttcctgagcctgaagccgggccaaggcgcaggcagcgcccagggtgcgtggtggccccacccgcgcacagtcccacgcaaagggtcccggggcccgggtaccgccagagccgggcctgcaagcgcgccttcggtcccacggtccgccactccacgtggtcaagatcaacagtttgttgagctcatcagtgacaccttgaacttttcata

SEQ ID NO: 139486 - DNA, 153 bp, Homo sapiens
ggataccatgagccataggagctgcttaagatgcactgttctgaaggatgcactgttctccaccaagggcccaaaggacaaagaggcctggcttctgatcctaatcctaccacgtgctagctgtgtcccctctgccagcctgtttttccatct

SEQ ID NO: 139487 - DNA, 340 bp, Homo sapiens
gtgcctcccacgtgcatgtgtagaacagcattcagccagagatgcttgggaagtggatgagaacagcattcagccagagatgcttgggaagtggatgatgtctaccattctacggatcacttgcgatgcttatttcccagggaacagaaatgaagtggggccaggccatctcctgtctctgttgtctgtattacagaaggaagggagcggtgctggagcagggggcccaggagcatcacaggcggcaggccaaggagagagatgtaggtggcaggaccctccagggactcgggagagacacatgcgtgagcttttgcgatacggggtgagacagcaaggg

SEQ ID NO: 139488 - DNA, 503 bp, Homo sapiens
agtctaagatcgaggtgacagcagtttcgttttttcctgatgcttctctccttagctcacagatggctgccttctagttgtgtcctcatactgtcttcccttggtcagtgttgtctgtgtcctcgtctcctcttcttaaagggacaccagtcatattaggttaagaattgcccattagacctcattttaccttaattacctctttaaaggccccacgtctaaatacagtcatattctaaactactgggggttagggcttcactgagtgaattttggtggaaagtggggcaggggacacaattcagcctacaaaaactggaaacaaagtgaaaatcctatgtgtttctgtgctcagaagacaggaagtagtcatacccaagagtcaataattaaactggtttctcaccagcaatttgggagactggaagtcggaagacacagagcagtgcctaccacattcaaaagagaaaagaggccgggcatggtggctcacgcctgtaatc

SEQ ID NO: 139489 - DNA, 1921 bp, Homo sapiens
acagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacagaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 139490 - DNA, 1868 bp, Homo sapiens
acagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggtttggggacagaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 139491 - DNA, 589 bp, Homo sapiens
gtaaggtaccttgaggatccccgtggggccttacctggggccaggagaggtagaaagtgatctgagcgccgatgaggagcctgctttaaggggcgggcctttggagactttggtggatccaagagggggctggtcctgggaaaccgtccagggccgggaagtggaaactaaaggggctgggtaagggagactgaatcggcccttgcccgtggccatttggagaaggagaggctagaaaagacggggcgatgcctggaaaagccaaagggggaggggttatgtccttaagggcacagagaatcaacctggctgattgaagcaagaggccgaccaaagccagtcagtacctgggattggccgtctcaagagctagggcctagacgagcagagagctaggactggaacacttaagaggcacgcaattaaggggtaaggacccctttctaccccgtatgagtagcattgggaaattccaggggcagagataaaagggaggagtagaatacagagacaaagccacggttagtcacacctcaggccacaagtccacccaggccactgagcaggacgcagcaattgaagagtactg

SEQ ID NO: 139492 - DNA, 262 bp, Homo sapiens
tagttgctggtctgtgggggtggtctggagtgggggggcgggcttcttgtgagaggggctggggtggccagaacagcatgagacacttggataagtgattctttccatcgtggtgtggaagtattttgatattttaataaccagcacagccacattagtgtgtaccagccaaatatgagcccagcctgttcgtgtctttgtgtctgtatggaggaggaaggagctgtgtatagaggcttttactagaggactggactctgct

SEQ ID NO: 139493 - DNA, 276 bp, Homo sapiens
ctgccattgcagaggtctcccggcgggggagtgcagggggcctttgaggaattgaaggaagacaggtaggtcggttcttgggttggtctggattccagtcttgacagctgcttgggcctctctctgcctcagtgtcttcctctctagaaggtggctgcttcaggtgttcctggacattcctgaagttctgctcctaacacacttatcctggtgcctgatacataaatataaatgtgattgtttatttttttccaacaaatttggtggagtgctgac

SEQ ID NO: 139494 - DNA, 326 bp, Homo sapiens
tggttgtgtaacttcactcaggctatgttttccttagtggagtccaagatttggaatcattgtaagaggagaaaatggcaggtaatctcaggaatggaaaagaccagttatgtttctccaggagagggtttcttggggtgggagaaggtgaggaaagtggtaagtgaccagtgttcatagataagtaagtaaatcaaaggaagacttgaatgtatatggattcttgttcccagagaatataatagattatctgggaaagaagccaggacaagagagacctctcagcagaggcaggtgcccacccatgtgggtacatagtgtggtat

SEQ ID NO: 139495 - DNA, 345 bp, Homo sapiens
attgacagattacaaaacacactgtcagattagaacacacatctcacatctggaagcatgaatccagcacaatgcaggtgctcgacagaatgttagctggccaaatgaaggaccagacaggcagcgctttctcagctcctcatatactgaaaatgctcacagacttccaaacagcttaggactttgtctaggaacatggaaatcttagggagactctccctctgttgaggagcactgcaagcagcacctgagtggaaggacagggcctgccgtcttccgtttgatgccgtaactgtcagcagttcaggagcatttgcagagatggctggtaatgttaattttgct

SEQ ID NO: 139496 - DNA, 227 bp, Homo sapiens
agcaaatgaaacccccttctccagagtcacaggacagcagcttcccctgttaggaattaagtcaggagtcaaacctgagatgggctaacctcgctgcaggtggagcaaatgaaaccccctcccccagagttacaggacagcagcttcccctgttaggaattaagtcaggagtcaaacctgagatgggctaacagacctcactgcaggtggagcaaatgaaaccccct

SEQ ID NO: 139497 - DNA, 348 bp, Homo sapiens
agggaagagatgaggcaggagtctacctcacccagaaggtgagatacaggccacagatatttcatacctctgcctcctgattccttcttccttccaggatagcttgcttttgttactgtatcgagtgtctgaatatactttgatctgaagaaagaattctatgattgaagcaagggatggtccatgtggttatagtagcccagatgggatgggggtccttcagtaggacagtaactggagtaactgggaaaatgaaggggagatgacagatagcgaggacctttagagataggactgctaggacttggtcgccattggctgttagagaggcaggaggctaggcctggg

SEQ ID NO: 139498 - DNA, 441 bp, Homo sapiens
cggtcgcctccttaatgtgtgcccattacaaatataggaaggacttatgccaatgtaaatattagtgaaaataagcaagtgtgaaccaacgtgtgttaatggaagtaattccagatgaaagcaaacagccttattttgctaggaatccacgttaatgctttttatgagtgaggggggaagagctaaacaatggctcatttaatgaacacaagaatcccacaggtttggaatcaaggtagagataataaaccctgtaattaaacttacacagaaccttctagtatggaatctatttttgaaatctcacttcaaaacacaggacacttggaacatgtgctgtctcaatttcctctcaactaaaatatattttggctccattttttagggttttttccctctcaagttcctgtacagcagatgactcagtcatcaactcttcat

SEQ ID NO: 139499 - DNA, 485 bp, Homo sapiens
atgggcggggaccggaagggaccgggccttgactgattgatgttccacctcctagaaggagacagttcggcaggactgggtgctcccactaaagatcccaggcgcctgcccttcactcgtcacttctacgtcccttggagggtggccaggttctctattctcatgccccagtggcactgttcctgtagctgcctcctgccctgaaactctctggtccatgatgccaatgacctcatctcaggtacagacctctggttctcacatgggggtcccaggttgaagaatcaccccccaccatgttaccagtagagggtcttgactgcaagttgtccaggttcttggcgttttgaacaaagaattggacaaagcgcacagcaaagcaagaaaagaatgaagcaacaaaagaacgaaagcagggatttattgaaaatagaagtacactccacagtgtgggagcaggcccaagcagtattcaacggtcccgc

SEQ ID NO: 139500 - DNA, 292 bp, Homo sapiens
aaataacagcaccactgttataaatgttaatcaaaggacttgatttttggaggaaaggggagaattatgggtatgtgttctcttccagcatgcttttccttttcacgggacccagaatgtcatgttaagatgttctcagtccttgcatagactgttttgaaatccccgagcagcccatggtattattgtggatgacacaggacccataaaaggggcagagagagaaactcgttccccctgtgggtcctgctgcctttcccaccctctcgcgcacagggcctacccaaggtcc

SEQ ID NO: 139501 - DNA, 607 bp, Homo sapiens
gctgagtcactctagagatcccgcgtatccgtaccaggctggagccaccgcgcccggcctagaaaaggagcattttaagtgtgctttccttcagtgatttattttgtcagatgtatactcatatcttttgtagtgtatttttcaggtaatagtgtttctttggaagcgtaggatgtgctttctgccacagagttgagttataccactgaaaatacatgtatttaggcagatgttttcaacctctgcctaaaaagttttatggactaaatccaatctgcagatatattttctttggctcatacagtgttgtacatttgaattagttgtcaacatttaaaaaggagattttgtgtaaaaatgtggattcaggctgcttttgaaaaagcagatctggcagccatggatctgcttttctgttttgcagcaaccatcttttatagttggggcatgtcatttccaatttgccctagaccctgccaacagtctgacatgtagccctgacctggacagagtgttagttggtatttactattttatacctttctattacttgtctattttccatcttttattacctgttctggatatatcatagaggtctctgata

SEQ ID NO: 139502 - DNA, 272 bp, Homo sapiens
  misc_feature (213)..(213): n is a, c, g, or t
tcgggagttcaagactagtctgggcaacataacaagaccctgtctctacaagacacacacacacacaaaatctgaaggatttcttatctcactcagagtaaaagccagatccttacagtggcctacaagacctttgctcttgaactcacatttctctcccctccttcactgtgtcagccacatgggcacacattatggagaaaagtgtatatnaacttggacaaagaaacaaaaaccggcacatgcggttactgtgggcacacattatggag

SEQ ID NO: 139503 - DNA, 2347 bp, Homo sapiens
  misc_feature (114)..(114): n is a, c, g, or t
  misc_feature (881)..(881): n is a, c, g, or t
  misc_feature (965)..(965): n is a, c, g, or t
cagagtctaaaaaaacaatgtcctcaggaatacttcagaaatagaaggtatgcaatcccttagtggggggcaaacacatttcagatttcgtctttatttaaaaggatcttcagnctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcntttgtaacctgatcgtattatgtttacagctgaaagatttcatctagacatgtctttcgtccttattattcaaagtgtaattgnaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgaatcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaatagcatatgaaaacatgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttc

SEQ ID NO: 139504 - DNA, 445 bp, Homo sapiens
ctggcacgcggtcagtgctcaataaatatttgtggggtgttattgaaggtagttctcccctttggtaggtgttttgctattatagacagtgctgccctgaacttcgtagaacagaacatctttgtggccacctgcgtgttttttttatagaatccaggaaatggaattactgggtcaaaaagcacatgtatttgaaattttgttagatatatttgtaaaaagttattgaagatactcagccctacgcctaggtacatgcccctggagaaagtcacacatgtatacacatacatcgtgaagattcagagcagaacttaggaacagaaggttggaaaccacctgtccatcaataggagactggtgtactcatactgcagagaaaatgaacccgtgacacctacccatgttaatgtggataaaattcacgaagcaaaatgaagtaaag

SEQ ID NO: 139505 - DNA, 249 bp, Homo sapiens
tccttttccttgtggaaccatcctctctgatctaaatcaaatgtcttctctgtgagacctcctcagcaagagttcctaccccagagagacttcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactatttt

SEQ ID NO: 139506 - DNA, 244 bp, Homo sapiens
aaccacaaaagaagaaagaacttaagaaccttttggaaagttgggagcaatttctatttctccatggtagaacctggaatttacctttgagacagactgtccttctgttctgaaaaatcagattattcttgcaatcctccatcaagggtgaaattcccaaaggtgtggaaaactaagtactaattttaaaaatccaaataactacaatcttagatttgagattattctcaaattccacatttgg

SEQ ID NO: 139507 - DNA, 632 bp, Homo sapiens
cgatacccaggggaacaatcacttctattttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatgtactacttaga

SEQ ID NO: 139508 - DNA, 298 bp, Homo sapiens
gaaaaaaaaaaagattttgcctcaggccaaacctgcttggctttggataagacatggcagtcttctttggttaggaatacttcaagataaccacattgatgaggtgggtgagactgagaactgaacaagttttcttcccagctattccacagcttcccctctctgggggtccctccgtgttttttcttcatagcttgctatggttctctcttccttctcttcctggagaaagcagtatgtgtgaaaagaaagtagtgatcaggtgaaatgaattcaacatgacatgcaggcagggttg

SEQ ID NO: 139509 - DNA, 181 bp, Homo sapiens
atctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaa

SEQ ID NO: 139510 - DNA, 308 bp, Homo sapiens
atgagaaaagcttgggagtagactactcagggaaaacaaacagcgcttaatgagagctaaaagaagctcaaaacgaaatttacaaagtccagagaagcagaaagaaatgaacactaaggcattttctggtatgagattaccttaaactataggcattatgcagagaaaactgtgagaaaggtgatacaactaatcacacaaataagcttattatttggcctgtcaaagcagtttggaaacactcccatttcataagtaaagaagagagtcatattaaccagactctaaaatagtagtaagcaattcta

SEQ ID NO: 139511 - DNA, 269 bp, Homo sapiens
caacaaccagcggccaggtggagagaaggccacagctgtctttgggtagggagcctgtgtgtgcatgctgtgtgcatgtgctggagagactaaggcatagagaagggcccaagcaatgaggtaaagtgagtctcctggctgcgctagtcccttctttccaggcacaaagaagttgaacttgttattcatgtaggcccccttcctctcacctcagcttttagtaagcagtgtgtgtgtgcacgagtagctgtgtgtgacagagtaagtcc

SEQ ID NO: 139512 - DNA, 1023 bp, Homo sapiens
agactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccg

SEQ ID NO: 139513 - DNA, 418 bp, Homo sapiens
ggcacaggagttcccagtagacagtgggtcataataatatagttattatcatacactaaaccagtgcttactagttactattccgatcatgtcacttgtattgacctttaattttcgcaaaaatcattcagggtaggtacttttcttcacaatttacaaatgaagcaactgaggcacaaagatgaaataactttcccaagatgacacatctagtaataacggagacagaattgcaaacacgggtggtctggatccatggtctgcgctctcaacaactactctacgcacaacagcttctccacacaaagtgctgcgtgcttggctgcaaccgctgcctaacgtcattttaaggtttgccaaatgtatttgtctaaagaatgcattttaagttgtaatacatcgatgaaaagtcaacaag

SEQ ID NO: 139514 - DNA, 454 bp, Homo sapiens
aggtcgtaggggtgtagcaaagaggagtaaattaatgaactactaactgactatgtaacagccaaagtgttacaaagggtgtaacaggcaccctcctgaacattcagaagagaaactgccatgagaaatgagaactgggctttcattgtgacgagggaatcatccttagccatggcaccaagggcaattctgggtggtcctttcatgggtcagtttcaaagcttagaaacatactcccaacctgcctactctcttttaaaaactcatggatttatataaactctgcttttctttgtaaaatctattttgagtttgtggatcttcattaactctttctatctttttttttgctggccagacatgcccataccacttaacaaaactcagcttctctcaggaagagaacaaaagccagaatcttcttctatcttttccctttttaaattacagtgtt

SEQ ID NO: 139515 - DNA, 339 bp, Homo sapiens
agacattgatatctcatggactttttttttacagttggacatttccctttaaaaatttattggtggcaaaaggaaatggtccactgagaaatcttttcttcctcgtggagaaaaacttagtaagtccttatccatattgaggggatgagaggaatgaaaaaatggcatggactaaaatctccaggagaacttttcaaatactaaagatctaaagccatagagaaactgcctagatgacttttgtatttctgattggtcctcctgtcctctcctgcctgcttagactttgaaaatttaaacacttggtctactcagttgctgtcttgtgtattaattaaa

SEQ ID NO: 139516 - DNA, 642 bp, Homo sapiens
gaagatagggtttacctcctggctaacacagtcagagactagctctacaaaaaaaaattaaaaattagctggctgtggcagtgcacacctgtagtcccaaattctggggtggctgaagtggaaggatcccttgaacccctgagttcaaggttgcagtgacctgtgataaagccaccacactccagcctgggtgatagagtgagatcctgtctcttatttaaaaaaaaataaaaataaataaaaaataaaaagctaccggctaataggccaatactttaaaaaatccaattatttcaaaataaggcaggaaaggagcaaaagaacaacaaaaaaaccaaaggaatacaaggaaacatgtagacttaaacccaatgatatcaataattagatataatggactagtacaccaattaaaaggcagagattgtcaatccagataaaatggcaagacccagtgaagtagagtctcccagagacagacacaaattggttgaaagtaaatggatgggggccaggtacagcggctcactcttgtaatacctacattttgggaggcccaggcaggaggatcacttgcgctcaggcgtttgagaccagcttgggaaacatagcaagaccccatctctactaaaaattaaaaaa

SEQ ID NO: 139517 - DNA, 361 bp, Homo sapiens
ttatttgagtggcatgtgatgcactgatagtttactccaccaactatgattgcactgactataaaatgtaatacaagggcatattagggggagaatgcctttgttttttcttttgttgttattttgtttttaagagagtctggtattacactggaggatcacaaactgtattttcttgttataaatggctcctctatcttggacttaatggttaggataaatatttgaatgtagaatgcgttaggagttttaactatttttgaaattaggaaaatggagagacactttttttttttttaagagacatttttttttaaagtatataataagcatgtggcactcggaaagctctgccagtgtt

SEQ ID NO: 139518 - DNA, 358 bp, Homo sapiens
ctccctgaccaagtctttgtgttcagataaccaggttttcataagatgggtaagttacattttaggcttgaggatacactgagccagcttcccctgctggatcatttccccaaactctgcagcaaacatcccagggtggatgcccccaaagctgctgcacctccactaatcccattatcactgctcttaatctcattatcagataaaaacaaacacaatccctctttcaagcacctcttccactggtctccactcagagctcacttggaagacgtggcacctctggaaggcacctggtgggctgtagtgtcacccagtaccatgccctggatcagctggtgcacctcctggctgtcag

SEQ ID NO: 139519 - DNA, 465 bp, Homo sapiens
tagaggactcccattctggtcgatgacggtgtgaagcgtctctcgtgccataggtatgggattatgcacctcctacgccggtcagcttcggtttgtccactgtcttaggttccgctgcagcatggcgcgttggcctggccttctttgataagcactcggttgttgaatccccgcttgaggatacactgagccagcttcccctgctggatcatttccccaaactctgcagcaaacatcccagggtggatgcccccaaagctgctgcacctccactaatcccattatcactgctcttaatctcattatcagataaaaacaaacacaatccctctttcaagcacctcttccactggtctccactcagagctcacttggaagacgtggcacctctggaaggcacctggtgggctgtagtgtcacccagtaccatgccctggatcagctggtgcacctcctggctgtcag

SEQ ID NO: 139520 - DNA, 396 bp, Homo sapiens
cttgatgggggagagtgggaggagggagtgggcagaaaagatcactattgggtaccaggcttaataactgggtgatgaaataatatgtacaaaaaaaccccatgatacatgtttacctatgtaacaaaccacatgtactctcaaaactaaaatttaaaaaaattaaaatacagtgggaaaaaaaaagtgtagcagttggaggatggaaaattttaaaagaataataaaaacatggggtaaagtggagaaagcagagggtttaaaaagagagaacaagggagctaaacaaaaaaaatggaatggttacaaaactaaagagaaaggcaaaaacaataataatcataatcaagagggttagcaaaagagagaaaaatggagggaaaatgcacaaggaaa

SEQ ID NO: 139521 - DNA, 421 bp, Homo sapiens
taacgtttatcaaacctttgctttgtgccaggcactgtgctaaaagctttgtttatattatctcattgaatactaaggatggccttatgaaataagtgatgttattattgttttatagatgaggaaattgagacataagttaagtggatttctttagcccaaaatctaggaaactggggaagaagaattctaatccaggctgtctaactctagaactcatgcttctgtttgtcatacttatataacttattaacagacatggagcacaagaatgcttgtttggcatttttccaaaactagcaatcatcaggcaaacaataaacctacgagaaaaaaaataaagagaaaattcatgcttgtcaacagacaaaatagatgtaattctaaaacagattaaggaattaaactttgaaataaaggc

SEQ ID NO: 139522 - DNA, 631 bp, Homo sapiens
gagtcacattgggagcagagactagggagggaccgatgtgtaaaagaatgcctggatgtctagaacctcagaccatttgcccatttttgacaaaagtcatccaggtcttgtaagatggagaaatcaaaagtgccattttctggccatttggaaccattgtcaagtttgtattggggccaggcagtgttgcagaagaaaataaggcatttaggttttaggtcaggtgtgagttgaaaaggttttaagttcttgagaacacaggctaagggagaagaagggggaatggagggtggaaggtaacccatagtgaagtttgaagagaagggtagagatgtggagaagggtgtggggtgagcagccctgggctgtaacatgggtgagcagccaaagcaggcatccccacaattgtcttgccagcaagggaatgtgggtgaatgaccaaggcaggcatccctgcggtgatcagacaccaatggaatgtgggtgatcaggacaggcatccctacgatgatcagacaccaatggaatgtgggtgaataatcagggcaggcatccccatgatgatcagacactaagggaagactgtcttcctgagtccatgactggtgccagagttttgggttcatggata

SEQ ID NO: 139523 - DNA, 380 bp, Homo sapiens
cactctagcctgagtgacagaggaagactccgtctcaaaaaataataataataataatcctggactctagctgagtattaggataaaattttaaaaatattactgccttcacatacagatgaactcaaaagaagaggttaaaatgcagttattacatttagttggttctttcctccaataggagagtattcaggaagattgcccaaaaacttggtaattgagctttccaaagggggttcaggtgatcctcagtgacagttcaggctgtgccaggtatgcacactggagccacgtcagaccccagtcttaatatgtttctctaaggtgaccttccaaacagtgttctacgtgcttggtttggagccaagttggttttgtgt

SEQ ID NO: 139524 - DNA, 161 bp, Homo sapiens
actagtcacggttggctagtataaacagacagtctttgcaaaacaatctggcaatagatagcaagataatttttaaagttcggtagttgctctcctagaaatttccttaaaaaataaaaatatacgctgggattacaggcgtgagccaaccgtggactagt

SEQ ID NO: 139525 - DNA, 315 bp, Homo sapiens
agtgtagctgataaggtcagatgggtggagagcggtcagttataaaacctgtaaagagcaatgggaaccatggaggggtttgcccatgtgtgggaaggcctgtatttcttttatggaatattcatcatctttttgcccaaagtctccaaacaattagactttccttgactatcaagataaacagatattcctatgtgtagatcactgtaaacactttaagtgctaggaattcatactaggcctcgtaaactctaaattttagaattagaagtgatccctgaagatcatttattttgatattgttctgcattctct

SEQ ID NO: 139526 - DNA, 507 bp, Homo sapiens
actggttctgtgtcatacgggagggtctctggtgtatcagccaggacctttatctccaagggtcagaacctgggtcacgctagcttaaataacaaagagaacgtactgcccctcttgactgaaaaatccaggaagattcaggtctggctggatccaggcactccaataacatcaccagggctctctccttccccatctgtcagctctgtttcctccatgttggcttcattcccaggggagccctcttcacactgtggccccccgcagctccagaccacatcctgcccgctctccccagtggaaagagaccctctctagttcagaagttccaggaaaatcctagaatctgtctcttatgagaataactgggtcacatgggtatcagcagagcctggtggtggggtcagcccatcccaagatacatagcttgggaatggggtaggggctttacccaaagggaaatcagggaactgtcacagaaaggatgggggatggatgtatccagaa

SEQ ID NO: 139527 - DNA, 542 bp, Homo sapiens
gttgttagggcaaagataagatttcctccaaacggagagtgagtgctgatggaaaaaagggttcattggcagacagccaagaagatatcacatgtttatggccaagaagtgtttggaattcagccatgcatggagattttaatagtatatctagacactaatatctctaccctgaagttgttgctatgttattgttatcactatgtagtggtaaagggctcatattctgaaatcacagaggcctaagcctgaattccaactctgccccacagtagctgtgactttgggagagtaaattactactatcacactgcaagtctcagtttcctcatcagaaatatggcggtgatgttaatactgaccttataggattgatatgaaaattgaaggatatgacatattcaaaagagctgaatgcaaggccggactcatgaagttttattacctagattaggcccctaggggtttttgtgcattatttcatgtaatcttacaactatttgacataattaatatcgagccccctcactcaccctttacaa

SEQ ID NO: 139528 - DNA, 374 bp, Homo sapiens
ctccctttgttgcccaggctagtcttaaactcctgggctctaatggccccacaaagtgctggtattataggcatgagccgctgcacccagccttgattaattagtttttaatattatttttagaagtagggaaatctcattatttctctattttgtcctttacatttcttctcattcttcaaaactataagtggaatttttcaaaattaaaacactgctaccagaaaaaaacattggtatgaagttgccttttaagcatattcgctgccatattatgctctgcaaagtgaaaaaggtttacactagagcttgcaaattgttggctttctggtgagtctcaacatacagatgtgttttgatgggctcacaaagtg

SEQ ID NO: 139529 - DNA, 429 bp, Homo sapiens
gatattcagtgttattccatttctcttcaataggttcggttctctggaataacttaaccttcttttttgggttctttttgagttttgttccaataaggcctgatgactacctacattaagttgcacttattttcttatattaaagtctctcaagattttgcttagtttattccctacattcttaacttcagaatgtaagtaactgaggccacaagtaacgtccttgaacacatccttcttcccagtatttactactacataatcatgggcaccttgtcaactgccttatatcatctattttatgtgataacctccatcatatccagttttagaattttactgatatttttctgtcttctccaacattttgtgaataaaatcttgatctgatgatcaagttaccaggtgaataaattcttttaattcctg

SEQ ID NO: 139530 - DNA, 421 bp, Homo sapiens
ttggtggaggtggagtgatagttatcagcccatttaacaaaacctgagacagccaggacagctgtaatgtgcatctctatgctgtgtttttgttaaaatgccacatggctaatactttggaaatcataaatccactgcaagaaaacatctttataggggatattttagttttatgctgtttgtgttacacacctaaaaccatcagtacttcaagctccataaagagcaaggaacatagagcagattaaaatgtttctgtaagtttggtttattttcatctgttttatttgctgcaataaggctatatagaggatgctttgaagacagtgctgtagctgacaatttaatcttcacctaagccactctctccctaagggccttaaggagaagtgggaatcgtgcaagtctgggccaactgcaa

SEQ ID NO: 139531 - DNA, 345 bp, Homo sapiens
gttgactagatagaggatcttgagaaggtgaggtgtaaagtcaggttaggatcaggtggttgaagagcctgaatgccagaccagagtctaaacattctccctataggctgtggtgagtactagcagaagtagtaaagcagtaaagaggcagagggagtaaagagtaaggattactctggaaggatgatctaaggtgaaataattagagggaagaagtcaggaaaaacagttcagaaaatattatgctgggcatgtaaccacccaatgggttcattttgccccctgcctagatagagctcctttaccaagacaggggaattacaatagagaaagagcttaatatac

SEQ ID NO: 139532 - DNA, 398 bp, Homo sapiens
gtctttgccaatttaaacaattacttttcaacatcctccaaatgttttctgtgtcatactgcattaaaagaaaaattacttctaaacactaaaattataccacaggaaaaaaaaaggcttttttaaaaacccatttttataacacttcttttgctacatctagctcaagtcagcaaaatgtggctctagtaaatgccttggagtctgtggtaggcacaacaagggaccttcaaacatacccacgtcctaatccccagaatcagtctgtgaattcgtggtaaaagcgatttcacagatgtgatgacattaaggatctggagatggggagatgatacaggtgggtccaatgtaatcgcaaggaagtttaaaagtctgagaaggaggaagaagtgtcagag

SEQ ID NO: 139533 - DNA, 382 bp, Homo sapiens
agccagccaagctgactccttttaggttcatgtagagcatgggaaagtgaactctttcccctcctcccactcttgcttcagctgggactgagataaatgcctttggtctttgaagcagcctgcaggaggccaggtggcagggagaggggaagtctgttttggcagtggactctttctgtctgccttctgacttctctggagattgccgcttcagagaagcatcggggccaggccagggcgctgtggatactccatattgagcctctcctcttgttcctggtctttcctcttaggaaatggcgtacctccagcatatcagcttcctgatgtctcttccgccttaacgaaaaatctaaaaattgaccactgctcttccttcccc

SEQ ID NO: 139534 - DNA, 329 bp, Homo sapiens
gatgtaagatattaatattaggacaaggtagatgaagggtatacaggaactcttggtactatctttgaaactcttgtgtaaatctacaactatttcgggccaggcacagtgtctcacacctgtaatcccagcactttgggaggcagagacggatggatcacctgaggtcgggagttcgagaccagcctgacccacatggagaaaccccatctctactaaaaatacaaaattagctggttatggtggcgtatgcctgtagtcccaggaggctggggcaggagaattgcttgaacccgggggatggaggctgcagtgagccgagatcacac

SEQ ID NO: 139535 - DNA, 341 bp, Homo sapiens
gatagcttgagcccggaaggtcgaggctgcggtaagttatgattgcgccactacactccagccaggacaacagagcacgactctgtctcaaaaaaaaaaattaaaaaggtctctctggtctcagccacagaagtgagatgaccgtttggaaagtgttgcaataggacacacacattgtgccaccgctgtggcgtgaaggcctaccaccttcagaagttgacctgtggcaaatgtggctaccccgccaagtgcaggaggacgtataactggagtgccaaggctaaaagacaaaatgccaccaggactggccgaacgaggcacctaaaaattgtacaccacag

SEQ ID NO: 139536 - DNA, 272 bp, Homo sapiens
tggtttccagcttcatccctgtccctacaaaggacatgaactcatcatttttttatggctgcatagtattccatggtgtatacgtgccacgttttcttaatccagtctatcattgttggacatttgggtgggtgtttttataactgccaatcttctctggcatatagatacacagacaacagctcaataaatagcttagtgattgattagaagcatcctttagcatataataatgtagggataaagctaatgtttgcacataaaatatgaaa

SEQ ID NO: 139537 - DNA, 473 bp, Homo sapiens
tagaattaaagatgtacagggggaaaaaaaaagcaagaaaatggcctcttttaactgaatattggtttgaatcagctaatatgtcaattgacacacaatatgtagaataaatataattaataagtagcagtgatcattccagttagaattttttttttttttttgagatggagtctcgctctgtctcccaggctggtgtgcagtggtgtgatctgggctcactgcaagctccgcctcccaggttcacaccattctcctgcctcagcctcccaagtagctgggactacaggcacccgccaccacacctggctaatttttttgtatttttaatagagacggggtttcaccgtgttagccaggatggtctcgatctcctgacctcagctgatctgcccacctcagccttccaaagtgctgggattacaggcgtgaaccactgcacccgggcctctccagttggattttcaatgtgt

SEQ ID NO: 139538 - DNA, 462 bp, Homo sapiens
tgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagc

SEQ ID NO: 139539 - DNA, 149 bp, Homo sapiens
gctagtcctccttgccccttggctgttgtgacagccccttaccagtctgccctgggtttggtttaaatcccctaaatccagtcacctctagcatgacctacaaagtgcacacatctagctagtttcctgatttgctccagcctgtcctt

SEQ ID NO: 139540 - DNA, 241 bp, Homo sapiens
tgtctgtcaatgagtaatgagggcccaagaggggctacacaaatacccttccagtccagcagacccaggagagtcagaggagagctggatcacaggtgccaggcaaagccaaggccaggatctgcccgaggaagaaaagaacgtgacccgtgaccctgggacctgggagggcagtgggcagaggcatcttcagtaatccgacaccacttgagaactgttcaacagcccctgggggactgag

SEQ ID NO: 139541 - DNA, 269 bp, Homo sapiens
acactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctca

SEQ ID NO: 139542 - DNA, 301 bp, Homo sapiens
aatactatattatcataaatctcaatttcctcacctcttaaatggagaatagtaatagcaaccttattggttgttgtgacaattaagtaagatgtatagaaggaacttagcaggacacctagcatgtaacagcgttccaaaggatttctttaaatcactgccagaagccagaaaatcattctggctcagtgttactatgcaccaaagacttttcactgatattaataccctctaaaaatcctccttgacccacattgaatggggctcagaggtgaatgaaggtaaagaattggacccctgg

SEQ ID NO: 139543 - DNA, 191 bp, Homo sapiens
aactccttaaaatagcttttaaaaaattcaactgcattcaagtttaatatttagactggcagaaattattctttccatttccaaactgttaagcagagtgagttctgctgggtgtcatacacatggcgtgtttcagtgccagtgtctacagttgtttgtttcagaacctctaattagctgccttatcttct

SEQ ID NO: 139544 - DNA, 409 bp, Homo sapiens
tgaacgtaagggaaatgagcagttactgcagagaggattttataggagtgaaaaattctgcatcagagcagcaagaaggattgttatgtgaatgatcaaactgcttctgctgactcctcagagcccgcctaagagcaggggccttcatctgacactcactccacttccggggaactttgctttcctatttgttttaaccctgattaacagcgcagagctatgggttaggtccggccagccactgagagtccatctttgtgttttcaaaagccaggcctggttactgtcagaaataagagaaacaactggaaaagacaggcaaggtacgcagtattttacgggctctgattgtcatttagatttcgcatccaagaggggttagagacttggggttctgttagctccatgt

SEQ ID NO: 139545 - DNA, 544 bp, Homo sapiens
agcaagactccatctcaacaacaacaacaacaaatacaagcgtatacaaatctgatttttaaaccagcccaaatgcctgcaagcctgcatctgcacgggatgttcacacagctcaggcaggcaggtcctcctcaccaaaccaacttcattagcaggtgagttctaagcacacaatcagcaaagggggaaggaaatattgcacaggaatgcatgtatcatgctgtggtcacctgatgcgttgatctttctctgcactggagaggcaggcactcattcaaattttctgtgcgagtctaactgtcacagagttgaacaatggacaaggacagagttcccatcctcacagagcttacagaacgtctaactccggaagccccttccctgacaggagagcgacagctgacactgctctcctgggtaggaaaccagctaaccacgtgctaagtcagtgccacttctctgtgatccggttaccactcgtttccgctaatacaattgttttccttccaccatgcacacctttcctgaacatccagttctcctg

SEQ ID NO: 139546 - DNA, 346 bp, Homo sapiens
tgctgccctgttccatgtatgcatttatttttgttttttattttcattgtaattatgtgtaccagactgggctacaggcagtgtgacactgacaaattggaaagcatatcgaacatagagagaaagagaatggaaattctaagatgggttagccagcctctcttgagttgatatattcatgacattattttctttgagctttgcactatcttttcaggaatcttcctattagaaaataacttaacaaacctgagtttattttgaacttggcagtggttctgattagagatgttgcaaaataaccattcagcccaacatggccctaaagactcagagtttccaagat

SEQ ID NO: 139547 - DNA, 404 bp, Homo sapiens
atggcagagtccctcaggatgagcttgctctcttttccttgaattgattctacgggctggaagactgactaacctcttcattagctcattgatcagtctcagcctctgactgcagagacagaatgtgattcctcacccagcattcctccaggctcattctccatggaaatcatctcttaaacagggtggaagatctcctcgaccatgtttgggatccattcctgttcctgttctaggacatttagagaagacatagtaatgagaaaatttagtcaagtgctaaaactgttgcgggaaatatggagaattttttctttatattctgagagacactattgcataaagggttaaaagtgcaagtctggagcaagactctctgagttcaggttccatttaaagcactt

SEQ ID NO: 139548 - DNA, 261 bp, Homo sapiens
ccactgtctgctcagtgtcaatgtattgattacctgtccaacagaatctattttatctctgaggttagggaattagtagaaattgatatcctactaatggaatagaacagagagtccagaaggagaaccaggcacattaagacatggtatgaggtcgatgtggccaatggtcagatttgtggggaaacaagggactcataataaatagaggtagggatcaaaagtaaaaaggtcatccacaggtggaaggagatgaaatca

SEQ ID NO: 139549 - DNA, 815 bp, Homo sapiens
tctaaattgctatggtaaagcctataatatggtagcaatatggggcgttttatgctaaaatacacgcaaacattagagacgagcctaactgcttttcttactttcctgaatatggtaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaatggagacccaaccagcagacagcttcttttctgctggagaagactgtgttgtaatcatttgggcatgagaatgggcagtggaatgatgttcccttggcattaccattctcacactatacgtggcagaaacgggacacggtgcttgtggacaagcccctgtggttaaatgcccagaacttggaagattgaaaccggttttgagattaatcccgataa

SEQ ID NO: 139550 - DNA, 320 bp, Homo sapiens
ctacaggtcaaatctgaattttctacttcctcttaaacatgggagagtcccacaaagactttaaatctaacatggaaatgtatctttgccccttttaactttgctctttttcttttgctaagtttctcatcccagctttctcttccgcctgtctccctttaccatctgtactgcccttgctggggaaggcgggcacgccccttcccaggatggagcatgtcttctcttcctgtcaggtgtgtgagaccaggacagacagcagagaatcttttcattcagagcctcaccctctgtcccgggcaacagcaggtcgagaactc

SEQ ID NO: 139551 - DNA, 794 bp, Homo sapiens
ggggagtgagactgtctgctggtatattttaaatgcctcttcaggcttgataatttaaaggtactggcattctgcagattaaaacttttctttttctttctcacagcttattgaggttttgagttactgttcttccataaaccacaccaaacattttccacagtttgcacattgaaattcttttcagtgcagcaagaacttagaggtacttgcaaaacaatttgagtttagaatctttctagacttttatacctttttccctcaaacacttaatttaagagcagatttttaggctatttccttttcattaaaatctaagaccccatgaaatggaggatgcattcttatttttctagatgtcatcatgtgagaaaatacaaatcttggaccgaaggaatatggtagctttgatagaaacaactcttttcctttgcatagtcattcttcactttacaaagtattaaattatgtaacttttattttttttcctcccgagacagagtcttgctctgttgcccaggctggagtgcagtggcgtgatctcggatcactgcaacctccgcctcccgggtttaagctattctcctgcctcagcctccggagtagctgggattacaggtgcgcaccaccatgcccaactaattttttgtatttttagtagagatggggtttcaccatgttggccaggctggtctcgaactcctgacctcgtgatctgcctgcctccgcctcccaaagtgctgggattacaggtgtgagccaccatgcccagccctaaattacgtaactattaa

SEQ ID NO: 139552 - DNA, 284 bp, Homo sapiens
tcaccacagggtcctcacgtgcatgagtaagtcatcctccttcctgaaagggaggttttattcaccttatcaccatagaggatgtttcagatgtggcaattcctttaagtcactgcaattttgactcaccctaggatttctgggtttaattgctcccctttcttgttggttttatgaccagtgttgcaggaaagacaatacttgaaagtctgtggaagccccttctttttatatttttctttgcagtgacgatgattgcttaacaataataaacatagaggttt

SEQ ID NO: 139553 - DNA, 405 bp, Homo sapiens
atttcataatttcagattaaaaaaaaccaacggcaatatcagccagttgcattagtcagctttattattttctcattttataatctacaataaggattataatatataaaccttcaaaaaatgttaaaacaaaggctgcattaatgtaaggaatctttgaaaggaagtcatttgtagatatgtggtctgagttactactagtcggaacttacttaaatttgttttgtattaattttctttctaaggcaagcaatatatttacaccaaacaatgtatttataatgtatttggaggaataaaacataatgtctttgtccaacttctcctgcttcttctctgtcttaaaacagcagctgctttcaacaaaagaagcttctttatagataactcattttccttttcaag

SEQ ID NO: 139554 - DNA, 164 bp, Homo sapiens
acagagaagggtgtgtgtgtgctgtgtgatgcagagggacctgagctggggtcacagcagtgacagagaaaaccccaggccccgtctttggggggcccccggtatggtggtggagacagacacattctcatctagtgacagctcaggatggtgatggggataca

SEQ ID NO: 139555 - DNA, 171 bp, Homo sapiens
catgcagtgtcctggaatgccagggccactgtctatggtcagtccttcaccacctaaaagcaagctgatccacaaggcacctggctgcatccaggcctgtcatctacggccaccatcctcagcttcagagcttatgatctggctcagggaacacagacaagtactgccatc

SEQ ID NO: 139556 - DNA, 217 bp, Homo sapiens
gctgacactgatgagcatggagaacctggggccaaggcagccacggggctctgagctgaccagctcccttggccttcgcttcctctttgtgtcatccttccctgttcaacctgctgatgcttgactttttccagtttgtcttttctgttttgtctcctcgttctgggatcacttctcactcaccagccacgaaactccccaaaatgacctccaggtc

SEQ ID NO: 139557 - DNA, 204 bp, Homo sapiens
aaaattttaaaatttttaaatgagtataaacctgtcttcttagcttaaaaattgacaaaattacaaaagatattaataaacccaccaatatagtatgggaaattttaactcagctctcgtataaactgataaatcagtcagacaaacattagtaagactatccaggattttaacaaataagagataccagtcaaaggacacaaa

SEQ ID NO: 139558 - DNA, 395 bp, Homo sapiens
gtctgttggcatcttttgtattttttgttgacttccccaaaaccaaccaaatcgaagaaaatcaagtgcataaaaaatgaagcagagctatcattgaaactgacattacacaattttttgtttttttttttgagatggaattttgctgttgttgcccaggctgcaatggcgcgatctcagctcaccgcaacctctgcctcccgggttcaagcaatctcctgcctcagcctcctaagtagctgggattacaggcatgcaccatcacgcccatcttattttgtatttttagtagagacagggtttctccatgttggtcaggctggtcttgaactcctgacctcaaatgatccgcccgcctcagcctcccaaagtgctgggattacaggcgtgagcca

SEQ ID NO: 139559 - DNA, 620 bp, Homo sapiens
caagaattctaggcttcatataatatattgctttagtattaacaataaaataataaaataatctttggcagattggtaggttactctgtatggcttatgaaataagcttgaagttttttgaaagtttatttgaaaaattaatgtatatgtctaacacctagctagtagatagtgtatgatctgaccatcttgaagagttaaaaacctgttgctaagatacatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccatattgggtttttgtacagggaagtaatttaatggaaatagtgtaagaaaattagtttttcatcaatatacgggaagaattaaagtggaaaaacgctgaaaa

SEQ ID NO: 139560 - DNA, 282 bp, Homo sapiens
catgctatgaaataatcaatttttttcaggtagttgcaaattacatttttaaaatgtgcaataatgtatttatttaagtccccattgactgagtatgtatgtagtttccaatcttctgctgcagcaaatatccttctacataaaccagcctacacgcataagagactctgtagcattaatatccagaaacagaactgttggggtcaagggaatgtgtatttgtaagtttgctaaacattgccaattggcctccataaagcctgctgtaatttatactcctac

SEQ ID NO: 139561 - DNA, 302 bp, Homo sapiens
atttctttcagtgttttgaagatgtcatttcatagtatttggtcatttctgttgtgaagtcagctgttagtcttatttttgctcctttgaaggttatgtgttcttttccagattttaggatacttttctttgtctttgatttttagcaattgtactataatgagcctaggtgtagttttctttaatttatcctgaggtttggggttcagtgagctgcttgaatctatctatgttttggtatctttcatcactttgaaaatttctcagcaactatttcttcaaatattacttttgccccacta

SEQ ID NO: 139562 - DNA, 256 bp, Homo sapiens
ctcttacctggacataggtgtgtaaaccaaaaatgaaactctaagctccctaaccaactgaatgaactcctcctctcagccaaggacacaccaaaatcaacctgaaatacaatacagtccatgatcggaacggatgattggacatgccttaacttaccctcttccctttaaaattcaggcagaactgaccagcttttaatatgaagacagagaccttgagactgacaaagaaaactctttatagcaataagatacc

SEQ ID NO: 139563 - DNA, 351 bp, Homo sapiens
agcttgtgtgtccattctctaagttggtcttcacaaccaccctggcaagggcacagagttggtaagtgcagaaaatttgataaatccagagcccaaatctaacccaggatttccctatgccaggctgctttcctgcaatcgcctggggcatacagaaaaatacctatattgaggtaaaaggtttgatttaaaaattaaatataaacattttcttttaaagcccaatttgcatatttttgcattgtgcagatttggatctgtgcttcatcctctcccacctgcaacaacatttaaatgcctcagcctgggcactaaaaaagggagcaaatgcaggtctactagctggccatg

SEQ ID NO: 139564 - DNA, 760 bp, Homo sapiens
gcagcagttctcaaactttttgatcttagaatttctttatacttttaaaatgtattgagaacttcaaagggtttttgtttataatagctatcaatatttactattttagaaaacaattttcaacaaaggttattcattttaaaataaactcattatatgttaacatagatagcatttctgtaaaggatattttccaaaatgaaaaattattgagaatggcattgttttacattgttacaaatctctttaatgtctggctgaataaaagacagctagattttcgtaacttctaccttcattctcttacaatatcaatcatcatgtaacttttagaaaattgtgccatattgtgtgagaatgtgagtgaaaaagggatatgtcctaatattatgtaaattgttttgaaacagtgtcagggacacccaggagttcctgcaccacacttttgagaattacactgaattacggtgattgtcatgccagtaaaagaaatatgagtttgatttgtaaatcaataaacctatatgcacattaaaaatgcagatgcccaggcatcccctagagatcccaattcaataagtctgtggggtcaagaaatctgcatctttaacaagcaccacaaattaatttgatataaatggtctgaaaattacagagtgagaaaaccagtcaaatgattctctagagtgttctgcctactaaaactcaagataggtgtctttcttatcttcacctctctccatcaatagtttccagagcc

SEQ ID NO: 139565 - DNA, 367 bp, Homo sapiens
aggctggagtgcagtggcatgatttcagctcactgcaacctccatctcctgggttcaagtgattctcctgcttcagcctgctgaatagctggaattacaggtgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatggaccttacagctttaatgagagtgaggagggggagttaaaaaaaaaaaaacaaaaacagcatgagacgatta

SEQ ID NO: 139566 - DNA, 436 bp, Homo sapiens
accagttaagtttgttataatggcagccttctgaagatctagatggatggagtttctggaaaacctcatagaagatgctatttcagtgtcacgaacttgatgataatagcatcaatgacttaaaaaaattattctttcatgtgtgcttgaggaattgtaaatatgtttagtgcattcagaccataagccaacccatacataaatagcagtattcaagccaatagctttgtggttattacacagggttgccagtccttgacaatccattcaacaaaatagtgtcattatgttcctttccaagaaagagaaaatgatatggattttgtagcataaatccatagcgaaaggcagctgggaaataaatgtttttaaactgatggtccattcacatcatttcccctctatttctagtatcccctgtcctttgaccttgcca

SEQ ID NO: 139567 - DNA, 263 bp, Homo sapiens
gtgattggttcacaccatgagttaacagtggggcaaggcctcatacccagtctcctgatagctggtccaggattcctgtgagcctgaatggggggtcaggagctcatcagatgcccagtggaagagcggggtgcgtactcacgtgggaggggagccggtttctctggttccattgtagctcttagctggattttcaactccatggctggttacttgagtctatgtttaatcacctgctagactgagaagcccctaaaggacag

SEQ ID NO: 139568 - DNA, 274 bp, Homo sapiens
gactcttggatgctgcagcaggtcacagagcgagtttgcaggggcctggctggagccgcagaggagactgtccagtcgagagcaaacagaaggctccggttgtgtcctggtgaatgacccccaggcccaacatgcaaggttgcccacaattctgtgtgcacttttcacgtggacttgccgtggactatctgggctgtacagtgtttgctatgaaacatctcagccccatgctgaggcaagtgggcgtgcctggattttaatcatgctcttgaca

SEQ ID NO: 139569 - DNA, 346 bp, Homo sapiens
ccctgaggacacactcgggcagcgacttgaaaacaatacaagaaaaaacggccaaaagttctttcggtacaaaaggcacccacgccctcaggcacaattagcaactgcgtctgcaaacatcccattccctcctactttgcagatcggaaaagcaacccgtacccccaagtcatttactaacagtggtggtaaggtgtcctgatgctgcttcctctcctctaacctacattttcttcttcacaatcatcaactttgtgagcacggaagggctttgtacgaattgcgcaaggaaaagatggcaaattactcaaaagtacagaaaacggagtcctggagcgtccgtggt

SEQ ID NO: 139570 - DNA, 745 bp, Homo sapiens
aggtaagtgactttcccagagtcacacagccaggagatgccaagccgagatttgaactcacatctatctgagtcaaaattctctgctttcctttttgatcgtttaagcctcttctcttccaccataccattctccaggggtattgaattaggtgacagctaagcactcttactatgtgcactttgcatgtattacttaaatcctcgcaacaacctgatgaggttgctaataacctcctccattttaccgaggcacagagagtttaacttgcgtgaggtcacacagctaacaatggaaaagctgggagtcagagaacctgggcagtgtggctctagactccccacttaaaggatcaaagaaacactgtaaaaagtagaaatcactttaggaatataaatcagaattattgttgattctcacagaatccctgcaaagtcctctcccctccccactgcttctggcattccaagacagtaccctagtttcagatatgtctacacagggacactggcctcctcagtccagctccttgaggctactgcttcttgccataaatttctaggactgttcattgccttctgaggtcctttgagctgatgctgatctgaaagcatttttttggatatggtcccatacccaggtgatggggataggataccgatttgcctgcaggataagaattagaggtcatacagactgctgagacagttacaacctagaggtcaagggcctgacatgggagaca

SEQ ID NO: 139571 - DNA, 410 bp, Homo sapiens
agcaaaaaattttatattgtgctgttttaagatactttcatcaaacacagaaacaaagcaaaggcattatcttttggaaactttattctgcccatcaacatgtaaacatgtaaaacttttatcttagaatttgaaatatttcaaaattatatacattttatcagaaactgttaacaactacaaactttctacttcagactttggtggaatttgtctccacttgtaatccgatttgcatctttaatgatggtctcaccatgaccccagttggaatctcttgaacatcagatttttctggaaataggatattttatccttagaaatagtttatgacctctcatctccagtgatctttcctaaagctgtacttctcagtaaagtcttttttctacgttaaagtacagaggggt

SEQ ID NO: 139572 - DNA, 271 bp, Homo sapiens
ccaggatcttgctatcatactttgcctgcaatacctagagatttggatgaattctccttttgttaagattctccaaatatcctgatgttcctggtcctgtcaggaagtgacaattcttactcacctgtaaggaaaggaacccttttaaaccaggacaatttttcatgtctgagtgtgtttctgttcctaaaaaccatgaagaaaataaaacagtgatattacattcaacatggtaactctaaatccttgttctaccagtagaaatataata

SEQ ID NO: 139573 - DNA, 574 bp, Homo sapiens
cttcgatgtataaaaaaaaggggaatggttataattcctctccattacataagttatgtacattaattataggaaatcctaaaaccacaaaaaagcacaaggaagaaatttaagatcactgataatcctaccaccacttgaacattgttataaatttttttaattttatacacaacacacacccctatatacgtacacatttatttgtaaaattgggataatacttttttacaacccttctttatgtaagaatatatcacggccttttccctcatcattaaatattctgccacattttaaaaattactgcataacattccattatctaaatacatcataatttaaccaggccactctcgttggatttttagattattttcggtttgttactattataattagcatatagggagataattttttgcaatttgtgatggtttccttagattaaaatttaaattcctggaagtgcagtttctgggtgagacaatcaatataagtatattttaaggctcttgatttgtaatgccaacttgccctcaagaaagttaaacaaacttaaattttatggaaa

SEQ ID NO: 139574 - DNA, 414 bp, Homo sapiens
aggcagatattgaaactaagagctgctatagtcactttccatctaaatggtatattggaatgacccataggttaccatatgggtcaacatgtataagtgggtttctgtgtatcagcataggagatgggggctggccaaacggctggatggaacaatcatattccccactcccacatatcctagcagaatggaaagggtgtcttggactggacagagtgggaaacccccatcattttgagggacagtgctggtgtgagtaatgcaaacatttccctaagctttctctacttcagacatccaaatgaatttcaggaactctgcatgaagacattgccaccctgctggcatatgcctcagcaatggtctctttcccagaattgcggtcggggcagatgtgggtagccatagtgacct

SEQ ID NO: 139575 - DNA, 274 bp, Homo sapiens
cgagaattttccagtaaagccacctggcgctggagtccctctgttggaggcagtagggtgtgagtgggggtgaggtggcatttttaggatggccccaggcctatatcactcctggactctgtgtctcccggccaggtgggtgggccctggaatgaaatgggcccagagtgcagaattgagcatcctggttccacccgcagtgaaagcttctagtccacagaacctcctttcttcccgaagcacatacacctcacgcccccaacgagtctgtctc

SEQ ID NO: 139576 - DNA, 197 bp, Homo sapiens
cgtatccttcccaggccagatcttctcatctcactcagtctttcccacagcaggccctcatctacagggcagacctgactggctagccaatgtctcctgacgtggggagcttggcctggactgactgggtggcttgggaggtaagtcaagagagcaaacagggcatgggcgtctggggttcacatggccactcaata

SEQ ID NO: 139577 - DNA, 579 bp, Homo sapiens
gacaaagtcatttacacagctatatttatcccctgaggtgttactaataaaggagcatttgcccactaaagggaaccaggaccaaatgacaatgtataacctaaatgaatgactttccaatgataacttttttttgagacagggtctcgctctgtcgccctgagtgcagtggtgcaatgctagctcactccagcctcaaactcctgggcttaagcgatcctcctgcctcagcctcctgactgggtaggactgtgatgaaattttaaatactaaaaagagatataactatcacttcccacgagcgtttctctgttcccatttagggccagccctctgttgcagtgctcctttgctgggagcacagaatgaggatgactgaaattcacagttaacctgcaaacgttggtattgcaatagcctaacaagcttggacccagaagataggtcagctccctcatttcacagcctaagaaatggaaactgtaggatttacaaaccatagtttcagctgggtattttactggatgctgctaattttttaaaatgaatgttcagttatttttttccattctcctctct

SEQ ID NO: 139578 - DNA, 305 bp, Homo sapiens
ctccgcgctcttgtgatccctgcggttctacctgagtcacgtctcctctctgctgtatgacctgaacgtggggtcacatgccaggcagacagtcgtcacaattcctgttgctttgatttctaggtacctcttaaattgatcctcttcctccattcccacaattattaccttggtttatgccatcctatcctacctgaattaaaacaactttctaacctgactgcctgcctctagcctcagagtcctgtattagtccattctcaagctctatgtagaactacccataagactgggtaatttataaa

SEQ ID NO: 139579 - DNA, 186 bp, Homo sapiens
ggcaaaaccccatcgcttaaaagatagaggagaatgagttttaatgcagtagggaggatgacaacatctaaaggttaattgtgcttcttagtcctggaagagccaggtcaggacacaatggatgggggctcggtgcagggagtagagaaacagatatgtcagggaaaaatgagagtaaaagaggca

SEQ ID NO: 139580 - DNA, 364 bp, Homo sapiens
gtcacactcttactcttttacttggaggaagtaggttattctgaccttcagttttttcatgtataaaattgggatataaataccctctgtatagatttataattaggatttagtgagatattgtatatgtgtgttaagtctgtgaagcacatactaggtatgtaatacatgaaagtgtggtaatgttattctaattatgccactcattggacaccagtaattgaaaatgtgattttctggtgctgtggtcatatacaattggagtggttactattgagatatcagaattcagaaagagggaattagtacacagtaggaaacaattttgaagtcaatcacattctgtactcagcttatcatttta

SEQ ID NO: 139581 - DNA, 383 bp, Homo sapiens
caccccgaacgactagtgcagggaggcgagcttctccagacacattctgtgcggtggctgcggggcagggagcacaggcccaagacttggagaccagctgagggctcctcactggctcccaccctctgccctctcaccagggagctgacatcctctgtctggctggatgtttaattgcttagcgcctcagttttcacttctgtgaaatggcactaataccaatacctaaaggcaccaaaggagagtcctgagtatgtagtaattgccatcatgacccaggaatttgctaagcgcttacaaacatctggttaggtactggtaaaacctcgtgaagaactgagcccagggcactgtcctggtaaaagcatttgctaaatgttggc

SEQ ID NO: 139582 - DNA, 180 bp, Homo sapiens
gcttattggttcactgcttattgtctgttacccactctagaatgtgtgcttcatggaggccagaatctatttggttcactgatgtattctaaaagcccaaaacagtgcctgagacataatgggtgctcagtaaagacttaaaacctagcttcactatccactgcgtggtcaccaaagaac

SEQ ID NO: 139583 - DNA, 891 bp, Homo sapiens
aatgtatacaatgttgtatacaagttaggaagcataataaatgaagccctaaacttaccactagtcttaaagttgagtatcattggatccacctgcgtgtttttccatcatatcccctgcctcataccttagaggtgtcctttctcctgagttgtctctcatttcctttataagaaatctttacatatatatatatatatatgactgttttgctttgttttgagtttcataaaaatagtatcatgggggccggtcacggtggctcacgcctgtaattccagcactttgggaggctgagacgggcagatcacaaggtcaggagatcgagaccatcctggctaacacagggaaaccctgtctctactaaaaatacaaaaaaattagctgggcatggtggcaggcacctgtagccccagctgctggggaggctgaggcaggagaatgacgtgaacccgggaggcggagcttgcagtgagccgagatcgcgccactgcactccagcctgggcgacagagggagactctgtctcaaaaaaaaaaaaaaaaaaatagtatcatgctgataattgtgcttgctttatttagcattgtttctctcacccatccttgatggtcatggctgtagttagtccatataccacaaaatatttatgttttcctgttgtgaacattttctgctgtcaacatgtttctggtttttgtaactgggaactttcttgcacatctctagtacacacgtagaaggatttctctagagtatgtaaccaggagtaattcccgtgggtcataggtactgcaaatattggacacaaggaatacaaactgttttttaaagtctttgtaccaatttgtaccccatcagcagtgtataaaagttcccattgattcactt

SEQ ID NO: 139584 - DNA, 117 bp, Homo sapiens
cccttccttggcctgtaatcttgcctctgagtcccccaaactcttcctcattaatcacaagccctgggcaatcaatcaggaagagcatctgctcctcctccatctccgatgtcctca

SEQ ID NO: 139585 - DNA, 297 bp, Homo sapiens
ttctcctgcctcagcctccaagtagctgggattacaggcgtgtaccaccaggcctggctaatttttgtatttttggtagagatggggttttgccatgttggccaggctggtcttgaactcttgacctcaggtgatctgcctgcctcagcttcccaaagtgctgggattataggtgtgagcctctgcgccaggcctcttcacctttctgagcctgttttgctcctcctggccacaggcataaagcttagcacatggcgtgtctttgtgcctctcgagctgcaggcgcggcgccctcaa

SEQ ID NO: 139586 - DNA, 449 bp, Homo sapiens
acccacagtgacaaaggtgggcgattagagtggtgccttggggcaggtgaaaggaggactagagaaggtcgagagattctgcttccagaggctggctcctaaggcctgacacacccaacattataacaaaagactgtaacaagggctatgggagttgtgagccaggaaccttagacaaaaaccagtatgtatcataagaccacagttgccaacagctgaaaactcggatatttgaaaataaaaattctggacttctagatcatttagatactctgtcaacacgaagcctgaatttttacgtgctagctatgggctggggttgagtagtagctatctcctttacacaggtaggctctgcagcccctcaggtcctgttaccacccaaaaaacccagggttcattcacctggatagtaacagatatctgactctccacaaggacacgaggtt

SEQ ID NO: 139587 - DNA, 324 bp, Homo sapiens
ttaattgggttctctcacattcattctgtgttctgaattgataatccaaaacgttcttttttataatagggtaaatgaaaataaactcaacgaaccagagttctttaataattttattcattaaagattttggatagatttttgttttgaatggaatattcatgtgtcacactgaggatcaggtattgggcagttcccttgacagggtttcctttagcctaataataataattcacaagagaggtaaaaaaaattctaggccgggcacggtggcttacacctgtaatcccagcactttgggaggccgagggaggcggatcacga

SEQ ID NO: 139588 - DNA, 202 bp, Homo sapiens
cctcctccaagctgaccaattccatactggccggtgacaaagcaccccacgtatttatgctgctgcctcgctctcataaattatatcagtttcccagacgaaggccccttggctgtgaaggaggatgccattttatttatgctgcacttacacacctgcatactgaactctatatttaaatcagacaacaaatcaatggtac

SEQ ID NO: 139589 - DNA, 557 bp, Homo sapiens
ctttcccaacagagccaggctcctgccaccaccaccaggtcgccaccagggagttccccaaggactgctgtgggcagtggtggcctcggcctcaggtggggcagggcagctccagcatgcccggtcacctttgagtctaatctgctcacgggaaaaacacggatcagagaatcgcctcagagagctgctgaggacactgcaggggcaggagcaataccgggcccttcaaggccagggtcacaagcccagtggtctacccaagactgattgcctgggttcaaatcccagctctgcaatcagctcgcgaccctgggcaagtccctgaaccactcgatgtcctcatctgtaaagcagcaatgggccgggcatgcggtggctcatgcctttcatcccaacactttgagaggccaatgtgggtggatcagctgaggtcaggagttcaagaccagcctggccaacatggtgaaacctcatctctactactaataaaaaaaaattagccgggcatagtggcgggtgcctgtaatcccagctacttgggaggctgaggcaggaga

SEQ ID NO: 139590 - DNA, 158 bp, Homo sapiens
tatttccacaggggatcgttttttcactttgggctaattgaagggatgacgacagaaagaaaattcggaagttactataaagactatgtattttatcctgagtgagttgggaagccctgaagagttttgagcatagtaggctttcttctgactgagta

SEQ ID NO: 139591 - DNA, 487 bp, Homo sapiens
cacacattctctctcacacaaacacacatgcacacacagtctctcacacacacacatacacaaactgtcactcacacacacacacatacacacatacacacacacatactctgtctctctctgtctctctctctctccttggaagtcccctacatttattcacatgttcattttgcaacatttactgtgcgcttgctgtgactcaggctctactctgaccctggaggtgcgatgctgagcaagccagtgcagccctacccttgcagagctgacatcctggtggagacacccctttttgtctgtacctatcctaaaccatctctggcagagcagcaaaacacatcccttttctaagtcttagtttccttactgtctgatgggggcaaaatctaacctatcaggctggaagccccagggccaaatatgagatctgagaaattattttggaaaggagaggccccatagtgtctctagcctgtcccttttc

SEQ ID NO: 139592 - DNA, 355 bp, Homo sapiens
  misc_feature (199)..(199): n is a, c, g, or t
  misc_feature (240)..(240): n is a, c, g, or t
acagaggcaggttgttagctgggcccctgggaggaagtcaacaagctccaccacatctgacaacacctactgcttgcagcccttcccccaggtcaggcagctgcacacctcatgcttccaactgagggggaatgaatgggtaccaagagtaggtgagtctacttctttcccaggggtgagtagcgggtgaagaaatcangcatgtagtggacatttacatgtgccggatacctcatatantgcagtgtggtatcattatcctcactgtgcagatgaagacactgaggctcagggacttgttcaagacacacatctggtcaatagggagccaggattcaaaatcacgtcagtctgg

SEQ ID NO: 139593 - DNA, 160 bp, Homo sapiens
accctggggatgaacatggcttaccagcacaatccttaagacaaagcacaatcaaagcaatggctaccacgaggtggaagtggtccatgccacagcaacagtggaccagtcaggagtcaggagcaaaggtcatggcaacagttagtggggaatgctcaag

SEQ ID NO: 139594 - DNA, 411 bp, Homo sapiens
ttgtaaggacagatccccaggctctatcctcagagattttaattcaccaggtcctgcatgagttcgaggaatttaggtagtccataatatttctaatgaccagccttaaactagacaaccactgaagaacctggctatgagctgagaaactcagggttttttatggctggtcattaacgacaagcggggctgtaccactgtgctggtcacttgaagttctctgagtcacctgaaaatgagggagtaattggagccaaaagaggtattcataggcagccaatctaaaattctagaatcctccaaatttaatttaatatcacatactatactgggtttactcaaaacagtgtcattctggctggcggcagtggctcacgcctataatcccaacactttcgaaggccaacgcaa

SEQ ID NO: 139595 - DNA, 344 bp, Homo sapiens
aagttcctaagcgaacactctggatggaatagataccaccctttccatgaaagttcccctctgcacttggcagaaaatccctgatctagcccaagtctctaatgttataagtgaagaaactgaagtctcagagtggaaaaggaagtcatcagggatgactcaagtcagagctcctggttcctgaaccctggggctctttcctcccctctaagagctgatctgtctgtagctggtcatgtttccatttcagagggtggagggaacatccaggatgtctcaaaaggtctgctttcctcattgtctcagcttcccctctgaagctcactcccccccaccgctttctt

SEQ ID NO: 139596 - DNA, 320 bp, Homo sapiens
tgtatcagctcccaagtagctgggactacaggtgtctgccaccttgcctggctaatttttgtatttttagtagagatggagtttcaccgtattggccaggctggtctcgtcctggcagactcgtgtgtgtgggctttgtgctttggaagagaagctgtgatctgtgggttccccagtcccttctttcttcccaaaggtgaccggtttccctccgagtcttccaaagatgtgggcagcagggtctcaaatccaccaccctatcccctcatcctaactcctcctagggctggcagcaaatctcttggttttcagagccttcc

SEQ ID NO: 139597 - DNA, 261 bp, Homo sapiens
gtgtcacagctgccttgcagctctgaggatcagaaaggttaatggacataaaagaaacttcaaagctcaacctcctaatgggaagctgcccttggttttaggctgtctttgcttactgaccgacttaattcatgctttgggttatgactgtaggagagattttcctgtgtctttggagtatgctgaacttgtgtttctttttgttgttgcatattagacagtcagtgttgaaactaaagtgacctaaagtgacagagctca

SEQ ID NO: 139598 - DNA, 549 bp, Homo sapiens
gacccaggtggcaagagtttgcaggacggaatgccagaggggaagagcagcacagacagactttggagacttgtagaaggtctccttccagcattcggctgaagtaccaacctgcacattggtacaacgacctgaagctgagaaagaaccaccagaaaggattagaggtacccaggaatggtacctattcccccttagccagaacagaaaatctcatgactcacaagccctgtggtaggagtaccaaatgggtcttgccttatttgtggggattaactggccctaaaatgagaactgcttgggtcttacctaacacatttaaaaagtgagacctgaaaaaaacaaactatttccaaataactgcatcctagaacaaagctcacaatgtctggcatccaaagaaagttcccaggattgcaaagaagcaggaagatatactcataataaagagaaaaatcattcaatcaaaaccaatccagaactgactcaaatgttagaacctgcaaagacattaaacactatgtttcatacgttcagaaagtagagaca

SEQ ID NO: 139599 - DNA, 315 bp, Homo sapiens
agggctcgtgggtaccagcgtttgttaagaagattacatgggttgtctgaggattttctggcaggagttttcttgttttgtgtgtttgaattaaactcttgaacgtgtctagaatgcttttaacatgaaataatatgcttggggtgggggagggcaattttgtttccttccagtgtgccagcactaattagtcaataatccgtcctttgaccaatgaattgaatgacagctctgtggtctgttagggtctcatgtaaactgggttccgtctggggatcctccatcccactcgctggcctgcttgtctcttcacgt

SEQ ID NO: 139600 - DNA, 399 bp, Homo sapiens
atggagtgattccccatttggtgtcctgaggctccagggatactgccaagaggccaggaggtgcagtggttgaactcagactttaggtgcaggctagcatctgaagcctagatccactatttgcaagctgtgagaccctgacacacacaagtccctttaccttgctgaacttcaactgctctgatggaaaataagactaatattaaatacacatagattgttgtgacaattaaaagagataccacatgtagagagcacttaggagaggatctgacatacactaaatgctcaatagatgtaaattatatcattattgttgttgttgtcattagtattatcaaatggtgcaactgtattttttaagtatttcacaattctcccattaaaaacggtatgccc

SEQ ID NO: 139601 - DNA, 278 bp, Homo sapiens
tctagggcataattatttctctttattcttagaatgaggtggttcaaaacctccaactgttaaccttttaatagctttcagtcacctggaaaggtgattgcttcagagatgttcttttctctgttttcaaatataagaagttacctagttagtgttgccagaaataaacttctccctttcatgcagctagggaggagatgttaaaacatgggattcatttttccccagagaaataatttataaaggtgggtaggtttggttgaagcagtgtgttaata

SEQ ID NO: 139602 - DNA, 345 bp, Homo sapiens
aagcattaatggccagtgtgtgcttaatttaacaacactacaaattcatgtagagatgtctgatcctctagagaggaaactgtcattccttagctgcagtcccctcttcaactgaagaattacatttcaccactaggtgtccacaggggaacaaaggatatcttacacttgcccattccaagtccctttcacacacactgcactccataaacaacttgtcctaggtcaatttataaaaaccttaaatcttattttatgttgtactactacagcttaggtcttcatttactttaacttataagatatcctggccggacgcagtggctcacacctgtaatcccagca

SEQ ID NO: 139603 - DNA, 239 bp, Homo sapiens
ctgccttgatttgttgtcatgatttcaattccaaactctcaggagaagaaatctgactggcctggcttgagtcagtttgtatcctgggttcatggtaagcacatatgccagagtccatatgtttctggagatatggaatgcaatgtggaggtatggtctttgagaaagagggttcttgcaagctgattcattcaccccaaaaatgcaagtattatgatatataatggtgaagactttta

SEQ ID NO: 139604 - DNA, 102 bp, Homo sapiens
ggtgatgagatcaagaaaagtccgaggccgtaaatgagattgcagataaaaatcatgttatttaggccaggcatggtagcagttacacctgtaatcccagtg

SEQ ID NO: 139605 - DNA, 485 bp, Homo sapiens
tctgccctcctgaacatctactccccacctaacacataagtacacaggtgcagacagacgccacccccatagaagtcaagggggagtgtgtggggctgctccttcgaagctccctgtgtgtgagaatccctctctcgtctcttgggctctgcctcctgtaatgttaggcttttctatacctaaagcctcacattccatcaatttcttccctctctcacccagtcatccaaggcaaagcttcatttactatcttaagtatttggagttttttctgatcaaggaatgtctcaggtgtcactggtgctcagccttctgctaacagtagtgaaccccattctgcatactgggaaaataaccccacaaattcagaaacaccaaagaggcattttgagcataatttgatgacctagttttattttaaaatagaaataagccatagactttgcatattagaaccaatgccttctttttatttcagtaaattc

SEQ ID NO: 139606 - DNA, 468 bp, Homo sapiens
tccagtccttttcacctccaaaatatatcccaaatcccagcctccagatggataagctcactccccagcctctcggttctggtcctcttcaccgccaccctcttctctccatcctcactgccaccgccctaagataaaccaccagcagcatctcctacctgcctaccttgacagcttctgcttaaaaccctttactgccttcccaagactgagacaaaaagacagattctttgccacagcctttaaagcctgtctaacctctgcaggtaaataggacgcttagggctggggagggacagggctgacagatgggttggtacagatggaggaggagcctgcctgagccaatatctaaactgcagaggttgggttttgttttatttcattacttttcaactggtattatatgcctaaggtataaatcaaaagatatggctgggtgcagtggctcacacctgtaatctcagc

SEQ ID NO: 139607 - DNA, 467 bp, Homo sapiens
tgatcgtctgcctcggcctcccaaagtgctgggattacaggtgtgagctgccacacccagccttgcttggttctctgtgagctttttccctgagtcctctgtctcctgatgggcagccgtagaaatctcttgctgtacctgtttgagcggagctggagaatggcttcctcagaaagccccccattcttctaacgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagttgactctatgtgggtccctagaaatgacttggaaaggtcttctggagttacttgag

SEQ ID NO: 139608 - DNA, 274 bp, Homo sapiens
ttcaggtgatgggtggtgttcaggtgattggtgttcaggtgatgggtggtgttcaggtgatggctgctgtaacaaaaatcctctagactgtgtggctcaaacaacagaagtgtttctcagccctctggaggctggaaagtcctttatggtctgcagacagcagcctttgtgccatgtgctcgcattggggggcgaggggtactggcgtctattctcgcaaagacactaatcaccagagcccaccctcatgacctcctccaaccctaatcacctc

SEQ ID NO: 139609 - DNA, 711 bp, Homo sapiens
acacctaccaacgaaaaagttaaatggagagagggaggcacccacccacataatctttccattcaaagaggcattattccaagctgctatggaatttataattaacagacaagcttaaccaacaacagaaatttctggaatctcttgtaatttacactacagcctgccttattccaaatttagatcacaagcatgggctggattccgaggctgaatcccaaagccttcttggcacacctctagcttgggattcttgcagtcactcagccctgtggggagggcgtctgcaggatgactgagggccagctgacccagtatgcagacagacgcagtgcggctgctttgccagagctcactcacatccagaggcccagcaacacctaccattagctccttggagctgcatcaggaggctgtgctagagaaatgtctcgttgcactcagatgtattcattatgatgccttctacagatctttgctatcattgttctgcgaggtttttgcttcctttcccagctgctaccccagggtgaatcctctcccccaagttccaagaccaaggtgtgcactgaggcatatctgagcaactgactctgcagtgaggctgcctgatagaagaccaagccacagagaagacagacaaggagggtgggaagagggtggccatcactggctaccgtcagaggcgtgtgaaccagagcaactccatct

SEQ ID NO: 139610 - DNA, 165 bp, Homo sapiens
caacccaggcttctccagacctagtaatgctgatgccacacacccaactaccactcccctgggggaagctgctccccaactcccaagctcagagagaaaggaagaaggggcagtggatgagaagaggatgtgatgaggggagcttcctaaagacccacaaggtgt

SEQ ID NO: 139611 - DNA, 2739 bp, Homo sapiens
cagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatcccagtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaataaaataaaatgaaatagatcttatta

SEQ ID NO: 139612 - DNA, 409 bp, Homo sapiens
cccagtgaaagggatcatcccttgtcacccagcaagtccagggcacaggcaggattagagcatccaaggcacaaaaccaaactgtctgactgcatcattactgttcagccagggtctgggcaatggatagacacagtggaaagagaaaacatgatatagaaacacaaacacaggctctggactcagattggctttgggtctcatttcatgcatgagtgatgcatgacatcacttgcagaggaaaaggcataaggtttgaagtcagaagacgtgcatttgagttgctgtttcatcactgtctgtatggctttgcacaagtcagttaagttttctgagcctccagttcctcatctccaaaataatcaaatccgctgtagagacctctgaaaagcttaataatatcccaaat

SEQ ID NO: 139613 - DNA, 1026 bp, Homo sapiens
cagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagaggcaggtttcctttcttcctacttgtctcttctccaaggttccagtgattgagagtttggggcctctgattcccaaggatctcttgtggaagacaggaggagggagggaggctgcaaaccctggctcagctagtccactgagataatccctgggtgtgatcttgcacctgctaatatcctgagagaaatgtcctactgggaaaagtggg

SEQ ID NO: 139614 - DNA, 338 bp, Homo sapiens
cacatttcaattttctggttttatttttcagattccctatctttgtctactcagcgaacacagggccccggtgagcattcagactcttaactctccatcataaagcagatgggaagagccaaatggaagagagagggggatggcagagggctggataatgacagaggaaggagtcagaatgtcattactcagaccacatgctgtgaggggagatgatctgtaatcatgggtcctacatggttcacaggcataggcatgtgaaccagtcactcacacagtttctcttggtgatatcaggttcattcaccaccctgctgatggagaaactaagtcccagt

SEQ ID NO: 139615 - DNA, 2406 bp, Homo sapiens
cagaagggcaaaaacattgactgcctcaaggtctcaagcaccagtcttcaccgcggaaagcatgttgtggctgttccaatcgctcctgtttgtcttctgctttggcccaggacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatcccagtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaataaaataaaatgaaatagatcttatta

SEQ ID NO: 139616 - DNA, 397 bp, Homo sapiens
tgatctcattaagtctcttgaatttttttttacatgaaagtttctggtaagctgtgaagttatgagaaagaagcaagcgaacctcttaggaactgctagtgacttttttgtgtccttgccattttttttctttttttatattagtatattcttgaggaagcagtatatggacacttttctatatgcattatggtgattgaataagacagtctttttgtacattttatgctgactgaaaatgtatacccattttcatgtgcacaaagttccagacatttttaggctagggaaatgagtattttagaaaaacatgtatgctgctaaattacttgtgaaatacaccaatagaaaatagaaagcactgtacttacaattgaggaaggaaaacagaatgaaa

SEQ ID NO: 139617 - DNA, 569 bp, Homo sapiens
tggatgttttctaagagagccgtgagctggcttctctcatgcactacgagagatgagagatgaatcccaaagtcgccttctgggcccatattgctacacctcctaatcatcaccatggctgggcaaacactccaattcaaacccaagtgggagtgggaaagacctgagagggttggagatttttatgagggtgaaataatttcctagtttgtaagtcaaaattcccaaggactgtgggatctacaacctagaaattcagatgatttcagttcttctgtcctggaaaataccacttcactatcctaaggcaaagatggccatgtactcttataaaaagttattgcaaaatgacctgctcttaaactctgaagtcaccatactcttttaccgcacctggctggacttcagggttttacagacatcgtgtgtgagcttcatcacaaaccaaggccagcacggtacagacttccaagaattcaactgcatttccatattcttcagggaactttaatcttctaccccaagactgagttaaaaagaaaaatctgagcaacaacaggagagtctct

SEQ ID NO: 139618 - DNA, 307 bp, Homo sapiens
atttgtacaccatcataccattagtaagttgccaagctgggattcaattccctccaaagcgcatactgtatttaactacctaccagaagagatgggatactcactccagtcatgccaacattgctccaaaatgacttctaaactttttttttttctttgagacagtcacactctgtcgcccacgctggagtgcagtggtgtgatctcggctcactgcaacctccacctcctgggtacaagcaattctcctgcttcagcctcctgagtagctgggactacaggtgcgtgccaccacacctggctaatt

SEQ ID NO: 139619 - DNA, 386 bp, Homo sapiens
tgggcggtggcaggggcaatgcagggagcctgagagccattcaggagacagtgagacaggcttgggggagcacgggagcaggaggaggcgatggtgacctctaggcctccagctctgccactaaggtagacaggggtctcttcttgtagacagggacccacacgaggaggaggtttcagcaaaagatgattagtccagctgataaatgtgcagcttgagtgactgaaatgtgagtgactcaaatgtgtagtttgagtggcttcctagaaggactggagggcttttctttttccctccaatagagagaggtgtgagtggttccaatgctgatgagcaggagccagtacagattccccgagacagagccatgctggtgtgcagccctt

SEQ ID NO: 139620 - DNA, 1135 bp, Homo sapiens
tcgatctagaggatctctcagtgatcctccaattgtgctatcttcatagcaattgctcctccttgccttccaccatgattgtgaggcctcccctgccatgtggaactgtaactccattgaacctcttttgtccgttgcccagtcttgggtatgtctttatcagcagcatgaaaacggacgaatacattggggacctgaaagccaggtttcctgtattctatgacaaagccattgccaagtagcaagctggcaatttgattcatgaccagatgtaaacagaggtaaagactgagaccattccaaggtaaagcttttaatacattgttggatatatcctgcctaaaatatctcctaggaatagatgattctaggctttgctattacagtgctcttaatgacagacaagcaaactacttcttgcagaggaagaaagtcctgccatttgataacatcatggagaatgcccccaagccattttcatgaattacccaaaagaccaaatggaacaggagctattatccctattttattcacgaagaaactgaggccctgagaaattaagacatttgacagatacaaacagtaatttaggcaattagtaaatgtttgaatcagagttcaaatccaggtctgtttgattccagagcccctacatcacccctccagactatctctctgctcacatcttcagcaagttacaaaattttgttgagtggatgaatatttttacatatatttcccagctgggcacagtggctcatgcccataatcccagcactttgggaggcagaggtaggaggattgcttgagcccaggagttcgagaccggccggggaaacagagagagacccatgtctttaaaaaaataaaaattaaaaattagcctggtgtgcatgcatcagtagtcccagctactgggaaggctgaggcatgaggatcatttgagcccaggagttccaggctgcaatgaaatatgatcatgccactgcactacagcctgggtgacagagtgagaccctgtctctctctctctctctctctctctctctctctctctctctctctcaaaagaaagaaaaaaaaaagccaggtgtggtggctcactcctgtaatcccagcactttgggaggctgag

SEQ ID NO: 139621 - DNA, 360 bp, Homo sapiens
ctccaagcccacagaggctctgccctggttttctatgacttctttcatccccacctcagtcccatcttcaatgaacacatcccacgctgtcatcatggtcatcatcaccatcaccgccccctccatggaaccacaactgtcacctccaccattacctttacctccgccatcagtatcatctccaccaccatcacctccactatcacatcacctccaccaccatcacctccacccccaccatcacctccactattacactccaccagcatcaccaccatcacctccacttttacctccacctccactaccaccatcaccacctcctccacctccaccagtgccagacctaagcaagccagg

SEQ ID NO: 139622 - DNA, 178 bp, Homo sapiens
ttgcccaaagtcttactgttacagcatagcagctgaattgagagcaaaattaagactcctgatacctagtcataatactgttgttattcttgtttaaaacagcatatatattattttgttccttttggtgaaggccaatcagggccaggggtggtggctcatgcctgtaatcctaaca

SEQ ID NO: 139623 - DNA, 310 bp, Homo sapiens
tacttagagataaatggaaagggtaaaacatgagtccctgtcttccaggagctcacactcgggtgtgggagaaagccttttaagcacacgattgccattgaacgtgatcagacttctcaaagatctgggccaagtactatgggaaatcagtcaaaggagggacaaagtacctgcaggcattggaaaaggtggctcagagaaggcaatgaagtttatgctctgggtcacaaaagatgagcatgcggcaaaggccagtacacaggccaaggacactttatttatttattttagagacatgggtcttgctctg

SEQ ID NO: 139624 - DNA, 689 bp, Homo sapiens
gtgaaaatgaccatacaccaaaagcaatctagaaattcaatgcaatttccatcaaaatactgtcatcattcttcacagaattagaaaaacaattctaaaattcatatggaaccaaataagagcccatatagccaaagcaagagtaagcaaaaagaacaaatatggaggaaacacattacctgatttcaaacaataaggttatagtcaccaaagcagcacggtattggtataaaaataggcacatagaccaatggaacagaatagagaacccagaaataaacccaaatacttttagccatctgatctttgacaaaacaaacaagaacataaagtggggaatggacactcttttcaacaaatggtgctgggataattggctagccacatgtaggaggacagtggatcctcatctttcactttataccaaaatcaactcaagatggattaattacttaaatctaagacctgaaactataaaaattctagaagaaaactttggaaaaacccttctagacactgtcgtagcaaggatttcaagaccaaaaacccaaaagcaaatgcaacaaaaacaaagataaatagctggaacttaattaaatgaaacagcttttgcatggcaaaaggaacagtcagtagagtaaatagacaactcacagagtgggaggaaatcttcacaatctatacatctg

SEQ ID NO: 139625 - DNA, 927 bp, Homo sapiens
taacaaaaattctgtttacatagaatttttcaaagggcacccagtacgtgaggccatagctggaccaaaacacagacctacgtattcagactcggtcctttaatgactaccaatgctagctccaaaatgcaaggattgcggaagaattacaggatctcaacttgtactccccatcaccttctctgcccttatcccaatttatttatcttcacacgacttaccggcacctcacatatgtgtgtttgtctgtgtccaccctgaacactcattagacctggacttccccccctggaaagacttggacttggctttcataagtgccatatccccaatggcttaccacacagtaggtgcacaataaacaattctcaaatgttgggggaaaatgggagaaagagaggtcatcagatagttctcttgtctcacgtcacttgtaaattcaaactgcttcggcggctctaccccagcctctggtgtcatgtcggggtgcagtgggcctccagaagggagagttggggggtatgataggaacacaatacaaaatcagagctctggcccttgcggaaaaaacttttgggggagaagggtgagacagacatttatcaaaggatacacaactaaatgtcgaaaggtaactggggacgatttccggcaacctaggagaggtatttacggtaacaccttgaagagggtacaccgggaagacttttccgtgtgcggagactgacggatgcttggggtttgactctgtgaaggccccaaaccctacctggcaccgcgtggtgccaggtgaggcggggggtgcctccccctggcacccggacaccagggattcgaaccagtctctgaggaggccgagcggcgccgcccgcggcccgggcggcggggggcgcctgtgaacccgggctgcggttcagacgcggccgc

SEQ ID NO: 139626 - DNA, 322 bp, Homo sapiens
aaaatctctcacctaatatgaatcaaggtcacacctgtgtacagtcgctgccttcttctgaccagcagccgcagaagtcccaggacctatgtgttcgtgtagttcatacacggatcattgagagtgtgagttagtacagaagtgtttggaatgttctgagtaaagaagtgtgagcattaacagtcctggatgatggagcagagcctcccagctttgttttctgtcagccattggaaagagttcttggttctttggaattcagcggggtagtggtgatcccaaaagcaggggacatgtcagaaggtactgcttaataaataca

SEQ ID NO: 139627 - DNA, 653 bp, Homo sapiens
acaatccaactgattgccccaagtgttctgaaaaccctgattcatgaagtcatgtagcagcaaagagaaccagaattcccagtactttgatacttgttctttacagaatcaatgaacttctctgcaatagaaaataacctcataatcctctcctatttctcaagagaagttcttgacaaggcagtgattcaaagccctgactaggttaaaatgtgactttagagaccttagacaagacttctttcacgatctttggcagagtctttgatgccaatgtaaaagcaatgattcatagtggctcgtggagcttctcccttcaccaaagcagcaaaaccagatgtgctgtcaggtactcaatcagttttgctggcaagccacttttcactgttttacgtctcaatggtctttccagtttccaaaatgtgttcacaaaacagtaattatttgatggcattagcatgctgttaaacgacaaaaaagagaagctagcttcactaagatacatcagaatttcatttgggccaggcaagggtggctcatgtctgtaatcccaacactttgggaggccaaggcaggcagattacctgaggtcaggaattcgagaccagtctggccaacatggtgaaaccctgtctctaacaaaagtacaaaac

SEQ ID NO: 139628 - DNA, 356 bp, Homo sapiens
ataggttcgcagagcaggtactgcctacaacatggaactcagccgagcatggagacagagtaagggtggtgggctttttgggcgctagaaagagtaccaggccttcacctcttcacctcttccctcactcatgatcaggtctggatttaagagcaagagaccccaggataattcagaagtcctctctctcctcctgttcaagactcttggtctgggattcaataataagtagcagacctgacataagaaagatcagataggtccaattgccagtgactattgggagccataatttggcagctggagactggtaggctcaggcctgattaacactggctaggatcagcagcaaataa

SEQ ID NO: 139629 - DNA, 134 bp, Homo sapiens
acttgtaattctgcccacacttctgtagaatttctgtagaagatcccatagtctggtcagaggagtataagcaagtctaaataaccaaagtggggggatctcaaccaaatcatttgactctgggctctgtgctc

SEQ ID NO: 139630 - DNA, 173 bp, Homo sapiens
tcaactttctcagtgagggattataaaatccatttatcattggcaaagtgatcaccttttcattatcttgaggtttcggctgagagttcgagggcaaagtcaaaactccatgataaattttgctggcttccgtctttgataattctcttgctagcacttttaaccctatctgc

SEQ ID NO: 139631 - DNA, 412 bp, Homo sapiens
ttcaagcagttctcctgcctcagcctcctgagtagctgggactacaggcacatgccactgcacccggccaatttgtgtatttttagtagagacggggtttccccatattgaccaggctggtcttgaactcctgacctcaagtgatctgcccaccttggcttcccaaattgctaggattacaggtgtgagccaccacacccggccttcagcttcattataattttatgataccactgacatatatgcgatccattgttggctaaaaaaatgttaggcagtggccaggcgtggtgggtcacgcctgtaatcccagcactttgggaggctgaggtggacagatcacgaggtcaggagatcaagaccatcctggctaacatgttgaaaacccatctctactaaaaatacaaaaaat

SEQ ID NO: 139632 - DNA, 177 bp, Homo sapiens
tcaccccaacgtggtaccatcctcaagggctaccccaccttcagcatcccctttgggatcagctgaggcctatcttgtgatcggacaccacagcccaatttctcccttggcccaattgtgcttcctcctattccacaagtgtgaatcctaaaatctccttaacaaacttcctacatg

SEQ ID NO: 139633 - DNA, 203 bp, Homo sapiens
tgaagccaggtccttgttagtgggatgaaggtgacacagccagatgagttttatctctgcagctggggatcaccagctgcagcagacctctcagcggctccatcctttacttcttttaaagctgattatttcagttaacaagaagaagattccctgtttattttttgcatttactagtattttatttctaaaatactaatctg

SEQ ID NO: 139634 - DNA, 200 bp, Homo sapiens
cttggtaaattggccttcccgaaagggaaactgacagcttctactccaccaggcgaaaatgggcaaagcaggtggaaagctgtatcaagttactaaagcaaattggatctacgtgggtgcacgtgcccctattttagttcgtttcatgaaaacatctcttctcaaggcaaggagtcatggcctcatctctctggaaagct

SEQ ID NO: 139635 - DNA, 127 bp, Homo sapiens
caggttttcaccactgtcaatactttaaatttaaaatacataaattagttgaaatgactgtaagctattctcacagtctcttggtctagaacatcttaaaaataagacttacagaccaacttaatta

SEQ ID NO: 139636 - DNA, 562 bp, Homo sapiens
actgctggtgggaatttaaaatggtgctgccgctatggaaaactgtatggtggtttgatacgatctggctgtgtccctacccatatctgatcttgaattcccatgtgttgtgggagggactgggtaggaggtaattgaatcatgagggcaagtctttcccatgctgttcttgtgatattgaataagtctcacgagatataatggttttaaaaaggggaattcccctgcacaagctgtcttttctcttgtctgctgccatgtgaaatgtgtctttcaccttccgccatgattgtgaggtcttcccagccacatggaactgtaagtccaataaacctctttcttttgtaaattgcccaatcttgggtatgtctttatcagcagcgtaaaaatggactaatacatggttcctcaaaaattgttaaatagaattgccatatgatccagcagctccacttctaagtatatacccaaaagaaccaaaagcagggtttcaaacaggtgtacactcatgtccacagcagcataattcacaacagccaaaaggtggaaacaacgcaaatgt

SEQ ID NO: 139637 - DNA, 459 bp, Homo sapiens
gtgtggcacagaggctttggcttttctctgtagcccaataccggtgagacacctcctctttactgtgaggcttcactctttttcttcctttttcctgctgccttggcttgctgtgggaggtggatgttgtcagcatgtatgacctgggccatcgcagctgtggctgaaccagaggtgggccgggggatgtgatgcagatcaccaagagcatctgccacaccccctgaacactttcgggaagagaaacatcagttcccttgaagggctgctctgtccatctgcccagcttggatgtactaaatgctatttgtttgtatacctaaaaatggttaattttggctgggcatggtggctcaggtctgtaatcccagcactttagaaggccaaggtgggtggataacttgaggccaggagtttgagactggcctggccaacatggcgaaaccccatctctactaa

SEQ ID NO: 139638 - DNA, 200 bp, Homo sapiens
gatctgcccgcctcagcctccaaaagtgctgggactacagacgtgagccactggtgcccggcctgacatatatcttgagtaaaagagcctgtgctgggctctggggatgcagctgtgaatgtaatcactgctgaagtcccgtgggggagatagacaccaaacacacccaccagaaaatgaacacaatcatatcagaggag

SEQ ID NO: 139639 - DNA, 394 bp, Homo sapiens
ggtgaagagggctgccgttcctcagtgtccacggggtttgtggccagaggagaactcctgccttgctgctgaggggatagctgcaatggtgactgatcttcctgcccacttcctcctgagcaagctgcattgaagacacgacccattcccactctaacggatggagttagtcaagagcggagagcagagagggctggactaaatgtccctttccttcctacctgctggtgaagtactgtgttgaatacaatgaaatcctagaagtatatagaaatagcagaaaatttaatccaaagctaattctgcttcacctttttaaaaatttggaaatcctgtaatatatttctgtaataaattaaatagcacagacagtgactttcaggcaaaattctgc

SEQ ID NO: 139640 - DNA, 683 bp, Homo sapiens
tgatgagtgcctataatatgccagccagtggaaatacctggaaggttactgaaaggcaacaatcagacaaaaaataaagaataccgtaggtaaatgctacagtagagctgagaacaaggtacaatgatgtcagaaaaaaggtataatcaaatctctttgtggaattggggaaggttatacaaaggagaagactgaactgggtgctggaataatttttcttgatgcttaggtaggggtagggagacagggaagtaacagaggtactggacatgccaggcagaagaaacagcagtacaggacatggaagcaaacaacatggcaagtctggggctctataaatatttcagtatggcttggtaagtagacttggcaatgggaaaggcgtaatgggagatagagtaggaaaggcctaatcacagaaggccttctattcctgataaggactttgatcttgattctatgggcaaattagaagctactctgtaaatattattacaatgaattgaatttaggttaaggagattagccttggtagtatgggtatgcttcatccaatcagttgaaggcctcaagagcaaaaactgaggtttcctggagaagaaaccctgcctgagtttccagcccgttggcctgctttacaggtatcagacttgccagcctgccagcccctacaatcacgagtg

SEQ ID NO: 139641 - DNA, 512 bp, Homo sapiens
tgctgcaaccctgcaacctccgcctcccaggttcaagtgattctcctggctcagcttccagagtagttggaattacaggcacgtaatttggatttggaggcagggtaagagtatggcatcactaccgggtttctagttagattatctggtagatagtaactattcactgataaagaagtgcaggaacaggcctaggcccaagagaggtgactaagaaatttgagcacaattagatgtgtctcgagttactggaaagttggatttggaaatctgtccatgtacatgtattctgaagctccagtgagaggtcaaggcaatagattaaactccaagaaagttgggaaacaggaacaacaacgataaatccacaggagagaagattcaaggaggggaatggttcacagtaccagatacagcagagtgtgagacaggtgattgagatgtgtccccagtattttgcaatatgatggtcctttgccaggcaatttcaaaggaaccatggaggggaacat

SEQ ID NO: 139642 - DNA, 530 bp, Homo sapiens
ttggtgcttggtgatcaagatttttacaagatttagtcaagtagagtgagtcttcatgtatactctaatagtgcttatttttgatgtgtatatgtatagtggatcctaattgcatgttatgtgtacatacgtactcctatgtatgtcttgagagagcagggagggaagagtgtatctgtgtatgttgggattttaaagaaggagaaaggatttgggggagggaaaaggaaccagtttgttgtacattgttttaccagcaggctcagtttactttgtttttgtgtgtgtgtgtgttgatcaaggagattcaaagaatgaggaaaaataggatgttctttcttagattctagtaaacaagtatacaccagatatactagtgtatacttgtctattcttagtttgcaaaatctcctttggaatatggttttactgcgtttatccaaggacttacagtaagacactttcagaaccaagtgaaggaggttgtttcacatacaagaataaggcagtgcagcagaggccagaatcag

SEQ ID NO: 139643 - DNA, 281 bp, Homo sapiens
ggattcctctggaccttgtctaccccttcctcatgcagggctgtgtcttgatttgcctccgtggtcccactgtccagcacaacagctggcctggaggaaaggctggcagattaagtggacccgaggcccctggcttcatatccatgactgaggtgaggcaacggaggtccattttatggatgggcaaactgactttccacatgcttcctgcttgggggcctagctgctttcaaaagccctatctcctgaggccacctttgccccagaagatgtcctggggg

SEQ ID NO: 139644 - DNA, 429 bp, Homo sapiens
aaaaagacagaggttcacttgctgcttcttttttctctttatcaattatttgatttagtcaaattttctattcaagaaaatcccatgtatacagttacagcggggttttctaaatgtgtaattatgtgtcaaagtagactagtcctgctatctaaacaacggttctggagaatgttctcataatgtttgttcattaatcaacctaattctcactctcagtcttccaagtggcatatgagctgggaaactaattcagccatataccatgtgaacttctgaaccagatcaacataaagaaattgctaaagaaataagttttagattctagattctttttactatagtcatttagagatgaattacatttatttaatgatagaatgggaatacaatgggagggaagcaatgactgagatgagccacaaaaac

SEQ ID NO: 139645 - DNA, 340 bp, Homo sapiens
gtctgagctgagatgtgtgggaagggcagaattaactaggtgaggaggtggaggaagagagacccgtggagagggagcagcctgtgcagggttctgaacgcacagggttgccaggacctgaggcaaaatgaggaaggtggtgtcctcctgtcctgggctgtggtcagaggggactgatgagcacggtgtctttttgggagaggatgggagtcattttaccgacggagaaactgaggccaagagaaaggaagagcctttcctgggcttcaggcagagctgagactagaaactgaggctcaggatacttagcctggaggatgtgtgtgtgtatttgtacgtg

SEQ ID NO: 139646 - DNA, 600 bp, Homo sapiens
gctttaacgaaataatgacctatgaaaattaagcgtaagacaatataaggaagggtaagaagggagatccaaagaagaaagcaaattgttaacatgtgaatgttttcactgggagtaatgtttccaaaaaagttttttgaatttgatttattaggttggtgcaaaattaattgcggtttttgaaggtagggaattttcagcaaattaggatattatttcttgcagatgacatttatttgtttcatattacaatatttttatgaatagtaatgatcactaattctaatgaagatgacacggatgaagtgcttggcatatttcaaaatagtaaaggtgaaaactggaatctgtaaatggaaacatttaaaaaccatcctctgtccaatttgttgaagttgaaaagacaaacaatatgacaagactatatataagatgcactaggtgtgggttttggtggatggggggcatagaaaccaaatggaaaactcagggatagaaggaaagaactctgatcaaagacaagggaaaaggtgacaatattgaaaagggttactttgccttttcccagtgttatagtggctttccaattctcttctctga

SEQ ID NO: 139647 - DNA, 162 bp, Homo sapiens
gtttgcaccttttcatgtgtttattgcctgtctgatttcctcttctactacctgttgatatccgctgtccaatttgaaactggacatgagtttttaatttttcttatcagtttgtagagttcttaaaaatatataagaacattaagtcattgatgtcacatg

SEQ ID NO: 139648 - DNA, 177 bp, Homo sapiens
tagaggggcttccatattccaatttcaaaggattccaacaaagaccaaagtctaaggtcataaaaatgacatattccttaatagaatcaaaatacatcattacacagcaatgaaaatgctaaacagcaaagcctgagtttattctacacatcaaagctttcatgcaggttttttttt

SEQ ID NO: 139649 - DNA, 268 bp, Homo sapiens
gtggcacgcgcctgtaatctcagctactctggaggctaaggcaggagaattgcttaaacctggggaggacagaggttgcagtgagccaagatggtgccagtgcacttcaacctgggtgacagagcaaagactccgtctggtggagggggaaaaaaagccattctaccctgactcctaaagctttatttgacccttcctgttagtcaatgttagttcttttcccatcccctctttaaaaaaagaacagctttcaccacctttgcgggat

SEQ ID NO: 139650 - DNA, 381 bp, Homo sapiens
catcatcagtgtctgtgaaatttattacagcaatatgtagagaatggtgcaattattattataggtcttactgtattaccaaacccagtaagattgtacgcgaggaacggtgagctcacgtgtggtgtccgtgttcatctcctccaacaagaatgtgtgttgagaaaagagccaccttagcaggaagcatcacaggcttctctattgatcgggctctgtttaagcaataagagaatgtcttctttcagtgacaaataaaattcttgaagagaggagaatatgatgtgaactctgaggggttagtgaagctgcctgtcttgtgtgcctgtggcctaattaaaagttagaaaaatacagccaaggaaattaaattttaaagca

SEQ ID NO: 139651 - DNA, 753 bp, Homo sapiens
caacaacaacaacaaaaacttgtggtgcaggttctaagacccagggtgtcttccagataagaatccacaagtgactcgttgacttgcaccgtcctctgaggttatcagctcattacttccattagtaatgtgcccaggagtgaaggctgaagtcaccattgcagatgcttaggtcaactattttaattcattgattactagttgttaaaaaaatcatagcagccacctcctagtgctgttgttaggattaaacaatcccatggacaaggtttcaaacagccccaggcacaggctatgggctcaatgatcatcagctgctggagtccctgcaacacggtgggccacaggatagagcattaaagggcctggtagaaactggaaagacctgggtctccttggcgtagcagatggcctaggggcaggaccaggtccttgcagcaggtgtggcaggtgccgcgtgcatactggaggaagaaaggactacgtctttgcaccacagcatacttccacgttcagccacaggcattcacgcttttgacaagccatcaaatggcttttctatagcaagcttcattaaaatggaagcacattgctctagtatgcagatggggccactttattactttttaatttgtttacggaaagcccatgtttggtgtacaccatctttgcaaatagtaacaaatgggcatgtttgctgcctccaaagctgtggtgtccctggataaatagaccgaaaccatgttggagcac

SEQ ID NO: 139652 - DNA, 271 bp, Homo sapiens
aaacctctaccaatgtctgcatataattactcaggaaagaaatgacaaggttgcagcgaagctaaccaatttcccagcaaaactcaacttgagaccatgtttaccaatcttcagtctgtcaagtaaattctaagtatccttcctggggatcccatccaagtcacttctggactctgtggtctatatagccagtaaaaacactgcagacatacataaacactgcctggatattctttgcaaatgtttgtaaaggctcctagacaaagaaact

SEQ ID NO: 139653 - DNA, 1527 bp, Homo sapiens
cagagatccccttacttctatatacttcactgttctatatatttccatccttaaagtgcaccaaatcaaagaagacgacattcccagatagaaaaggaagcaaacgttttttgagaatggagacaaaaactattttgcacatcataatttttccattagcaagcacaatgccagaaacactgtaagttctaaagaaattaataatgaatggtgatatagcaccatcacacaagaaactaagatctagaaaagttaagtgactttaatgaattttaaaaattgtgatacacaaacacaacgcacacacacacaaatagaatattattcagcctctgtaaaggacatactgccatttgtgacaatacagatgaacctggaggatattatgctaagtgaaataagccagacactgaaagacaaagactgtatgatctcagtcatatgcagaatcttaaatgtaaaagttgaataactagaaacagagagtaggatagtgattcagtgggagggagaggaggaaataggaagaagcaggctaaagggtatacaaatttgcagttagataggctgcataagtctagggatataatatacagaatgaggattatagttagtaatattgtattgtgtactgaaaatttgtcaagagagtagatttctacagtttttatcacacacacccatgaatatgttaatttgtttgactgctataatcatttcactatgtatatgtatatcaaaacatcatgtataccttcaaacatcttgtaccccttaaattgatacaatataaaatttttttaaagttaggtgacttgcttataattcattagtttattcaacagtatttgttgagcatgtactgtgtgctgtgtacgctgagttaggttgcagtgggtagagcaatgaataagatacactagatccctgatccctgcctcgttaatatgctagacacaaaaggacaaatattgtagcgttccatttatataagtatctacaaaaagcaaactcatggagtcagaaagccacattagagggctgggggaataggagagctatattgcttaatgattacagtttccgttggggtgatgaaaaagttttggaaataggtggtgacaaccattatatatcattgtgtatgtaatcaatgtcactgaattttacacttaaacatggtttaaatggcaaatttgagttgtacactttaaatgggtgaattgtatgttatgtgaatcatatctcaataaagctgttttaataaaagaaaaagaaagatccctgtctcgttaagcttataacctgatgggaagagacatacaataaacagagaaagtcattttagattgcaataagtgctgtgatggaaattaattaggtgatataatagaaaataagtggaaaaggacctactttagattaaattgtcaaataacccttattgaggaagtgactgttgagcttagatatgaatgatgacaaggaactagccatgcaaccagctaaggaacagaaagttcctga

SEQ ID NO: 139654 - DNA, 202 bp, Homo sapiens
caactggttagatactactactgtcaaaaatttcacaagtgaggaaataaccaatatacttaattactggttttagtaccaccatcacttaatactttaaaatgaaaagttaaaaaactaaaattgagtaaatgtattttgagaaaatatgagcaatagtgattcaaattaacagtcacatttattatatacatctctctac

SEQ ID NO: 139655 - DNA, 452 bp, Homo sapiens
ctccaccctcaagcacagggagagactttctctggaatttccttacctgaccaagaaggcttctttccaaaagaaactcggaaatctcattatctatcccacaaaagaagactgaggacagcaatcacacctggacagacttgtgcacaagataatgccttcctcattcaggctccaaagagaatcatttgcaagttaatttctgtccattctttctcccaaataatcatttgctgccccgtcaaaagaactgtctacatcccctatctccctctcccctgtgaaatagggtacataaccttctgtgttgcattaggctactgggtcatctttctcctgctatttattccccggtgctatgcacgtcaaaattttaatgtcttttctcctgttgacagctgattttcagggaaacttcaaagggtgaaagggaagctttcccttggccccta

SEQ ID NO: 139656 - DNA, 431 bp, Homo sapiens
gttctataagcctctacatttcactttctctttttcaaagatacttaagcctaaactgggtgcagtggctcatgcctataatcccaacactttgggaggctaaggtgggaggatcactgtaggccaggagttcgaaaccagcccaggcaacacaaggagaccccaactctataaaaaatttttaaaaatagccaggtgtggtagtagtcccagctactcagtaggttgaggctggaagatcacttgagcctgggaggtagaggctgcagcgggccatgaatgtgctaccgcactctagcctgggtgacagagactctatacccgtaaaaacaacagtaaggccaggagcggtggctcacgcctgtaatcccagcactttgggaggccaaggtggatggatcacctgaggtgaggagttcgaaaccagcctg

SEQ ID NO: 139657 - DNA, 447 bp, Homo sapiens
ggaatccgtgaggataactagaaaatgtccttgattcagggcaggggactgtcagatttcctgagcgggagcctggcctgagcaggagctgggccccaccccttctgggctctgcagggatcccagtgtggaccagcttcgagcaggaggcacagcaggggcttggcctacttttactccctgaaaaatataaacatctcctggagagctacagatacctgatgaaagcaagaaggactcagggtgctgcactgaaaggagggcaccagtcttatcccctgacatcgggggccgcctttgagcagagacctcagggcgtctctgaaggcgaaaggccaagtcacagaaaccacggctttccagagatagttggagctacaaatcacagaccgcctcagtgtgcacacagctccctcccctgtgccatcaggcacagaaatcattatc

SEQ ID NO: 139658 - DNA, 253 bp, Homo sapiens
cttctgacctactgactataagttgggattcccacaaatacctgtttgggttccattaatttgccacagtgactcacagaactcaggggaaaatgattaccagtttacttaaaaggatatcacaaaggatacagatgaaaagggcaaggtacagaggaaggggtatagagcttccatgccagtactttgcttccttggcctctgggcacgggcccaggatttggacagcaataataatcgccggtcacgagat

SEQ ID NO: 139659 - DNA, 291 bp, Homo sapiens
cgtgcaggtgtctgtgtgtgagtgtgggtagagaagagtgtgtgtgtggcgggtgaaggtgtgaggaggatgagaagaaccaaccttcagcgctcactgcatgtcagtgcttgtcactgtcatcttgtaatcccacattttacagatttacattttataggaaactgaggcacaaagaggctactcagccagcaggtgatagagatgggatttacacccaggtggtttggctccagtgtgtacacacttaacactaggccacgccataagctatgtgtgtgagtgtgcaag

SEQ ID NO: 139660 - DNA, 514 bp, Homo sapiens
tttttctacaatgataatccttaagtagatagctaacattgtccttagattaaaccagttttttcatatgtggttcttacataccacctccttcagaattataggggagcttatttaaaaattaattatccacttcatgaataactttaaggtggcatccacacatccacattcttacagatactgaggtctgatgaccaaattaattcatctttcttaaatttcagatacccgagtaatgctttggcaagtattcccagttatgacgggattctaggttcagcctaaagtcctgatgaagttggtgttctataaataacagaagtacaggaagcagagttgacattcagttgaagaacttttcactgtagaagggattttgtttttccttagaacacaaacaaaaatgctctcagtcttccaaatgcctcctttatgcatccagaaaagttttcagttgtgacccaaaaagttgacattagaaagcaagaatggggagtgaggttagcaaaaa

SEQ ID NO: 139661 - DNA, 133 bp, Homo sapiens
atgaatggaaaaaggtctcaagatagtgggatttaaggctggacacactggctcatgcctgtaatcccaacactttgggaggcaaggacaggaggattgttcaaccccaggagaccagcctgagcaacacagt

SEQ ID NO: 139662 - DNA, 106 bp, Homo sapiens
ggaaaaaaaatcatgtaggcactccataaattttgaatggctggctggcaagacaaatggataaatgacaaattatgcaacttggggttgcttacaacacaacagg

SEQ ID NO: 139663 - DNA, 455 bp, Homo sapiens
gcccaccgtccacgagagaatcacagactaaatgctatcgatatcacaggttgcttcatctgctcagcaaaggagcgcaggcatacagagagttaaccttcgtggcaaacatgctttatctataggaactagattataatatgactatactatctccctcaaagttcttccactcgagtgggtggggcgataggcacggaaaccttcctcttctcgtgaggtttatgtcacgagaatgtatgattatctagattaaggtcgtgactaatgtagctagggtcatctttcaaggtataaaaggtagtctgaggccaggtgcagtggctcatgcctgtaatcccagcactttgggaggccaaggcaggtgcatcacttgagctgaggagttcaagaccagcctcggcaacatggcgaaaccccatctctaccaaaaaataaaaaaaattagctgggca

SEQ ID NO: 139664 - DNA, 394 bp, Homo sapiens
aactgtgtatgtttgatagtttaaatttatttcccacacataatatcttgatgaaattattctttttcagtttttgtacagtgaacttgtgtggtaacctttctcttttttcggataggtcaaagacttttccctcataaaatctgaaaacttgaacaagctagggttaggtatgtagaattgtttagaaagcagaacttcttttcttaaaaatatttttagagcgctggtgcttaattggcattatattgccacccttaataatacagatggggaggccaggcacagtgactcaatgcctgtaatcccagtcctttgggaggccgagatgggaggattgcttcagcccaggaattcgagcccagccctggcaacatagggagaacccatctct

SEQ ID NO: 139665 - DNA, 292 bp, Homo sapiens
tcggataggagaaccagagcaggagatggaggagacccttgcagtgagctggaggaagaggaggagtgggctctggaagtgaagatgctccaagaaagatcatggaacagagcaggaaagaggcacaaaaggcagcttctcaaaccctgagcttttatccactgaaagaaggcaaaggctccttccactttctgcttctacttgggatgtgggctgacaagcacctgacccctggaactcctgcactcaccatagtgtacatcccacattagtgcatctgatacagtattca

SEQ ID NO: 139666 - DNA, 1150 bp, Homo sapiens
gttagtttcgctcttttatatcttgctgatgctgttaggtttctctgtttcaaaggtcagcattctgctaattaacagaagaatgtttttattaaggtgaatgaacagttttattttacagttttgaatagagcttaattgtggacacaaatattcagattctgcttgcctacttttttaaattaaaaaatgtatatccatttattttatgggataggtggtaggttccagaatggagtgataagggcatacaatttattcatcagggattttacattatatcatcacagccagatactgaaagcatttaaaattttactcttttttaagatgctttaatttttcttcatttatatttgctatttgattttctatacatcatgaggcctcagatgttactcaaaggctaataatgttttaaacattctatatcttaatttaactgtgaatgatttactttaatttcatatttaaccaccaaataagagtgttgttaaggtataatttttttgtgtgtgttagagcttgtcaaaatataaatatcattttcaacttttaagttacctgatcgtatctctctgtaactggcaagtattttattggaaagtatctttaattccaccttgaatttgtgattaaaaaatacaaccctgttgagtacttttgagaagaattgaattttatcttgagcatgtctttctatactcagtttaatttgtttttataaaatatacaatttattaacttgtttaatattcactataccaaagaggtatctaatacccatgggttatgtagtcatgatggggatacaaatactttcttgcactattttagtatagattatatatttgagcatatttgaatatgcactaagcaacttaaaaaattcatttgcagatcacgattaagtcttagaattatttttctaacttcctaatttttgagtaggttgtattttggtagacagcatattgtaattgtatgtaaatttgtacacaattgtgtgtaaattgtgtataaatcttatatgctttgtctttttagcagtattgtaatacattttcagtgttggtgtttatgaagcgatagtgtattattgcaaatggttaactatttggatgcaataaatttttgtaaaccttttttc

SEQ ID NO: 139667 - DNA, 315 bp, Homo sapiens
ttaaacttttgccaagtaagtaggtagcatctgcatttggtttgcaaagtatctgttggaggtagataagagttgttcctatagaaaaactgtactaatgccagaactttaccatagccaagtgaggtagttgtgccaattaacccgaaaggtaatttggaatacaagcatcaaatgtattataacttgatataatagttttgctgttttagaagttataaggcacgttaagcagtcttcacataggtcctgtcctccacctcttgcccattcttacctcatctaacatcccccaagaagccgcagattttttgc

SEQ ID NO: 139668 - DNA, 297 bp, Homo sapiens
tcattgtattcattttttttctcccttcttcaaagaactaagttcatctcaaactatcattgattccacatctaaggaagtcttccctaccatgtcaagctataaaatataaggcacattaacaagaagcctctcaaagtccactgatcttccccattaaaagtaccaccactctgccaatttgtttttcataactttctagatccactgccagtaccttattcaggaccaaagtcccaaagggaatcttttgtaaggaaaagaaccttacaaaaaggaccaattttgaagtcttcc

SEQ ID NO: 139669 - DNA, 236 bp, Homo sapiens
atataagcgcgggtcattccgttcacttcagggtctgacttcctgaaatttcccctctcttccctcgaactaactcaaaatgccgctcacttgcaccactgggcatctctcttgtcccctgtcatgtgtcgtgtctcatcattgtgcatttccagataacccttcttctgcctaaacggctcaagcacagacttttctgctgtccccatcactgacttatttttgagtacagatcc

SEQ ID NO: 139670 - DNA, 453 bp, Homo sapiens
ctgttgcctacaagaaacaaacttcacctacacggacacatatagacggagaataaagagatggaaaaagatattccatgccaactgaaacaagaaaacaaacaaaaaagagcaggaatagctatacttatagtggaaaaatagacttcaagacagaaaactctgagagacaaagaaagtcaccatataatgataaagggatcaattcggcaaaaagatacaacaattttaaatatatctgccctcaacactggaacatcaagatatacaaagcaaatattattagagctaaagagaaagataaaccccaacacaataataccttcaaacccccactgtgagcactggacagaccttctagacaaaaaaatcaacaaagaaacatcagacttaatctgcatcatagacctaatggacctcatagatatttacagaatatttcatccaatggct

SEQ ID NO: 139671 - DNA, 423 bp, Homo sapiens
cattcgctggtgtgttattttcccccgtcaaattctatcacagtagtacacaatacacagggggagaaactggcagattaatctgtgagaggaaaagctgagtactgtggctattcaataagtcttcatcaacataccacataaatccaaactgcggcccaccaaaaaggccctcgaccattaggaaaatcatactctaatatatgcaaatacaagacacatactgacttaattagaactgtttttccacatgtacgtaaaggtaacatgcacatatacgtgtctatttgtatatacatgcacacatagccatctccgacactggggtcatactttttccacttgtttttatgtttctgagtataacagactacgtggaattaaatcaatgctttgaattaagagctgtgattaaaacacagt

SEQ ID NO: 139672 - DNA, 361 bp, Homo sapiens
acaatacctaaatgctagtaaaaaggggaaaaggtgcgtaacctcattagtaatcagggaagtacaaaacacctacatacatacacacacagacacaatgagatgccattatgcacctatcagaatggctgaagtaataaaatagattgacaatacctagtgttcactgacaaggatgtaaaggaaatgaaactctcatacactgctagtgggagaaagatcagcacagccacttcagaaaatgggccatacctactaaagttaaatatatgcaatttgtttcatagggatatacccaacagaaatgcattctgatatgcatcaaaagacacacacaagaacatttgcagcagcattattc

SEQ ID NO: 139673 - DNA, 686 bp, Homo sapiens
tctgacaatgcttcagaagttgtagtccaagcacacacaaatagtgccaggagtcgagtttccaataacttctggctaaaagcctcagagtcagtcagcctttcccagtttctcatgcaaaacgtttaaaattaacaaaagccacctcaaactacaattttcagaatctgggaactcttatatccaagagcaagatggatacacttggattgaaaaatgcagccaagacccacaaatgccaagtccttgccacagaacaagctgtccagctggaagaaactagaggaatccccaaaccatttgtcctctgactcaagaacaccagaattataccaagacaaaactgtgcagctatcactgttctgcacaggtgtaccgccttgtgaagtgatccgggagacttctgtgttaccaaaccctcctcacatacactcactcccactaaaacatctccttctatacaaattagaaactgaggctcccagaaaacaacttgaaaggaatgtagagaaacttatgattgtcagatttagcaaataaaaatacaaggatgcccagttgaacttgaatttcatacaaactacaagtaatttttaatataagtatgtcccaagtcttaaaagaggactacaaataatttgttagtgtgagtgtgcccgtaagtatttgggacatactcacactaa

SEQ ID NO: 139674 - DNA, 304 bp, Homo sapiens
agcaacccgtgtctttcatattctccaggcactcaactataagccagcgtctctcacgtcccttcagtccactgctgattcagccacggcagagtagaagttctgtgtcccacacactgccttcgcgtgcactgttttgctctgagatgacctgaatgtagacaaaggcacaatgggacctcatgagggcggctgcctggcttggtagccactggtgggcacctgtggcacacaccgcagcttccccactcgtatcctctgggctgcctgggttcacctgcatagaattatgggcggctcccgg

SEQ ID NO: 139675 - DNA, 481 bp, Homo sapiens
  misc_feature (438)..(438): n is a, c, g, or t
aaggagaaggtaggctacagttgggcaaagacctcagggagagaaagaatgatatctgagggaaaagagtactgggcagaaagaagagcaagtacaaaggatttgaatcaatgatgcccacatgccacatccaagaggctagcaaaaacaatgacctctccaattcctgtcttttaggatgaagcctgaggcaattctttttgagttcagtattctaacacgtctgaagaagaaaagttgcagccgctagcccatattgtgtctctgtgtgagttggaaaaaaggcaaatcttcctccaggtgaatggttccctattcaaggcacacagctagacgaatggaatgtgggctgaatttcaggccccactcactgccttaagccaggtggacttgcagagggcacaacttgcatggcattatgcaaaagccccaggcaancgtggactagtagccaaccgtggactagtagccaaccgtggac

SEQ ID NO: 139676 - DNA, 201 bp, Homo sapiens
gagaaaacttgggagtcaagtaacagcgtttgtgggaacagaaaagtttcatgatggccaagtactagtagagaagagccgatgtcaggatctcgaaaaactactaactactcagcatatgtcaaaatgaacagaaagacgggggatgggaggacagatatcaacgaattgtctctgttaatcaatcagtaatcgatctgt

SEQ ID NO: 139677 - DNA, 322 bp, Homo sapiens
attatcatattttctaatgacagaagaaaaaatgtaaagtgttatggtagatattttttgacacatgtaatggctgaaaattttaatatgaatttcaaaaccaaacattttcacatcaagaatatttcaaaattaaaatcatgctttatttctgacaaacatacatgcactatggggcagtcaccttgcagagcatatcaaacgcacgtggtgagcagcatccaatacaggtgaatacagatagtcaggcctggagctgggccaccagagacaccctccctgcttccttgtcctctcattgtaagtgggttgcaccttgtgg

SEQ ID NO: 139678 - DNA, 324 bp, Homo sapiens
gtccactctataggatcccccacaccacctgagtccgtgaaacacattttccttgaaagggtggttagttagttttgctttgggtatgtaattgtaacttttctcattaattgggacaagaaccctgataagaagagcacattaaattgctctgatcatattttctggtgtgactgaagccttgctgtgatgcagggctatttagaaggcaaggacatagatggaatttaaagtactcaaaaatgtacttgattagaattaatgagaatgaaaagagaattgagttaaatagcttcactagctattggacttgaatttctgtaa

SEQ ID NO: 139679 - DNA, 293 bp, Homo sapiens
gcagggaccctgagggaaggcacgttcctgtccccagaaggtgcatgtgaaattgttcggcacatgcatttggggaccccgttccggaatgccctgcgagaggcctttccgcagagctcaatactctcatcagagatgagaccccccgcacctgccagagaggaagatggggcggcacatacacaggggaactcctccatccccaccaagggatgtgcttgcagaaacacacagcagccatgagggcaagcccaggcacaggtgaactcagactaacacaacacggtgggctc

SEQ ID NO: 139680 - DNA, 177 bp, Homo sapiens
ctgaccttaagtgatccgcccgcctcagcctcctaaagtgctgggattacaggtgtgagccaccatgcctgatcaaaagtatttaaatcagaacaaagacatattatatgtacttttaacataaatatattgttgaacattatcattggtcagtagcatgggtattgaaataagcag

SEQ ID NO: 139681 - DNA, 165 bp, Homo sapiens
ctaaaaatttgcctctcctatacgtagttttatatttaaatactctattttcttgacagctacaaacctgggaaaattatggaagtggtcagaatttatttatggttattataaagattatctagatatatgtgcaagaataaaaaccttattgtttttgttctt

SEQ ID NO: 139682 - DNA, 302 bp, Homo sapiens
agtttctccacatgtctccagtgccatctctctcataaatcaagttctcacatcagtgtgcgcttattcatagatcacatatttgtgccaatgttaaagctgccagtatcccactaatatcttaattactacatattcagaatgatttttgatatgtgatgaatctttatgttctgtcccacttcagaaacatcttggtaattcctgggccattgctttaccataaaaattttggaatcagcttgtcaaattctacaaatgttgactttttttggtactgcatttaatctatagatcaattt

SEQ ID NO: 139683 - DNA, 390 bp, Homo sapiens
ttctgggatccagaatttgtttcagcacctccagagtctgtcctgttctatgaagaaagtggcattaggcccatttcataggttgggaaactgaggcagcagggagtgggctttgatcaggtggtcctttttctgtgatcccctttttgggactgtggtgaattccctgtcttggccacaccaagcctcaaaccctgtgggttgtttctgattacacaggtttgggggtcacacctgggtgcatgcagtgtggggtacaggttctgttactctgtgcagaaatcgtcctcataaaggaagagttgaagtggggctggcagcaggggatggacccctaggatgaccctggaggtgatgggcaactgggtcagctgtgtgggttaaagtcct

SEQ ID NO: 139684 - DNA, 289 bp, Homo sapiens
gttagatttggctgcaagtaaaacttcaaattactgtgactcaaaaaggttggaggttgtaggtgcagatctttctaccttgttgctccaccacatctgactttcattttaaaaccacctcaacaaccaagatggctgctggagcgctagtcatccgttccagccagaaggaaagagtgagcaagagggagaagaaagtatgtctctttttaaggatatcacttggaatttgcacccctcattcccacttacattccttaggatggaacacatttacagagccacagct

SEQ ID NO: 139685 - DNA, 421 bp, Homo sapiens
ataaacaaaaagctcattgatagctccagtcatctttggaggattgtctgaagaatatggagcttatctgtttttctaaatgtatttaagatttcctcttggattaagtctgtcagagaggccaggtatggtggctcatgcctgtaacccctgtacttattgggagtccaaggcaggaggatcacttagcctaggagttcaagaccagcctagggaacatagtgggaccctgtgtctacaaaaatcaaaataattagcgaagcttggtggcacatgcctgtagtcctggctacccaggaggctaaggttggaggattgcttgaggccaggaggttgaggctgcagtgagccatgattacatgactccactccagcctggatgacagagtgagaccttaaagaaaaaaaaaaaaagcaacac

SEQ ID NO: 139686 - DNA, 209 bp, Homo sapiens
atctacattccttctacctagcctttgctgccccctggtccttcttggagtcctgtgctgggtcacctgtgttctggtggccaaagagagagatgagagtgtgggtgggggattacatcggatgttttggggaccgcatctgaaatggcacacatcattttggtccatattttactggctagaagtagtcctggattcgaggagctggg

SEQ ID NO: 139687 - DNA, 550 bp, Homo sapiens
cttgaaaatctgaagtgcagagtctcgtttaaatatctaaatcgggtatgggtgagactcaagttatgattcaccttgaggcaaattgctctccagctgtgaacctgtgagatcaaacaggttatgtgctcatatatataaggcactcattaaccatttgctgaaagaatggaacctcatggcaaactaatctaactgacttttaagattacagtaaaatattggtctcagcattcaataattatcaacagttggtagtactgatgatttttggtgtacacaaggaaagccctaaatggattctagatttacctgcaacttctggtagtgaattcttgttctctctaacagaaatggctttagccttatccttatatttgagtgcttctgggctgttactttgaagggcagaggtgatttgattcatcaaagcactaacgtaatgagtgggagaggatgaatcagcagacagtgtgctggagaaatactctgccaggcaaaccaaaatcttgcttctctgctccttcactccctccttgatgctggactt

SEQ ID NO: 139688 - DNA, 177 bp, Homo sapiens
gtattattccatttatgtcaaatgtctagaataggcaaatagagagtgacagaatgtacatttgtagttgcttgggactgggctagggagttactgctaaggcatgtgaggttttagaatggacaaacattttctaaagttaaattgtgatggttgcacaaccctataaatacacta

SEQ ID NO: 139689 - DNA, 254 bp, Homo sapiens
tattatatttacagacaaagatagtaacatttgttccaggagaagatgccaagaagcaaaaaactattgccaagagaagtaattgcttattcctagttagtaaaagtgacatattctgagttgatgctttaacttttccacacccctagataagaagagcttcaggtgctggacttatgcaggggggctggtcaggattgaagaagaaccaagcagatacttagctgaaggggttgggcagaggacagagtgca

SEQ ID NO: 139690 - DNA, 181 bp, Homo sapiens
agatagcaatgtcaaaattccccacctcccttcactatgcttccatgccctccaagcagtcttccaagggctaattcaactttccaggtacctcagtactggaaaggtggtgtggtaaatagagaacagaatgatccttgccacagggaagtggtaaattgacatttcaaaatcaatcttg

SEQ ID NO: 139691 - DNA, 373 bp, Homo sapiens
tgaaggtgacgtgggcggctctctcaacaggtaatcctgggggtattttagctagagcaaagcctgtgtctggccactagtgggcacaaactgctcagtaagtggaaggaatcttcatgtcaaggtattccagctaactttgatacagttattcaatgaactgcattcctaattaagaggctttgtggcaggcacagagctagtttgtcagggtctagttctgcactttgacatccatattcttgctctgctagtgagtttttggacttctaaagggaataacacgcagccactgaggtacctgaggttactggataatagtaagctgtctgaggcttttttatacccttgttggaaaactctagaaacaggg

SEQ ID NO: 139692 - DNA, 301 bp, Homo sapiens
agagcctacgttaggttattatgaccattctaagaagaacacagtatttgcacaattgcttttgttttttctgacccttttttcctccttctcacacagcgtgccttagaagacagcaaaggccaggaagaaatgtaccctggacaggagaaaagtagaaagaaggtggaacaacttgctgaggggcatcagctcctgggtggcctggcactgaaccccaggctgcctttcagataaatccaggtgggccctatgcacccccaatacaagtatgtgtagtgcatctttaccatctgaaatg

SEQ ID NO: 139693 - DNA, 396 bp, Homo sapiens
cctgcaaccccctcctaccttaagtatggacccttctcttgcacctctgggtgcaatgtggggagcagctggggactgggaggatgaagcctgaaagcctgaggcttggaaccagtaggaaggcctgggcagggtttgggaaagaactggcaaaatttcatacagatgaggtcaggtggtggggacaagggataatgctggactgggcaccagcgtgcgtgtgacactgttaacatgatagggggagactgcttggggaaaatagttgcttggggaaacaccagaggaagatacccctcaagcactaaatggaggccaagcaaggtggctcatgcctgtaatcccagcacttggggaggtcaaggtgggcagattacttgaggccaagagttcaag

SEQ ID NO: 139694 - DNA, 221 bp, Homo sapiens
tgagaggcctgcctttctccatctcttgggaccaaggagctgacaaacagtactttactaaacagcaccgccaccctccacacacacgcatgcacacacaacatgctcattcacgcgggtcatgctcatcaccgcgtgatgagcatgcaagggatcttgtggaaggatgacggagtgcgtgcttcataagaacgctccaacgagtacccagctgattgact

SEQ ID NO: 139695 - DNA, 153 bp, Homo sapiens
tgtgaggtgatctacaggacttatgaattctcctgctgctctcctgctgtagggtctcttgttttcagcctattcagtcacccagcagatgtgggggacccagagtaaagcccaggttctcaccaccctgttttcaaggagcccccatcttgt

SEQ ID NO: 139696 - DNA, 436 bp, Homo sapiens
caagaaccttgagataaggagattacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcaaaactatgagagaataaatttttgttaagttaccaagttttttagtaatttgttgcaccagccataggaaacttaaatacctttgtcctctggagtaaaaaggatactctgttttaatctcttatttagaactagtcattgctaaaataatgtaagagggatgctgccaatgttagttttctgcg

SEQ ID NO: 139697 - DNA, 189 bp, Homo sapiens
gccagggaatcggtgatgttctgagctagttctttctgcacttagaacttgattctagaaagagattgttaaaattggaaaatctggccgggtgcagtgatttatgcgtgtaatcccagcactttgggaggccgagtcaggaggatcacttgaggctagacgggatggctcacgcctgtaatcccagca

SEQ ID NO: 139698 - DNA, 528 bp, Homo sapiens
agttttttttcctttccttttacataatgcagtgccaatgtcctcttacctggaacagtgcctggcacacagcaagcatcgtaactatttgttgaataattagtgaatacatgactggccgaatgagtgagggccatgcagtgcctctcccattatgtcaggactcttcttggaatgctgactgtgttttgtagagtgcagccctaggaagatgggagacccaggaactggccctgtctctgctgatagctccgtcagcttgaatgaggtctaagccccacggacactctgcataaagaagcatgcatgttgtgtaggtaacggggttggaactgttgtggtcattgcttcatgagggaaactagatagggatagcaccagggatggcaggctggagcctggggagggcggatcacagagaagctctgtgacgtcgtctggggttaggaacccatgaaaagactgaacttcctattaggcagggagaaaatggggagggtctggcttgatgtctcttggagaaatctg

SEQ ID NO: 139699 - DNA, 213 bp, Homo sapiens
gatacctaacacttaacataaaatatacaggtcatgtatgaagaacactgtgctaagttgaataattataaacacatgccatgtttatgataaggaagttcagaaattgtcaagatattaaatctctcagaatctatttgcaattaccttgcaattcaaatacagttcaaatggattttatttttagaccttttggattgctctaaagttcat

SEQ ID NO: 139700 - DNA, 105 bp, Homo sapiens
actttgttcttggttgtccttttcatatcctttcttgtagttcagcatctagagtttttatggttttcctgtgctgtgtaagtttatcataggatttcttggcca

SEQ ID NO: 139701 - DNA, 979 bp, Homo sapiens
ctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctg

SEQ ID NO: 139702 - DNA, 357 bp, Homo sapiens
cctcatgctgtcttttttccctccaagtatttgccagttgttggtcatgggaggcgggaagatgagattctgggcagaaggcctaggcagaaagctgctgctaagaagagagatgcctgctgaaatgttggcaatcttaaaggactagaaagacagaaattggagtttagggctaataagtctttggaatttggagtggaagggagcagaaatcctggtcacaagggaggcacagcacatttttgcccaacaaaccgctctttgtctttctagggatttgttgactttttgaattcttaaactgcttttgaagcaaagcagaaaactcccaatgggtaaagcagagttttcttcctt

SEQ ID NO: 139703 - DNA, 251 bp, Homo sapiens
gttatactccttttcctggctataatatttcacttactcccagtcctctggccctagaataaaaatgtgagccacctttagctctcatgcctgcattgacaaatcccaggtttcacctggatatccttacctccccaccaagcttgttttagtttcagacttgccgatctgcacctcaaaccccaaattctcataaatgatagcttttctgcctgcttttcttttgatgcttttccttgaccccaggtgag

SEQ ID NO: 139704 - DNA, 274 bp, Homo sapiens
tgagtgatgacagcaccaataaacactgagactcacctttctgcttggataccaaacctcttcccaccggaatcccgccaagccttcaactctccatccaaaccattcattctttctttcaataaacacggtgccaagtatttactaataagaggtgtcgaacgtgttaagtaagaaggacacaaggaggaaagacagtttctctgccctcaggaaaccatcgggtctcgtggaacagaacagtggtcaccgtcttctggccttttcctctgtg

SEQ ID NO: 139705 - DNA, 297 bp, Homo sapiens
aacatactaggtgcaaagtaaaggtaaggagcaagatttatcaagcaaatggaaaacaaaaaagaacaaaggttgctagtcttatattagatacaacagactataacaatggtcaaaaaggacaaagaagggcattacataatgataaagggttcaattcatccagaagacttaactatcctaaagatacatgcacccaacattggagcatctagattaggaaaacaagttcttagagacctacaaagagacttagataactacataatggaagacttcaacaccccactgatagtg

SEQ ID NO: 139706 - DNA, 402 bp, Homo sapiens
aagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctga

SEQ ID NO: 139707 - DNA, 402 bp, Homo sapiens
tagcagacacagggtcagtttcacagggctggtttttacattatgcagctcaataaaagtagtgggcttctaagtgtagggtggctctttgatcctcctgcaggtgttaagagctgggtctgagacttctggaagaatgcaggagctgtgactttatgcagacctccctacatgttttcactccagatcaacatgctggtaagtattggagtgaggagcttgggatttctccctgacagtttctggaaggcagtgtttttgagctatgagtttagttcagatacgtgtacttagcagccagttaagctgggctagaaccgacctcttttgtaaatggagggacctggtatgaatatcttctcggtacaccaagtgcctatgtcttggcttctaaagaccatt

SEQ ID NO: 139708 - DNA, 400 bp, Homo sapiens
gtcttgaactcctggactcaagcaatctgactgccgtgtctcccaaagtgctaggattacaggcgtgagccaccgtgcccagcctcattttttaaattagaatactgatccatttgaaatttgctctgacatacggttcgaggagtgtatccagttttatcttttgctaatggctagctggttgtccaataccagttattaagctatttttcctgctggttttatgtatgactgttgtcatgtacaggatcaccatgggcttgggtctgtttctggatcttctcccctgttccattgttcatggggaagaaccacttgattcttgttttttgatatgtgtttttttgtgtgtgtgacagggtctcactctgtcacccaggcaggaatgcagtggcacgtg

SEQ ID NO: 139709 - DNA, 176 bp, Homo sapiens
aataaaatactagcagaccaaatccggcaatatataaaaagaattatataccatctctactaaaaatacaaaagttatttaccatctctactaaaactagttactctggctggacgtggtggcccgtgcctgtaattccagcactttgggaggcctaggagggaggatcacttgag

SEQ ID NO: 139710 - DNA, 356 bp, Homo sapiens
cgcgatctgatggatcccacgcgtcagagtaaccaatggttacataaaagcagaaataacggaaataataggcccttcccaggcaatgcttaatgtcagcatcttgctcattcccccaaattctgataagctttcctgagtgagaaaaaaattagtgacttttaagagcagacatgcctgtaagtcctttttttttttttttttgagatgagagtgtctcattctgttgcccagactagagtgctgtggcatgatctcagctcactgcaacctctgcctcccgggttcaagcaattctcctgcctcagcctcccaagtagtgggattacaggcactcaccaccacgcccggctaat

SEQ ID NO: 139711 - DNA, 290 bp, Homo sapiens
ctgttggtcacacagaccagtcctggtggagtatgggaggagattacacaagattgtgaatatcaggaagtagagatcattgagggccatcttggctggctaccaaattaaatataacacaaattcagaaaactgcataaaacaaatgttcgtcttaatgaatgactatgactatcagaaaatattagagacttcctccttgtgacctactctctgtcatagtcctttggttcttctcataatcactatgtggatttttagtttttttaagtgatgaggtaaaatttatt

SEQ ID NO: 139712 - DNA, 324 bp, Homo sapiens
gagaggcctggatttgcttcgtggagtgacgggaagccgttggagggcgtgtcaggaggagaatgacatagtgtaacttgaaggacctctctgaagggtggaccaccaggaggccagggtggaagcacacagcagtccgcgggaggatgtcacagagccggcaaggacacagctggctccgcaggagggccaggaatggagatgcacggatgtgtcctggagttagaatggacaggacttctggatggattggctttgaagagtgaggggaaggaggaagcaaggagaaccccagggtgcttggcttgagcggctgaggggacg

SEQ ID NO: 139713 - DNA, 139 bp, Homo sapiens
tgtaccatgtcagtacatcgctacttccttttcctttcttcctaggtagtataatacttcctagtattgcatcgttttggagatatcagagtgtgccagttatcaattagctgcataacagattactccataacatagt

SEQ ID NO: 139714 - DNA, 359 bp, Homo sapiens
ggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgc

SEQ ID NO: 139715 - DNA, 587 bp, Homo sapiens
ttggaagcccagggatgattcacagatgatatactggatacattttgcaaccaattttttaaaggtagctaattctactgatacaaccttattttcacatattagaaacaagcacgttgggtaaacatgtggtagcttaaatctgcatgcaatatttgaaatgagaagacaaagcaggaaagattttcttttcttgtcaaaacttgcactttgcaagctgttccgtaaaactgtataaaaccattggctctacagtgtgaaacagtgtatcaaagggaaacaacagaagctcaaatgaatatagtcttttgttaagccacctcaatttttttttttttttgagacagagtctcactctctctcccagcctagagtgcgagtgcagtggcgcgatctcggctcactgcaagccccgccttcagggttcacaccattctcctgcctcagcctccctagtagctgggactacaggcacccgccaccacgcctggctaattttttgtattttttagtagggacggggtttcaccatgttagccaggatggtctcgatctcctgaccttgtgatccgcctgcctcagcctcc

SEQ ID NO: 139716 - DNA, 467 bp, Homo sapiens
ttggaagcccagggatgattcacagatgatatactggatacattttgcaaccaattttttaaaggtagctaattctactgatacaaccttattttcacatattagaaacaagcacgttgggtaaacatgtggtagcttaaatctgcatgcaatatttgaaatgagaagacaaagcaggaaagattttcttttcttgtcaaaacttgcactttgcaagctgttccgtaaaactgtataaaaccattggctctacagtgtgaaacagtgtatcaaagggaaacaacagaagctcaaatgaatatagtcttttgttaagccacctcaaggaaaaagataaagcagttatttttgatccagattctacacaactcctattttctttctttttttttttttttttcctctggggaagaggcctctgggctgtcccccccgggaaaaaaaccggggccaaacccccgcccccg

SEQ ID NO: 139717 - DNA, 339 bp, Homo sapiens
agttgaaggactgacctatcccactttaaaacctactgtaatactacagtaatcaagatattgtggtattggcaaaagaatagacaaatagatcagtggaacagaatagagagcccagaaatcaatccacattaatataacctgatctataataaaggagcaaagataatcttttgaacaaatggtgctggaacaactggacgtgcatacaccaaaaaaattaatctggacacagaccttataccctttacaaatattaactcaaaatggatcacagacctaaatgtaaaatgcaaaactataaacatcctggaaggtaacataggagaaaacctaaat

SEQ ID NO: 139718 - DNA, 587 bp, Homo sapiens
tgctaagtgttactcagaatatagttacaaatatggtacttaaatatctatttgttttttgtttgtcccatgagcttctcacatgagtctactgggcaattttatgtgagttttggtcaaaattggtaatctcttttatcttagttttgcataatttattgttgccattttatcaaatgagtaggaagtagtgaagtatttcaagaagattgctcagtggggtttgatacaagaactgcccagtagctgggcgacattcagagctctctctctgaggtatataagaagagccctgggagctcctcactgagcctcctgtgagtcaggacatagccttgcagtctgccactgaagcagcctcaccaaagcaaagattccctgctttggaagggtggtgggcaagataaagtcctccaaagtagttatagattattctttttctggagtaaaacttacctgctcagagttgttacacagctgtataaagtccttaatgcttttaattctcaggtggttttgagggaaggagaagagcctgtgattttccttctgtgtatctttttagtgcttagaaattacttgccaaa

SEQ ID NO: 139719 - DNA, 425 bp, Homo sapiens
gcactgacttatgaaggagaccaggccggttgacttgtagaagtctcacactggattggttaggttgtttcctcctaataatgattaacttattcgtctatcctgcatttcctataacctgaaattttgaatcaagggcttgattagactcaagttgaacatttttgcaagaataaaggtcatgttgtatgttgtatagggcgtcaaattggaaagtatttgtggttctcctgctgtcttaagtttggtcactagatcaaagagatgaaagtcaaaaatcttcattgtagagtaactttccctcacaactgacacataatccatggggagataccgtggcagcatgtgagtgcccagttctccatctgtcgtccacctaagtgctgtagcttcagtttttcaatccttgcctgaatcacttattt

SEQ ID NO: 139720 - DNA, 200 bp, Homo sapiens
gctctctcttcctccccacccctcccttttttaaactgggggaggggagagggaagagactgtctttgatctcagcggaggaaaaaagtctgttcaggcttttggctaacacaacaaacagtgtttaaaatttaactttgcttaattaattagtaattctgtttaatgctgtctgatctccctccaaaaggtattttgaa

SEQ ID NO: 139721 - DNA, 398 bp, Homo sapiens
cggagccccggcactggtggaggtctgtgcatggctgatgtggatggagccctgggcagggctctggaaaaggagagccctgaatgcctaaaccctgaatgcttgcctgcttgtcaatcctaagcgcccacccctcagcatggctgcaggacctctgtgctcaggggaagcctgtgaccctgcctctcttagggcagggaaggccctggcatagtcactggtcctgggttggagttgatgctgggcggacagagatcttggtttcacataggcaactctcatgccaggcagggagaagttctgtttctccacactcttcccaagacctggcacccaaccaggcctgggaagggctgggcagagaacctcactcatccctccttgtagagctggtcccc

SEQ ID NO: 139722 - DNA, 468 bp, Homo sapiens
ccaccacgcccggctaatttttttgtgttttaagtagagacggggttttaccgtgttagccaggatggtctcaatctcctgacctcgtgatccacctgcctcggcatcccaaagtgctgggattacagatgtgagccatcgcccctggccaaaaaataacaaagtttttaaaattgacacttgtacatatttatggggtaaattagacatttcaatatatgctgtgtatatgttgtataatgatcaaatcagggtagttagcatatccatcacctcatgcatttatcatttgtttgtgacaggaacattcaaaagcctctcttccggctattttatatatacaataccttactgttaaccataaccaccctaccgtgcaatagaacaccacaacttattcctcctatcccaccgtaactttgtacccattgacgaacctcttcccgtcttccttttcttccttccttt

SEQ ID NO: 139723 - DNA, 437 bp, Homo sapiens
ccaccacgcccggctaatttttttgtgttttaagtagagacggggttttaccgtgttagccaggatggtctcaatctcctgacctcgtgatccacctgcctcggcatcccaaagtgctgggattacagatgtgagccatcgcccctggccaaaaaataacaaagtttttaaaattgacacttgtacatatttatggggtaaattagacatttcaatatatgctgtgtatatgttgtataatgatcaaatcagggtagttagcatatccatcacctcatgcatttatcatttgtttgtgacaggaacattcaaaagcctctcttccggctattttatatatacaataccttactgttaaccataaccaccctaccgtgcctggttaatttttgtatttttgatagagacggggttttgccatgttggccagctggtct

SEQ ID NO: 139724 - DNA, 567 bp, Homo sapiens
cattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgaggaagagggatcagaggtaaactgataaaacaacagaaggtgaaaagggaactgacagaacagaaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaact

SEQ ID NO: 139725 - DNA, 615 bp, Homo sapiens
tagtgttattattgttgtctttgttagaagaagaaaaaatgtggaaggaaaggggattggaatctctctcacctgtcctccttagcccttttttgggaaacatccagaaacacttcctcagtcatgtccagctgctgtattaaaatggcatagactgggtagcttaaaccggaagtccccaacctttctggcaccagggactggtttcatggaagatcatttttccaccgactggggtcggggaggggatggttttgggatgattcaagtgcattacatttattgtgcaccttatttctgttattattacattgtaatatgtaatgaaataattttacaactcactataatgtagaatcagtgggagctctgagcttgttttcctgcaactagacagtctcatctggggttgatgggagacagtgacagatcatcaagcattagattctcataaggagtgggcaacctagatccctcatatgtgcagttcacagtagggtttgcgcttctatgagactctagtgctgccattgatctgacaggaggcagagctcaggcagcaatgctcacttgtaccccacagctcacctcctgctgtgccacccagttcctaac

SEQ ID NO: 139726 - DNA, 440 bp, Homo sapiens
acaggcaaagtggacactgtggtgtagtggaaataatatgagctctataactcgctagacacattctcctagagcctttaaaaactttctgtggctcggtttaccctttctgtaaaatagatacaatagctagccctaaaacacaccactttggttcataacatagaatttctagcctgctcttccacagaaggaaaggagcccaaggaaatctgatatattcctacatccatatgtgtgtgattttactatttaatgtcttcaactgtgtttcttcttcctgacatatcgattttcctcattcccgtgtatccgaaacctacgtctttttcatgtcctagtttaactaccctgtctaaaatgaaactttaccaatttccatcaaacagaagtaatttccctctcctctgtgtttcagccactcttggggatgctcgatg

SEQ ID NO: 139727 - DNA, 817 bp, Homo sapiens
ggcagtgtttcttctgaaattctcaggcagtcagactgtcttaggcaaatcttgataaaatagcccttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtaatgggtgttggtgacaggctatgatacaatggctggccagctgcaacaaatggagcactttcattttcactgactgtttatattggggtctcactgaatgtctggctaccagattccagtgacacgtgcttaggccattttccatggactggcaagatggaccc

SEQ ID NO: 139728 - DNA, 452 bp, Homo sapiens
ctgcttcttgacttttccctccagtcctttgcaatgataatcagttaagtccctattagcacaataaggccaggaacgaggctccaaaaccaaaatttgcctaaacagtgaggggtctgtgaactgcatacatttatttttattttcttttgcactaagaaaaaattctgatgtactctattaaatatctttttttctccccagagacacttttttcaaaacttaggatctattttaacgtatgccttcttgggaactgccatctcctgcatcgtcatagggtaagtgacattcggagctcaagttgcaggtggctgtggggtctgtgatctgtgtgagggatctaacacttccaggattcttgctggctgggaaaattgtcttttttttagtatatcacatatttgtatgttttttctgacttaattccacggcttctgacaaatacaagg

SEQ ID NO: 139729 - DNA, 684 bp, Homo sapiens
ggcagtgtttcttctgaaattctcaggcagtcagactgtcttaggcaaatcttgataaaatagcccttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatgacaagccgccgaaatttgccatgtcacgagagcaaatgtcacagtcatgttctcacacggcacataatgcaagtctgttgacagatgcgggtccattgtcatgtggggagtcgagggcgagctgtttgtttttgtaatgatgttgggaagtgatggctctgcagtcacaaagagcagccttctctcactggctgcaccgatgaacattacgaagttctagaaaaaacatcacttcaaaatgcctggagtaattcctcttatatcaactaatttcaagaagaaaacttgcagaaactaaccccacccctcttaagagaatattgtgtccaagtcctttttatttatacgaacagtgtcttattttcttataataaaaagttataaataaacgagagtttctt

SEQ ID NO: 139730 - DNA, 620 bp, Homo sapiens
  misc_feature (599)..(599): n is a, c, g, or t
tttcctgtaaatattgcatagactttagtccagattttagtacattatcctgtgtaataaatttctatcttttataaattaacttttggtatttagaaatacatattttggggtgaagtcaattctatggtatttcctagcttactatcttcctcatggagaaatagaaaacacaaataatccttagttgaaatataaacatttcagttttagtgaagtgtactatcaccaacttgtaatggtgttacaagtcatcattctgcatacaccagagtgacccaaaatgctccacagtctaggtaaactgcaggagtaagcttaaggttatttaacttccaaaccccagatctctgctctgatggtcacttgaaattctacaatttcaaacacctctgaagacattcagttaaggcctctggcctctagatggccctctatcttttgggaatgccttaaagtccatttcatgagggaaagttgaagccagtgatctttctgggatagcacaagttaccctgtatctttgctcaaggaattctttctgtaggcttcctagagtataccagaattaaatttttctcccctttgatgagtctctncaaagcaaggagtaatacctg

SEQ ID NO: 139731 - DNA, 312 bp, Homo sapiens
ggaaaggaagtaaaatcatctattcacaggtgacatgaatttgagtacagaaaatcctgaagaatccacagaaagctaacaaatgagttcagcaaggttacagggtgcaaaatcaatatacaaaaatcaactgtatttctacacactagcaatgaactccagcctgtgcgactcaaaaaaaaaaaaaaaaaggaaaaaagaagaatgcagttttaaaaagaaaacttaaaggaaaggtaaggcgggccccctttttttgggaggttcccggggggggaaccgaaaagggcccggcccccgcccccaatttgg

SEQ ID NO: 139732 - DNA, 457 bp, Homo sapiens
tcacggagatgaggcttcattcttgagattcaggcctggcccagagaagtccaagccagggaatcgaagcttcttggtcccaaggtttatggactgccctggggaaacagtaccccatcggaaaacctgctctctgctctatgaaaaggaccttcaccatgttgtggggtttcactgaaaagtattctggggaccagcataagaagcaaagccccttgtatgaccttcctttggtctgtcaagctgtgtgagaaccagcagggagcccctggggtgggaagctcaaagccccaggcagaacacaccttccctttgcaaggcactttctagatggaatccctggggagaagcctaatagctcagtgcaagaggcgtgtggggtttcatccccattctacaggtgagagcacctagatgcagctagaatacttggccagagtcttgtggctaagacagt

SEQ ID NO: 139733 - DNA, 247 bp, Homo sapiens
tatagcagctcggaccatctgttaatctctctacactgaaaataaaaccatcttccacccaccccaagcattgtttatattccatttctcttttgaaaccttttgttgccatttccatcagcttctaagatttaacaattttatatttcctcttttctgttttcttcggagaatattttctccaattatgaaccccaaagcccaggggatatctttctttcctttatttatttgacactaattagtg

SEQ ID NO: 139734 - DNA, 437 bp, Homo sapiens
cccggcaagcagctgttataaataaaatacatgctgagcctgcaatttgctcttaatgaaggccacttgtcagtagacggtgctgctaatgcgtgtcctgcagcaaagataacccagacgggatcattttttaattgcccagcagaactttaaccagttgtgcatcttaacctgctttttgtttgttcgtttgtttgttttgagacagtctggccctgtcgcccaggctggagtgccatggcgcgatctcggttcactgcagcctccacctcccgagcacaggcgatcctcccgcctcagcctccagagcacctgggaccacaggtgtccacgcgcagccactaaccgctttcttatctgacactttaagtgcttcttcgtacccagctcctctaacgccttttgaagcagctccatcatctttgaagggcagttca

SEQ ID NO: 139735 - DNA, 313 bp, Homo sapiens
tgactagaggatcccggcagcagacaacagcagttgtgcatcttaacctgctttttgtttgttcgtttgtttgttttgagacagtctggccctgtcgcccaggctggagtgccatggcgcgatctcggttcactgcagcctccacctcccgagcacaggcgatcctcccgcctcagcctccagagcacctgggaccacaggtgtccacgcgcagccactaaccgctttcttatctgacactttaagtgcttcttcgtacccagctcctctaacgccttttgaagcagctccatcatctttgaagggcagttca

SEQ ID NO: 139736 - DNA, 325 bp, Homo sapiens
tccagtcggtgggatatgcccctgggccagccagggtgtatctcagccagacagccacaagatgcagtgctggacaccccagtcctgagttgatggagctgctgactttctgggtttcagctgtatcatcagtaagagtgctgtatctattcaggcagaggagatggtctctccagctccactagagatcttagatctgtgatgcacaggtaattactcctaaaattacctgagacgatttctgaaatcatgagggagtggcttcctgaggagcgatgattacacaaacccgggaggacctggaggtcctgcttctgtcactggc

SEQ ID NO: 139737 - DNA, 448 bp, Homo sapiens
cctgtaatcccagtagtttgggaggccaaggcagaaggatcatttgaggccaggagtttcagtacagcctggacaacatagcaagaccccatctctattaaaaaaaaaaacccagcaagtataggaagtgcaaaggccccaaggcaggaccacactggagcattctgaggagtgacagaaagagcaggagagtagtgggtgccacagagccacaggccctggagtccaagaggcaggcaggcccagtgagaccggagaagttcgcaaatcacatggggagccactagggcctctaagcattcatccctctgctctgggaggcgggcttgaggagccactaaaatggacctgtttgagaacagaagcccagcagtctatttcccagcagcttccctgcctccaagcctaagcggccgtgagccacagagggagtccatctccctatttc

SEQ ID NO: 139738 - DNA, 368 bp, Homo sapiens
gaggaagttggctggatgtgcagttaggactggtctaggaatttgtctgtgtgaccctgggggagtcatctgatgtctctgaacaagaccagagagacctgctaagagtaacctgggttctgactgatccccctttccgcctgcacagccccgggtctgacagttcccatcagccgacccccaaatgaggcagcaggagggaagaaatcaggctgcgaaaagagaaaaacgagcaacggaagaaaccggcttccaggcctgagggggccggtgaaccagggcaacccccgggcaggcagaggcagaatgtgcctgagcgccatctgccgctcatccccaggtcccacgcactttcaccacatcccacg

SEQ ID NO: 139739 - DNA, 404 bp, Homo sapiens
cttcaatgtgcccacaaggctgcagactgcctaagtactgtatctgaagctcagtggtttcgatggtatctttagagcccaaattgattgaatactcactctcaataaaataggaataaaaatttgccttgtaaatttgttgtaaaaataatgcctgatgcgaagtgcttattaagtagcacttgctattattattcagcattcttcagactagaacatagtaaaaaattttttttattatactttaagttccagggtacatgttcacaatgtgcaggtttgttacatatgtatacatgtgctgcaccagttaactcatcacttgttggtgtgctgcatccattaactcgtcatttacattaggtatttctcctaatgctttcccttcccccgccaccaacccc

SEQ ID NO: 139740 - DNA, 627 bp, Homo sapiens
tcccctgagatagagtcttgctctgtcgcccaggctggagtgcagtggtgcaatcttgactcactgcaacctctgtctcctgggttcaagtgattcttgtgcctcggactcccgagaagctgggattacaggtgcacatcaccacactcaagataatttttgtattttttagtacagttggggtttcaccatgttggctaggctggtctcaaattcctgacctcaggtgatccatccgcttcggcctcccaaagtgctgggattacaggcatgagccaccatgcccagccttatttagggtctttatgctaggtgtgtgttcacttgacttgtagcccactggtcaacagttaaactggagggaagagggcacagaaaaagctcataaagtttggatgggaagctgggaatgtggagagattataagatgtgctcacagcttcatcaaagggtagaatagaccctgcagggaatgatatctcctctcagaccatgtggtccaggatgtctttgagaaatttctcctatctcaggcatgataataagtgtggtagtaataatggcacctcttcactgagcatgcatttacgtgctatgcactctataatgaacaggaagattctcatt

SEQ ID NO: 139741 - DNA, 442 bp, Homo sapiens
cctgtctcagcctcccaagcagctaggactacaggtgcatgccaccacgcctaactaatattttctatttataaagcagcctcttttaaagagtttaaactggtgttaatctcttccttttagagagtacccgactatgggcctcaactgaactcaatggctaggaatcagtaagttttcccatatgcaaagagcagagaatctaaacctaaggttctgattacttggcactaccttctcatcaccacaaaagcctccaggaaggcacgtattgagaagagtccagaaactcaacacaggcaatggaactgtaaatatgagtacattctaaccattccaggctctatccagaagatggagctctgagaagtctggccacacaagccttttctctaggtctatgcagactggttgacactagtctactgaaaagaccttttga

SEQ ID NO: 139742 - DNA, 559 bp, Homo sapiens
tatatagtgtggggaatttaaaacttattctatggctttgttggtgatgattaactgcttttatttgctgttgaatcgtaaacaaaataaacatacacagaatttacatctatttggtaaactatataatgaggtggcgactaatgtccaggttggcaaacaaaaatcctggtgtacagcatgtgtgtcttgtccccagcaacataaagaacatataatgttacaatatacttctttattacagaagaatatatggttgtgttttgaaaatattatttctttgtagatggttctcaggggtaggtaaaaaaaaatcttgtctgggaaaaagtggagaaagtggaacatcttgttgctgttcattttattggtttggtcagaaattgtgaaaggggggtcttccatccttaactgtgctttgacctcagtgcttttcttcttttctccatctgtggcagaattgattcttcatatctttctcaaggtccatttcagcagttgatgaagctttttgaagaaaaattagttctatttttaatcattttatcaaaaatatttg

SEQ ID NO: 139743 - DNA, 582 bp, Homo sapiens
taaacgccacagctgtgcaggaagttggaagtcttatggtccagactgtggctgggctatgcatggtggtggcatctctgtgggccccagggcagcttatgtcaagtgccagactaatggtaagtaggaacaagagtaccaaccacagaccaaggagcaggcccctgacctatttttctgactctgtataagaaacagaggctaaaataagccatctggtcaaccaggtagaaccagatttagaacaagagcactgttactgccaatcccacgggattgcttctaagcaatcataatgccaatcacattgcaaaatgtttgtggattgcagaagctccaccaagaatggagactgaagcaaatgggagaagggagatagtggaaatgggagaactaatcaagccttcagtcatcagggacacatcatctctgcttatcccagagaacatcatcctttgtggccatttttctagggtcaacaagaaaaaaatcataccttttcattttcatatacacttagaacagtaaatgtattcacagaaatataagaggcatactagaaagttacaaaaccataaatgt

SEQ ID NO: 139744 - DNA, 296 bp, Homo sapiens
aaaggatgatgtccacaaatcatacaaatcattctgtttatcttcctcccactgacacttcactttactaaagttatccattctcatactaccgttgttttgaacctcacccacacaactctccaatattacctattactaattttttcccattaaaaaaatttaaaagttagctttacccactcaggaagcccatatattctgtaatgcaagcacctacatctaccacagattctcaggttttaagagaccttcggacgggcatggtggctcacgcctgtaatcccagcactttg

SEQ ID NO: 139745 - DNA, 130 bp, Homo sapiens
tttctcattgaattaaccttgatcaaatctgagaactctgcttagtaatgactccaggtatactatacccacttttgtagcttattcaacaccctcttcaatcctggttccacttcctgtgactgaaatg

SEQ ID NO: 139746 - DNA, 134 bp, Homo sapiens
agatcccccttccatcccctctgtctctctctcccttcccctatctgttctctggggtcagcgatcctgggatgctgcattgggaagtgttattcctggtggcctcacaagtaggcaccgagaatttagaggat

SEQ ID NO: 139747 - DNA, 301 bp, Homo sapiens
gaaaggtagggcctcgcctgggtaggaaggtgggggctcactggggtggaagtgggtttctgaagcagcaggtggggccggtggactccaggcaggatctgcgatcactgagcctgaggctgcccctttactcctcccggctcccgggaacagcctctctgttcttacaagccctccatagcagccttacctgacaggctttgctctgagagccccaccatcttgacctgaggactacccatgtcactcatccatctcccagcgcccgagaaggcgctctttgagccgagtgctccagtga

SEQ ID NO: 139748 - DNA, 293 bp, Homo sapiens
gatcaaagaagaaataacaggggaactgtacaagtatttcgaaataaatgaaaactaaatcacaacatgccaaaatttatgagacatagaaaaagcagcgctaagagagaaatgtatagctataaatgcttacatttaaaagtaagaaatattttcttttaatttagaaaaagacatatctcaaatcaaccactttacaacttaaaccagaaaaacaaactgaaggcaagaagaagaaagaagataataaagactagagcagagatagacaaaatagatgatagaaaaacaat

SEQ ID NO: 139749 - DNA, 410 bp, Homo sapiens
ttaaatgaaatttttaaaaatgcaacaacaagatgagaaaatcaacaaagagatagaatgataaaaaaaagaaagaagcggaaatttttgagctgaagaatatagcaactgaattgaaaaattcactaaaagagttcaaaagcagacctgatcaaacaaaacagtggactaaacaacaggtcatttgaatctttgagtcagggagcaaaaagaagaaaaaatgaagaaaagtgaggatagcctaagagattaatgggacatcatcaagcagatcaacatacacattaaaggcattccagaaagagaagaaagagaacttatttaaagaaataatggctgaaaacgtcccaaatctgacaaaggaagtggacatccaaattcaacaatctcaaaacaaatattagtaaatt

SEQ ID NO: 139750 - DNA, 463 bp, Homo sapiens
gcgagaaggctggcgggttgcgcgcatcagatagccaggaaagattaggaggggaacgtgatttggtaaaaacaaatttcggtagggaaagcaaagagctttgttcgacttgaatacataataggtttataattccgttagctgttgaaagcgtcctcccaccgtgctccccccagcaattccattctgatattgatcaatggaatggaaagaaggaaaaaggttacaggacagagatagttaataaggattcttaggaagatatatttagagagatggctataagctatacaaggaagaatgatttctattgtactgactttatcttttcccccaactatctttttttagtctaacttttccttgctttgtatttcacttactctcaccctaggatataggtttccttccaaaggcaaggagctcagttcaaggtatcccctagcaaagagccaccttaatg

SEQ ID NO: 139751 - DNA, 547 bp, Homo sapiens
gtgaatgaatatatagaataatattcctgaaaattccacatattttaattcttggactgctaaatttttcatatgtggccatatatctatacaggtgtttgggtgtttatgtaaatttgccaggcttggtgtgtatgtgggtatgcttctgtaagtatctgtgtatgtgtataaaccatcaacagtaaagtatagtatttgtgatacagccttataagttactggctcttgtggaattatacataaaatcttcatgtaataaagtgttactctgtgacatattagttggggcatgtttaaattaaaaagcagtttgctcaactggtatggcaaatggttcaaaatattcagatatactgatttataaaaaaattgaaattcagctaaatccaatattgtgttaactattaaatataagtaacattaatgtttatattgatatatctttgttttcaattattaacaagatcgaatactatgatttttttctattgtgtgtgtatggatggcttgtagtggttgccaatcactatactctaaaaaaatg

SEQ ID NO: 139752 - DNA, 590 bp, Homo sapiens
cttgtaattctttcatgtgtttgaaataaaggaacaaaataaaatgttgaaaaaactaacaaaaccataaaaaccctagaagaaaacctaggcaataccattcaggacataggcatgggcaaggacttcatgtctaaaacatcaaaagcaatggcaacaaaagacaaaattgacaaatggggtctaattaaactaaagagcttctgcacagcaaagcaaactaccatcagagtgaacaggcaacctacagaataggagaaaatttttgcaatctactcatctgacaaagggctaatatccagaatctacaaagaactcaaacaaatttacaagaaaaaaacaaacaaccccatcaacaagtgggcgaaggatatgaacaggcacttcttaaaagaagacatttatgcagccaacagacacatgaaaaaatgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacactgttggtgggactgtaa

SEQ ID NO: 139753 - DNA, 363 bp, Homo sapiens
ctactttgttctctctcctactcacccagtgtgctctcccagacaatcttactcacttgtctttctgcctcaatgaggaggactctcaaatctgtgtttagacctgacttgtcttctaggctctgcaaccctgtttgtaacttcccaatgagtgtctgtaccaggatatccaatagattttctcaaatttaacacttgtgaaaataaatgaattatcttttccacctgctcattctgtattccttatcatattgaatggtgacatcatcttttcagtcacccaagctaggatcctgttatcttcaagtcctctttattttccatcaatcactcaagttctatctataccttctaaatgcctta

SEQ ID NO: 139754 - DNA, 599 bp, Homo sapiens
atcccatttccctgaatccaactgccagtaggtactggccctacatacgcgtcctttaacaagccccgttctcaaaaggctgggggtatttatataagaacttattccaaagtgactctaagatccacgttcccaagatctagtacgggctactcatgtgttctgaggcatgtccagcatgcacgcaaacttaatctgttcaaattgaggtaaaacagacaaaaaacacttaatattaacagaagctacataattaaaactaaccttttgctgcttatttaagctaattatgtattcttgcaaaacagagaccctcaagtcaataattttttattttagtcacccccaaattaagcctcttctttaaagcgcactgtcatatttcatctgtagcactcaacaccaaactatactataagtatcaatgcatacacatttccatcattcattttgtaagtactatttgtgccaagcctatttcagagacacaagggaaatagagataagtagcacactatcccctggcctatactgtctcgatccaatgaatgagagaggatttgggtgtgacacagcactagagtacaactacagcagtc

SEQ ID NO: 139755 - DNA, 358 bp, Homo sapiens
ttttccaagttaggaaattgaagatgatgtggaggattggagaaggagttcatgagtctggttatgaacatgtacaggtagtaatgagatatccagctggactgtttttgatcattttggtatacaggtctgatgtctaagagatatctaagggcagaagatacaggtttgagtatcattcttttatggatactagttaaagttttggccatggatttgattgctgagggagatggtgtagactaagaaaagaggagcttgcagaaaaatttcagactaccagcacttaacgaaaaagtagataagagagatcctgtggaaaatatgatctgccaattgctgcctcattaaacagagc

SEQ ID NO: 139756 - DNA, 235 bp, Homo sapiens
ttcaattttgaaaaggtgactgtagtggcagtgtggagaatgaattgcaggggtgggtatggcagaagcagagaaaccaggtggaagctttggtcatagttgcatcaagatgctaaggcttaggcttgcttgggcttatgcggtgagcaccaagtctcctgtagggatcaacccttgtgtggttactatgacgttggcttacttttaaaggtctctaggtgctgttctgcctggt

SEQ ID NO: 139757 - DNA, 349 bp, Homo sapiens
aggcaggattaattctgcccacaatcttgaggacgctgaacgtgttttggttcataatttgacaaaaatgacatttttttaggttacagtagaggggggaagcccgtcttgctggtcaagggtgactgaaactttgctgaaagacttactgcctggcttgtacagccaccgcttgtgtaataaggccatcccctcggactcaggtggttaaacatcaggccctgctgcccaagtgtgtccccaacccaaggtgcaccctgggggcgctgaaagaccaggggtcgctggggtgagtgcgggttgctcctggagttgggcgctccaaacgtcctcggagtcctaactccaa

SEQ ID NO: 139758 - DNA, 171 bp, Homo sapiens
aaaaaatacagtcaaggtacactgactaataacagcagctaatatctaccaagtgtttctgtgccgggcacttaaagcactttatgtgcactgactcactgaatcctcccaacagccctgtgaggcagggaccacgaccctccccactttacagatgaggaaactgagggt

SEQ ID NO: 139759 - DNA, 229 bp, Homo sapiens
gactgaacatgatgggcaggtggtcgtgcaggacccacaggcatggggggtgtgcttggtgtagctggagaggagaggcaggggcaattatgacattgttggcaatgggggcagggggcactgcattcctgctgaggaattgatcctatctgtgacgggctgggaaaataattactagttgatgatatggtactgctccctacaagttcatgaacattctctctttacc

SEQ ID NO: 139760 - DNA, 519 bp, Homo sapiens
tttgattacttcttcttgcctctagaaaaagtttgaacaatttaccgtgacgtaataaagctgttcccagttgggctctggccttctttcctggtcttgggccccacctctatataccaaatcatgattttaccacttcctaaatacagcatgctcttccacgttgcgaatatttgggaaatctttttttccttggaaagctgttaactttttctccctgtcagactcctagtaatccttcaagactcaggttttgttggttgaactgaagctcatgcaaatgatcacttaagaggtgctgagattggcatacttctccagagtgcctggctttagtgtagtggaaattctcttcagccacgagcgtcccacaagggagcctagtttgttcatgtctttacttgctctgctaaattatgttttattaatgtgtgtgcttgtactgttgctcaggctactgtgctaatgactgataattgccttaatgagctatttgtaagaaatacagtaataccagta

SEQ ID NO: 139761 - DNA, 481 bp, Homo sapiens
atcgacgatgagcccactgtgatgggagaacctttcacagtcaaccctgcctgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacgggcaatgcccccagcccttccattggaggcagtagccgccttgaaaacactacccctactcagcccctgactcccttacatgtggtgacccagaatggagctgaagccagctcagtcgaacggactgcagtccgttcgactgagccaagggtgtgtggctaacttgtctcaacttcattttaaatgccggttgg

SEQ ID NO: 139762 - DNA, 178 bp, Homo sapiens
ttttcagttaaaataaaaggagtgcaatgagacaaaatctctgggtgaggcatgaactgataattctaaaaggaaagttcccagaatgctttgaataatgtcaacatcattgtaatgagtttataacactccaaattttctacttggaaatgtacagcactcttttggatgtgtatgt

SEQ ID NO: 139763 - DNA, 457 bp, Homo sapiens
tgtggacagctgccttcttgctgtgccctcatatggcctttccttggtgcatgcaagaagaaagaaagtgggagctccctggtgtctcttcttataaggacaccaatcctgttggattagggccccatccacaaaactttatttaacctgaaggcctcatctccaaatattggaggctaagacttcaacatatgaactggggagatacagcaaaatttagtctgtaaaaatgagttaacctctatgccaagccacctttacagccacagcagggtttttgagtagcaatgagtgcctccatttgagactcaggcttggaaaattgatctctgggcccatgtggctacaaggaaggagcacaacgaggttggcccccagccctgtgcactcccagtggccatgccagcctcctgtgcagaacttcccttcccctttcttatcagctgtctctcagctt

SEQ ID NO: 139764 - DNA, 204 bp, Homo sapiens
ctgctgatctatttatagaagctctttccactggcctctacttccttcctcccagtctttcctgcgtacaaagctcaccactgcacacaataactcttcctaaagggacaagcagtatcgttgggcctgcagttgccttagagccagatgagccaacagctgagagctttagacactgatgtctgagggacaactagtcactgg

SEQ ID NO: 139765 - DNA, 650 bp, Homo sapiens
ttagatggagtctccctctgtcgctcaggctggggtgcagtggcgagatcttggctcactgcaacctctgcctcctgagttcaagcgattctcctgccttagcctctcaagtagctgggattacagatgcatgccaccatacccggctaatctttgtatttttggtagagacgggctttcaccatattggtcaggctggtctcaaacgcctgacctcgtgatccgcctgcctcagcctccccaagtgctgggattacaggcatgagccactacacccagctgggaccaccgtcttatatgcagtctgttgtggactaaaatgtcattatatggcacatgactgtattttaattgggaaatacattactaggcttgatgagacaaactagggagatttcagtaagctctgcctaacttaagggaccattcaaaggtaaaatttctttgtaagaaataagttggctgggcgtggtgactcaccctctgaatcccagcactttggtaggccaaggtgggaagatctgttgagcccaggagtttgagaccatcctgggcaacgtagggagaccccatctctacaaaaaaatttaacaattagctgggtatggttgtgcagcctgtggccccagttactggggaggctgaggtgg

SEQ ID NO: 139766 - DNA, 406 bp, Homo sapiens
caaagacgccatctcagctcactgtaacctctacccccagcttcaggcaattttcctacctcagcctcccaagaagctgggagtacaggcacatgactgtattttaattgggaaatacattactaggcttgatgagacaaactagggagatttcagtaagctctgcctaacttaagggaccattcaaaggtaaaatttctttgtaagaaataagttggctgggcgtggtgactcaccctctgaatcccagcactttggtaggccaaggtgggaagatctgttgagcccaggagtttgagaccatcctgggcaacgtagggagaccccatctctacaaaaaaatttaacaattagctgggtatggttgtgcagcctgtggccccagttactggggaggctgaggtgg

SEQ ID NO: 139767 - DNA, 295 bp, Homo sapiens
tgtgtctggggtgtgtgtgtgatggaggccctctctgggacttggtaatccggggaacttggcagggccgtgttggtgggtctggaagcagatccgaatgtgaatgggtcgtgggttggctcaggcaagcctctcgtgagtgacaggtctttttgccctttggccctctccttgtagcttgtgaccgctgatcagtgatcactctttttacgtgattatttccttttttaaaagttggtttttcttgttgctgtttgattgtttttttgagacagggtcttgctttgtcacctag

SEQ ID NO: 139768 - DNA, 453 bp, Homo sapiens
ctgccctcagccacagctctttctaggcgggagtgtcccttgacccctggagccataccagccctcttcaccctcacaggccttgccctgctggaaagaccagcttccagggcacacccagctgtggacacgtctccacccctggcaggctctgcacccgcctcaggagggcagcctctatggactgtccccatcctaaggcctttctggaggaatggcattcatctgacagacagcaaggggttcttccctagcccatttgctctggtaaacaggagaacttcctctgtgttactggcttcagggctccaaggtctgaggtctctgaccctggatgtatggcctgagttggatttcatcaaaatattgtgccttggacttctgacaactccctactccccattgccctagtcagacccacctccctctcattccttcctctctcttccactc

SEQ ID NO: 139769 - DNA, 271 bp, Homo sapiens
ctgactccttctcccaaacctgctttcccctgagtttcctgcacagtggacatcctgaccccatagctcaagccaggcccatctgtcgactcctctcatctctttgcttgatgtgctccagccacttccgttttaacttccagaaactgaccatgccctctcctgcctcagggtcttggcccatgccttttccctctcctagtaatgctttttcttttcctttaagaccagtttcgggcgggcgcggtagctcacgcctgtaatcccagca

SEQ ID NO: 139770 - DNA, 149 bp, Homo sapiens
cctgtctagtcattgacatggtctcagtatacaatttagtgtctggcttgtagctatcaataaatattggtcaaatgaatgaaattatattaatccatcaatggctaagatactctgttctttgtgaccttgttttatttttaattaag

SEQ ID NO: 139771 - DNA, 554 bp, Homo sapiens
cagcaaatgacacaaattacattttgaaggtgtacacaacagaaaattctctcatcttttagcttcatgtgtaaatttcttaattgttcacatgtatagatcatgttgtgaaaactacattgagccatactagcattgttttcagaacagcatctcttccattgaacttgattgcagtttgtatgcattaagatgtcattgttgattacaaacacaaagcgaacaaccaatttagggctgcccactggcctagattttaattttcaatcaaagcgtgctttttctttcatgtgaaaaaagaattttatctgtgaagctctgctgtgtttccttgccctacttagtttttgttgttgtttctgcttttttgtggcaggacacaggcagttcatggataaggcttccctcttaaacccagatacccgtacctctttgtctttgcttactcagcaagtcctcttttttttgctacatttttcatgttgctccatgcctcttcccagcaatagaactatggtagatttaatatcaagacatttgtatttcctttacat

SEQ ID NO: 139772 - DNA, 819 bp, Homo sapiens
caggtgtgagccaccgcgcccagcctgttttttggatgtctaatggaaccagaactggcggtcccttctgtttatggacccgtgcacacagcaggaaggagaggctccagaggccctggactcgggggacaaccctcgcttcatcacctcctgagggtccaccgcagccagccctgggccttctgcccctttcactccaagatctctgggctgaccttcatcagccccttccacccgcctcaggaggtagggacaaggctgggggtggcctttgcagaccctgagaatgaatattgtcctgcatacacagcccagtggccacgagaggccgacgaagatactgaaggtcacagagggccagaggcggggccagggcttgagccaccctctctccaggcccgtctataccattgggctgcccccttcagacctccgggcaggaaaagaaggtagaggggatattcactgagcccccgcctcgagcctgggcccgacctggggtgtttgccttactggccgctccagccagtgtgagaggctgcactatcatgcaccccactgacaggtgaggaaggcgctgtgaccaccagaggagtgagcagactggaatttgagcccaggtctgctcagctcctacacccggcactgagcttccggtctgacctggctcttgggcagggccctgcaggccgcctccctatgtggccccagagtccagagagcagcaaggagagtaggtttctacggtgacctgggcaaatgaagacactaacctgtgcctcagtttccccagcccttcccactcacagcaaaaaaaaa

SEQ ID NO: 139773 - DNA, 304 bp, Homo sapiens
ctgggcagcgttgggacttcaggttctcctctaggcctgcttcaattctgccctagttagatggggaatgcatgtctcattactgccaggctgggtggtgacagaagtccaggctccccacatgctgtccactgatggtgatgggggatgttgtcaccacctggtggggattagcaccccagctcctcacagccttctctgacaccgtggggtggggatgattggggtgcctgttacagcctggcaagggtggaaatctaagctctccacctggcccttgctggtgaggggtggggctgggctg

SEQ ID NO: 139774 - DNA, 322 bp, Homo sapiens
gctgaacggccagaccagcttagctcgtcacctgggcatgctggtcactgtggagcctggctcatggtggggtcgtgctcttcagcatggttgcaacataaaaggacaaaaagcaggcactgtgactgccagtcatggcctccaaggcaggtggcataggaatggcatggtcttctgaaagcagctggaaaactaaatttgctgccggtgtaaatcccttctctaagcatgccctcatgcctgtgaagggcatcatacatcttaccctcagtgctttgtcctaatgccttgccccctgctgccctggaggggctgacaacct

SEQ ID NO: 139775 - DNA, 479 bp, Homo sapiens
tggactctatcctctcaaaccctgctgctgctttatcaactaagcttatgtaatattctaaatcctttgttgccatttcaacaatgttcacagcgtcttcaccgtaagtagattccatctcaagaaaccacttactttgttcatccataagaagaaactaatctgttcaagttttatcatggaatcgcagcaattcagtcacatcttcaggctctacttctaattctagttctcttgccatttccaccacatctgcagttacttcctctactgaagtcttaaacccctcaaagtcattcatgaaggttggggtcaactgcttacaaacacctgttaatgttgatattttgagttttgtatggtagatgcacctgacagtgataatgcgacctgagtataccctgagaatgaccccgtatggcagagcacctcaatgtgtactcagaagtggccaacccagagatccattccttgtctat

SEQ ID NO: 139776 - DNA, 509 bp, Homo sapiens
gtgtgtcatgctctggggccctacacatctaaatatttaacaggattgctttatatgctcttttgctgattttgccgatatgtgatttggtttttgcccagtgggtccctgggcttttcatcatccagtgcatatattggctgcagagtgcctgggcagcaagaatagaggggttgctgaggcatccaatgcaatcagaatgttatttagaaaagctggcttgctagccaagccttgcacgcatcttttattacactgtatctttgtgacatattatttctgcttcacaaggtcacctgaccctgaatgggacctgtggtccattaataacacagctgggtgatggctgcagcatgagttaggactagacacagagaaggatgagtcttcaaaagtcccagctcacctgggctgagttctcacattccttttctattccttagctccccctgttccctgttaattggtgtgcgaggagagaaagaatgggcaggggatggtataatcaa

SEQ ID NO: 139777 - DNA, 435 bp, Homo sapiens
ttcaaggtcatggtgatatgcgctacagctgagcaagattgttcccagcatcagattggaagttgaaagaaaggctaagtcacaagaacccaagagctgggtgaatgcacagctgtgccctaggcccaccagcaaggaccacatttattaggctcagcctcccacacaaacggtgccagaaagtctaagagaagaaggggaacagaggaagggagggaaagtcctttaaatcaacatggtttcattgagcttctgcaccatgcaggggcctgtgggattgagaaggagaatataatcctagtccttgctctcaggaagcttatcatctgtgtagagcccaagagtgagcagctgggtgaacaagaagtggtgcaagggggaagagttaccacagatggtataacagtttgctcaggctgcctgaaacaacagaaa

SEQ ID NO: 139778 - DNA, 582 bp, Homo sapiens
cacctaaagtatatttacagttgtatgttatactgtatataaatttgatatataaatttctaacttataaaacaggtaagctaggaggtgattatgattataatcattttccaaatgattcaggtcaagattccattcatcaatagccatttttctttggctcatataaatgaagtcatttcatatcacgttagccaatggatgatgccagaaacactctttttcattaggccacagtatcttcagtatcaggagagaaaaaacaatgcttaaactttcaaagtgttttttagcttatattttaactgttatctgtgttcatattcatatgaagttgatatataggccaaaatgaagtaaataaaaataagattttccatttggttttggaaaaactatatgtatatatttcaaatttatcttttaaattatgaatttcttaatttcttagcataaactaactggccaggggtgaactagccctagaaggatataataaaaggagagagaagataaagttaggtaagaattaaatatctactatgattaatgcaaataaaaagaattcctcagatttattta

SEQ ID NO: 139779 - DNA, 117 bp, Homo sapiens
aagaaggggtggtcagaattaaagaatgttatggtttaagtcaaacatgcttgtaaagtatgtgaaagaaatggaatatgtaatttttaaataaattgaggggtaaaagtaaataca

SEQ ID NO: 139780 - DNA, 645 bp, Homo sapiens
atccactcgtacacgcatggaatgtaacaagctccacactttggctcctgcctcgcacacgtatgtaatgtaacaagctccacactttggctcctgcctcgcacaagtatgtaatgtcacaagctccacactttggcccctgtctcgcacacgtatgtagtgtcacaagctccacactttggctcctgcctcgcacacgtatgtaatgtaacaagctccacactttggctcctgcctcgcacacgtatgtaatgtaacaagctccacactttggctcctgcctcgcacatgtatgtaatgtcacaagctccacactttggctcctgcctcacacacatatgtagtgtcacaagctccacactttggcccctgcctcgcacacgtatgtagtgtcacaagctccacactttcgctcctgcgtcgcacacgtatgtaatgtcacaagctctgcactttggctcctgccttaaaaacaaacttggaggacagaaaccaggaaaagctcaagcatcttacacccaggaccttccaccaaagttaaatgtttttaatgacgaccaaatatcaccagagagcttcctcgtaaaattaaccaattcatgcatctttccagggctacagctctggcaagcaagggaatgacag

SEQ ID NO: 139781 - DNA, 562 bp, Homo sapiens
atctttgctatgacttaaaagagataaatgggctctggagttattgtggcagattaaaaaacaaaacaattatattttagacctgcatattttggctgttttggactacagttgttcatcccttgagttccaaatgtaaaaatgttacattcagtaatatctaattgtgaaatcttgtttgttactgctgttcttgttctttttttattcagaatcttaagtagtatttttgttataatactaatacaaatcagtgataaaggaggcatcaacaaatcagcaggaggattatttaagaaatggtattagtgcagttggttagctgtttaaacaggcagagagagagaataaattagcctcaacccctaacagttatcaacagaattccagatgaatacatagttaaatgcaaacaacagtgggatgattttcaaaaagtaggacaaaatagaaatgaacttctgatagaatgaaaagttttctctattaagtagaagacatctcagaacaaacaagtgaaaatagaagttactacttataatgaaaacccccaaaaaaactt

SEQ ID NO: 139782 - DNA, 316 bp, Homo sapiens
ggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatcca

SEQ ID NO: 139783 - DNA, 379 bp, Homo sapiens
actgctctgcaccaagaggcaaaccacaggaaaaagaaacccgaacaagcaaggagaatagaagttccccaaagcatgccttcttgtttttctcagaggacagtcttttcattcatgttttacagattggtccaacaagtgcagttcttctagtctcctatctagataagcaggatattagaaggaataggagaggcctgcaaaaagctatgatagggtggaaataggataggagaaactgaaaaaaggggaggcgtgcgctccaacacctccatagcccttggggacgggcttagtttctaatgagaatacagaaggcccatgtctcaataggccccgaaaaatattaatccagcccaatatgaacagtctgctaatt

SEQ ID NO: 139784 - DNA, 571 bp, Homo sapiens
tactccacagggggctgggaagcaggtagggatgaagacaagttgattcatgggcataaaaattcagtcagatagaaggaatacgttttagtttttgtttgcacagtagggtgactagagtcaacaataacttagtgtatattttaaaatagctagaacatttgttatcttcccaatacaaaaagaaaaggataaacatctgagatgatggataccctaattaacctgatttgatcattacacactgtatgaatctatcaaaatattacatgtacccttataaatatgtacactctaccttaaggaaacagtgaaaaaagaaggtgtggaacaacgaccacaacaaaatcaaagaggaaactctttgtgaacttgggtttgtcaggccaggaatcagcaaaccatggccaatccactacctgtttttgtaataatcaaaacaatataattgataatttgtaaattatgtgaaattcaaactgcagtattcataaagttttattggaacagctattattcatttacatattgtctatgggtgctttcattgctacaatggcagagctgcaac

SEQ ID NO: 139785 - DNA, 339 bp, Homo sapiens
tacccttccaaagggaacagactgtgtccgctttgcttatttttggtaactttaaataagactttggatgggtcgtcttcccaactcatttaccaatttaaccactggacgcaggactgagcgccccacagctttcggccggagtataacacgcgcttccccactcggttccccctgtctgccacaaacaaaccagatgtaatagctgaagaatgacgacactaaaatcaacctagagattcacatctaaaagggccgcaacacgaaataaacttctctctcttcagaggcagcggggaagaaaaagaaaaaaaagcctaggtgggttcggtttgatcc

SEQ ID NO: 139786 - DNA, 286 bp, Homo sapiens
tggctcagatgattatactggtaaattctgtcaaacatttatggggcaaaataaattcaacctcacaaaaatttgcagaaaataggagcgagaacttaacttgtttgtatcaggctagcaataaccctgatgtcaaaactggaccaaagacattacaaaacaacaaaactatagactattaccctgtatgaacataggtacaaaaatcctcaacagaatattagcaaatcaatccagcaatatataaaaaggtgaatatgtaaatcatgaccaagttggagttatc

SEQ ID NO: 139787 - DNA, 473 bp, Homo sapiens
gagcacagggctgtgttccaactctacttgttattcgttatatgagtctgaacatgttatttgaacttcagctctttcatcaacaaacatgccattagcacttaaacatgcaattagcacttgccttaccaaactatgatgaaagatttggccaaataattcaaagtgtaaacagccaaacataaaaatgtacaacttcattaataatcacagagccaaattaatacatgttgccatttatgaaatgtgaaaacagtaaagcggagtcagtacatattgggactgtgaatcaaagattttggcaaaatgtaccatggaccttaataacagtcacatcctttaacctactaattcccttctaaggactcatgccaagggagtaattaaaattgcttacaagatggttcaataaagtaaaaagatacgacctaaatgttctgcaatagggtaaatatattattgtatattcataa

SEQ ID NO: 139788 - DNA, 122 bp, Homo sapiens
gttcattccctactatttactatggtacttaatgtgttgacattttttcatctcccccactggactatgaacccctcagacatagcagccgggcacagtggcttatgcctataatttcagca

SEQ ID NO: 139789 - DNA, 207 bp, Homo sapiens
tccacttacatctgaacccaatcagctgggtcccctaaaagttgcatcatgggatgaggaaggagcggttctgggatacagagagaaggattgaaagtatccatagagctgggcacagtggctcacacctgtaatcccagcactttgggaggccgaggcaggtagatcacctgaggttgggagttcgagaccagcctgaccaacatg

SEQ ID NO: 139790 - DNA, 426 bp, Homo sapiens
tcctcctttgccttctgccatgacggtgaggcctccccagccatgtggaactgtgagtccattaaacctcttttccttataaattacccagtctcgggtatgtctttattagcggctaagagagtcacaacacagtcttagtgaattgactaatacagtcacaaatatgtataaggctgtccacaagcccagatagtcccaagaagttcctaagctcaccctatgactgaccctacagctcggtgaaagcagagatgaaggctaaggcagagatgaagctagttgcctgagtgttgatcatgtgcttgaacttgcaaacttctgttcttaggaaagactaggaaacttattgcttctgtacttttaaggaaatctctctctaataattagctgactactaaactagctgagcagagacttcagtgg

SEQ ID NO: 139791 - DNA, 398 bp, Homo sapiens
gatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaa

SEQ ID NO: 139792 - DNA, 154 bp, Homo sapiens
attcaaccctttttcaaagataaataagaggagagctttatggcttgtttttttcttatacattttatacacattgagaagtaaaaatcatttcatatttctgatttgactataggatcttgtactgattttacttgtggtaagtgatgttcaa

SEQ ID NO: 139793 - DNA, 262 bp, Homo sapiens
tcacctcagcctctggagtagctgggactataggcacatgccaccatattcagcaggacatatacttttaaaagtgtgggatctgctgtcaccttgaggatgtactaactgggttgacttcatgtagggcatgggtagatctgagcagggcaaagtagactgcaggagatgttcgggatgccccacaccatgtcatgccctttgccactgttgatttcagccatagctgcagtgggtagttccatgcaaactcacgctcgag

SEQ ID NO: 139794 - DNA, 170 bp, Homo sapiens
ccacctcggcctcttgggattataggcatgagccactgcacctgactgatgatgttgagcaagtttctctatttctctgtgcctttgtttatgtcataggcaaaataccagggatgagtattctgaggtgctctccggctctgtaaataaacaaccacatgctgtaggct

SEQ ID NO: 139795 - DNA, 329 bp, Homo sapiens
tatatcatgcttgttggctgactacacaggaaagagtctgcattattttagatttgagaggagaaaaattacttggtcccacattctgaccaacagaatccagaggatcagagaaacaaggtcatccgcaatttatgttgactcttaatacttccaaataggtgcttgtcaacatttgtagaactgctgaatcatggaatttcagtgcaaaaggaaactgattcattcacctccttcagtccccaattccaacacttgaatccctagatcgctgctttaattttgcagatggtatcctctgagttaatttagcaatgtatgatattgct

SEQ ID NO: 139796 - DNA, 280 bp, Homo sapiens
aaaaaatccctctgttttcatcattttctgcccaactgatttctccccctctattttcccatgcaagcatcctctgggctaggtttggtggccactccattataatgccagtgcagcttttggggactgtggcaggtgcctggcccatctttacgtggaaacagcggtatctaaataaacctgacacatggaggaagaaatgaacctaaatgcaaatgctattaacatttctgcaagtcatacctatccccaagaagcatagctctcatgtttcttagtc

SEQ ID NO: 139797 - DNA, 406 bp, Homo sapiens
gtccttataggagggagggaagagactcggagtcagaggatgagacgtgatgatggaagcagaggttggaattgtgccatttctggaagggaacgcaagccaaggaatgtgggtggcctctagaaaaggtaagaaacagattgtcccctagagcctccagaaggaaggcagccctgctgacacctcgatttcagccccggaagacctgctgttcagaatgttgacatctagaagtataagataataaatgtgtgccattttaggccaggaaatttgtggtaatttgttacagcagcaataagaaacactagatcagcaaggataagaaacgcctggttaatcccagatggaaggagtagactgtagccaaaagcttgggtgacaggggccctctcggatgtttctg

SEQ ID NO: 139798 - DNA, 157 bp, Homo sapiens
gcagattttattgcttcaatgtaaggttctaaatataggaatttagagttactgatggagcagctttttccttttaaaaaatctgggcctgtggtagtagattgaaagtccagattaaacctgtgtgaggtggggttttttccctttagaatgtttg

SEQ ID NO: 139799 - DNA, 501 bp, Homo sapiens
gacggggttttgctatgttggccaggctggtcttgaactcctggcctcaagtgcccacccacctcagccttccaaagtgctgggattacaggcatgtgccactgcacccagccttctcagcacttttctacgtgaaaagttattatacacattttaagtgaaggttgttgaagatgcgaggtgttttgtttttgttttttctcttgtggctagcaaaaggtatgtgagatactgagaagcagcgaggagtcctaaggactcaagggttaatccgacaatcaggagagaaatcccacatttaacaaatactagataaacaccgatcataggtggaaacttgggctaggtgtcagggacttaaggatgaatgaagacagtgcccatcctcccatttaaaacatgtactatactatactattaggtgattaaagccgctacattgaaaaaatacattcttgctatgggggctcagaggaagaagcaatcgattcttatttgagc

SEQ ID NO: 139800 - DNA, 330 bp, Homo sapiens
tttaattaaaggtttccccctttgatatctacacattctaggggtagctgacatctgtgttcttaataacaacaaacagttcttgccaccaaaaagaagcaaataacatctagtacctgtgggcagttggctaagaggctgtggtattttttgtgtgtatttgctttctacctggggatcagagcaggcctggaataaatgtcgttggtgttgtccactgcaaggcttcaggaggacatagacaaagatcagcctactgagcagagagtggtccaggtattgaatggactcaatatcctagaaggactcacattctagcaggcacttttt

SEQ ID NO: 139801 - DNA, 238 bp, Homo sapiens
tactcaggaggctgaagcaggagaatcacttgaaacaggaaggcggaggttgcagtgagccgagatagcaccaccgcactccaggctgggcgaaagagtgaaactccatgttaaaaaaaaaaaaaaaatcagcctgctgtccataatcatgtaattaaaaaatagggcttacggaaaaagtaggattggggtacaaaatcaaaaatgttgtcagtggctcagtgaaaaaagggatggt

SEQ ID NO: 139802 - DNA, 486 bp, Homo sapiens
ggtgtcaaaagtgtgtatgggaggctgctattaatattgtaggtaatccattccttactgtgtaggaccatcatgtccttctgcaagacatcgagcatacctactaaatgctgatagcatccagcagttcagtgtgtcaccccaaaatgtccccaagaattcccaaatgccctctggggtgtgggtggtatcactctggttgagaaccactgctttagggatttattcttttattcacataaagtaattggcttttcctgtgcatttcatttgagatgaatcttcgtgtgcagcattggttccatctcacctgaaacagaccatgggatcttccaggacatctgtttcctctgttacacattgctgcaagaagcaaaacttgtttctgctttggagcctttgagtaaggtctaagcagcttttgctcttctgttgcaagattggaagggtaacgattttggtgcacaattaattagatgcctggaa

SEQ ID NO: 139803 - DNA, 205 bp, Homo sapiens
gtgggagcaggcacatcacatggcgaaagcagaagcaagagacagaaagtgagatgccgttcctttaaacagccagatctccagagaaccactcactatatggtgaagacagcactaacagcatggtgctaaagcattcgtgagaaaccctcccacgtgatccagtcacctgccaccaggctcctcctctgacaccgagtatcac

SEQ ID NO: 139804 - DNA, 277 bp, Homo sapiens
agatctgtggggaatagtatgactgtatatgctggtattaaggaattggggaggttaagagggaggagagagagatggaatttagaggctgattcctactctttgcatctttggtcttaacttcattgcctagtataggaagcacaagtccaaccttaaaatattaacacgtatcctggccaaattgagaagtgggtagagttggccttctagtacctcctatagggctggtacctctccactctgccactgaatgtcaggcatcatgtatttctgg

SEQ ID NO: 139805 - DNA, 125 bp, Homo sapiens
agatccccttcctcccccaaaataaaaggaaaagtggaaggattatattcacccaatttagagagagaatagttgttcattacctattgatttgttcattcctcatttagcgatgagacttaata

SEQ ID NO: 139806 - DNA, 360 bp, Homo sapiens
  misc_feature (357)..(357): n is a, c, g, or t
tctatttgtgaccaacatctaatatctataaagagttttactatagggctcaatgtaacaaattctaaacgtattctaccatttttgtttcttttcagggaatttgaacaagagatcagattcatggcagaagaatcacctcccaggttttattctgcttgaaccccgtggaaagctaatgattttgacatgaatcttctcctgtcttggatagccttataagattcttttccttttaaagtaaagtgcttttgattacagatgcccgccaccacacccatttttgtatttttagtagagacgggggtttcaccatgttggccagggtggtctgaaactcctgacctcgtgatccgnctg

SEQ ID NO: 139807 - DNA, 104 bp, Homo sapiens
  misc_feature (97)..(97): n is a, c, g, or t
aatgtttgttttggagaacctctactggcacatggagtcttcgagtacagcaaagaaagaaatatcagtatctccagagaaacaaaggagccataanaatccag

SEQ ID NO: 139808 - DNA, 436 bp, Homo sapiens
ttccatagccactcagctatgggctgctcatcctccctggatgaccaagtccagaactctatgtgggtataacatggagcaacccatgttagatggtggtgccccaggggcctgagcacgtatggatgtgtaggccgtggatctaagaggagtttgtggagccagcattctggggcattttcaggttaatacctgagagttagcagtctgatcttagatcacaaatcaaaatgggacaagcaagaaggggcatcaaaatttgaagccaggaggaggcagagccaagggaaactgctgtgaagggaaggttgatagcaatgtttgggagatatgtcctagaagtgtttcctaatggtcaacattctacttgataagcctagagatttcatcctaaacctagtaaatcagaatttgcaaaagagcagcttgggaacct

SEQ ID NO: 139809 - DNA, 724 bp, Homo sapiens
agttattcaaaatgtcttctggtttccaatatcttccttcttcaatccaaactctatattgctgctagagttatctaacatgtgagtttcatcaatcaccctccttaatatcttttagtgacttccagcggctaaacagactttgaataaaatccagacatcttgtggtggtaaacaaagcctttctttttttctttttttttttttttgagacggagtctctctctgtcacccaggctggagcacaatggcactatctcagctcaccacaccctccacctcccaggttcaagcaattttcctgcctcagcctcctgagtagctgggattacaggcatgcaccaccatgcccagctaaatttttttgtattttcagtagagacagggtttcaccatgtcagccaggctggtcttgaacttctgacctcgaatgatccacctgcctcaacctcccaaagtgctgggattacaggcatgagccaccacatccggcccgggcatggctttctataagtacctagagcatattatctagctagaggtatgtacttcttcagaggttagtcaaaaatgaaataatacttggtctttggttgctcttgtagacacagctattctgttgtctcctaaatgtgtatagctaataacctcaaatatggttccttttggtgtaactatgtaagctattagaaatactatcatggacgtagattagccacacctg

SEQ ID NO: 139810 - DNA, 329 bp, Homo sapiens
gaaaattggcactaggttcttttatacattttaactgtactggactacagcgtaagtttcagaaattttacttctattttttgaaggtacatagtgtaactgcttaagatcaatttggatttcattttcatcgtaaaaatgtcttgataaattccatacactgtagaataagcctttcactaaggctggcatcaacataaatgcagttattgcatatctggcaaaaagaggtcattaacagaaaaaaatgactagccattcaatgagacaaataaaaatacaaaaagttataatctcatttggtaacacattatttactatgaacagaa

SEQ ID NO: 139811 - DNA, 771 bp, Homo sapiens
tccaaaatgtttttgacttctctgagaaacttctgcccacatccacttttgtatcagtcattcttcctggctgcctttagtagatcattatacagataaaatgctaaagtatagaggacattcagggtaggaacaaatatggcggatatttactgaaatccagttatgtgccagatgttatgctataggttttaattgattttgtagatttttctatttttacaacagttaggttattttaacataatattaatatcaattattagcacctacaatgtgttggacatagtgctgttttatatttatacatgttatataattaccacaagtaatctgtaatgtattattcttattttataaataagaaacaagatttcagaaaagttaaataatgtatttaagttacatgataatttttaaattactgaggacaaaagctagaatgtgcaaacttttaaaggtttggatgtctacagaatgattatctataacactacaattaagtaatcacaagaagacatttagtgactgtagatctattggttacatggttgtattattattgttctttttgttttttgagacagggtctatctctgttgcccaggttagagtgcagtggcgtgatcttggctcactgcaacctctgcctccaaggctcaagcaatcctaccacgtcagcctccccagtagctgggactacaggcacacgccaccacacctagctaacttttgtattttttagagagacagagtttccgccatgttgcc

SEQ ID NO: 139812 - DNA, 254 bp, Homo sapiens
taatacataatgataggataatacgtaactcttaagtaacagctgacaaagtttttaagaattctcaaatatttaagataaaacaaatatgttaaaaggataacgatatgaataaaactaacttcaaaatatatattttgaggaaaataattcaagaggatgttcaagtctcatataataagcaaaaaaaaaaaaagaaagaaaatggggagtccataatatgaaaggaagaagagaaaaacaagtgtcatcaa

SEQ ID NO: 139813 - DNA, 1018 bp, Homo sapiens
actctgtcgcccaggctggagtgcagtggcgcgatctcagctcactgcaacctctgcctcccgggttcaggagatactcctgcctcagcctccagagtagtgggattacaggcatgagccaccgcgcccggccgacactcacttctgaaatggaaacactcagccccaactgggaaggtaaaacagaacagcacagaacgtgtttacttatgtaattaggaagtcagaagggtgctaccttcaggtgtaagcagttccaggagctcaggtgcaatcattagggctccgctttcatctacctctctgccctgttttcccaaactgggttcattctcaggctgggtcctccagagactggcaagacagccctatgagctctgggtccccatcttgctaccttcagaactagggagagaagagtttctctttctcagcagttctcataaatcctcttctactgagttttgctggttccagatgcccatccctgaattacctgctgggttgggaggccgatgttctgactggccaggcctgggccatgtgctctctcctggagcctgtggccaggcctaaccctgcttctagccacatttcatggactgagtgtggcagagggatgggtaccgcaaaaaactatggggatgttaaccagaaggggaatggctgcctgattggcaaaaacagcagaaagcctccatccggccagctggttccattcgaggccacagggccaaggttgcttggaggcttgcagtgcctccgttggctcaccctctgctcccggaaaaagcatctcaaagcacagatccaactgagggcctgctggagacaccctgatgtgcaaagagtagccagggactccaagggaagactgggattgtatctcgtccacctggcagaaatgccccatgcacagtgcatcaagacagctgcatagaaaacagtatggcagttcctcaaaaaattaaacatcgaattaccatatggtccagcaattccacttctggggtatata

SEQ ID NO: 139814 - DNA, 959 bp, Homo sapiens
ttagaggtgcccgccactgcgcccagctaatttttgcagtttgagaccagcctggtcaacatggtgaaaccccatctctactaaaaatacaaaaattacctgggtgcggtggcaggtgcctataatcccagctactcgggaggctcaggcaggagaattgcttgaacgtgggaggcagaggttgcagtgagccaagattgtgccactgcactccagcctgagtgacagagcaagactctgtctcggaaaaaaagaaagaaagagaaagagagagagaaaagaaaggaagaaaaggaagaaagaatgaaagaacaaacaaaagaaagacaggagggaaaataggcactacagattgttcacaattccctaactccatttaatataaggattttgatttctccttttcactgaaaaactatcctactgttctttggtggccaatgataacaaacttagtttatagctactataactgaggtttgggaaatcttcaatacttcacatatgtatagatgctggcagtgtatcaaattctagtttctagtctttagttctttaaaaactctttagtcactttgttattcttacatttcatttgtgataattgattaacatgtttgtatttgaagacattaatcacaatttagaatatataaggagcacacagatactactctgtatcttttagatttccttatacctatgaaagatgttattcagaattcaatatgttcatttaagtttgatataaatatttttctgaaaagaaagaattgagccataaatgaattgttgtgggatatgctgtttggtcctttgggctcaaggcttaatattaataagactcctgaactgagccaggaatccccaggtctagccctaattggctttgtaaccatgagcaaattcatttatctttgcatccttataaaatgtcctacacaaaaaatgttattttt

SEQ ID NO: 139815 - DNA, 182 bp, Homo sapiens
ctagaggatccccattgaccggcttccatttcaccggctatgtgctattaaataagtagcaccttgcgaataatagtctgcttccattatttttgtatattagtaatcaagcagattaaatacttcctaggaattatggttatttgttttacttcaaaaacaatgttgatttaaagtacact

SEQ ID NO: 139816 - DNA, 367 bp, Homo sapiens
ttcaccctcatgggatctgatctcaacttggcttccctgtgagaagaaaaacatggcagcaaaaacaagtatgatcttgtataccagcaatgggcacatcaagaaattatatagggcctaagcaggtacctgaactgaggtttgctccacaatgcagtcacagtaagggagaatgagggctcctcagtctctcaccttcccataaggaaatgtacccttctctaatcctaaagaggatttggttcacacagcttcatcctcatgctgcaaaggagtccaagaactcaagcagctgcactaagtgagattcaccacagccaagggtactctcattcaccacatgggagacttaagcatgcatgtgttc

SEQ ID NO: 139817 - DNA, 229 bp, Homo sapiens
cgtgatgcatagccgtcgtcatctgaaaggccggagtataaggaatcagaatgcataagctgaggtgagtgccagccccctgtttcacgtcatgcttatccgaggggcctgccaaagagtgcagatttgtacccaggtgaccaggctccaacgacatcctgcatactcggcggcacctccgcacctggcgagccttgcttccctgctgtccagacctcagactaccctt

SEQ ID NO: 139818 - DNA, 293 bp, Homo sapiens
tccttatctgtcctttttctgttgtgtcccacatctgatcagttaccaactattatcatgtctacttctaaatttcactctaatccattcctttctctctgtcctcagtgttctgattcttacactctgttggtctaacagtctcctgtgttacccaatgtttgtgaaatctctgtgttgatagagctgagaaacacagagatgtgctgcctcaccatccaccctttcctccccagtccattctcacattctagccagagagaaatttctaaaggcaaatcttgaccatgcta

SEQ ID NO: 139819 - DNA, 116 bp, Homo sapiens
ggccagagggagggaggagccaggagccccagatcctcattagctctttgctaagcaatccagaaagaacaaaaagatcagttggccaaatttggtaatccaggtgagatcatgat

SEQ ID NO: 139820 - DNA, 532 bp, Homo sapiens
tgttgcacctgttctactaaaacaaagaaatgagtcaacggcctcttttagctttaacattctctctgtctatacatttttatagaataatttttagttattgcagcaggtttcaccagtcagccaacgggtgtgtataacattaatcactagcactacacctcagaagtcttgcttattaagagcactcagcttaagtgaagaaattaaagaattttggtaggcctttgggacagttcaagtttaggttgtttgcgctcgggttgagagagtaaaaaactaacatttcttaacctaaccctttttctttctttctcacaggtaacaactatccaatagcttacctttaaaatgtcccctctattgttcctccctcagacatttttgatcacttgtcccagtttccatgagtcctgtatcacagctgtcacaatgcttgagctatttaggtggaggtaactttcagaaatgaactgctgaagggtgcagagtgctcaagaattagattaacaaagaaagtacacctaaattt

SEQ ID NO: 139821 - DNA, 422 bp, Homo sapiens
  misc_feature (411)..(411): n is a, c, g, or t
tgttgcacctgttctactaaaacaaagaaatgagtcaacggcctcttttagctttaacattctctctgtctatacatttttatagaataatttttagttattgcagcaggtttcaccagtcagccaacgggtgtgtataacattaatcactagcactacacctcagaagtcttgcttattaagagcactcagcttaagtgaagaaattaaagaattttggtaggcctttgggacagttcaagtttaggttgtttgcgctcgggttgagagagtaaaaaactaacatttcttaacctaaccctttttctttctttctcacaggtaacaactatccaatagcttacctttaaaatgtcccctctattgttcctccctcagacatttttgatcactaacccgagcgcaccaggnccgagcgtgac

SEQ ID NO: 139822 - DNA, 418 bp, Homo sapiens
tgtcgggcacaggggatatgtgaccttatagcatcttcctgacagcccaggtaaggaaagcattattatagaaaaggaagctgagttataggaaatttaagcaatttgtccatggcccacagctgttacatggtggctgagctaccaaatacctgattccagggcccaaactctccctgcccctcattttgctttctcattctcttcctctccccatttctgttctcttaggcctgtgaatgggcattccttcctcctcaaagcttagctgggctcttacaccaaggttgctagccctggacctgataggagtgaggtggtctaagagctagagaaggacattttgatagtttatgacttcagaaaagtccctgagtgacccttggacgtgttctaccccaagtcagcagtatttcct

SEQ ID NO: 139823 - DNA, 161 bp, Homo sapiens
gggcttctaggtgatattcatttttttcctcttagagaataggggatgtaaagaccatatcagaacctctgcaggtgcacataaatgtttttgttcaaataaataaaggtaataatggcagataagaaattcaaacattttgttttaagcaagatggtatt

SEQ ID NO: 139824 - DNA, 662 bp, Homo sapiens
ttcttgtcttttccataatgctccatatactacccattaaagactgccaaattccatgtaatagattttcctcagacaatttctgcttcccactggtgtggcaggtgccccaacctcagaatcgtcgccctggttttaccacttggagctgttgtagactaattcactgagggagagaaaaattggattccttcaggctaatcccttcatggaaattaaaacttggcactcagaaagaggatttatatttttctaccagcttcaaggttcactaccaaagggatttccctctccttccttcattttcctcaaaatctctagccttgtctgtcacttatttctgtttcataagtagcatgagacaaagggccagtgacaagtttttccttccctgctcatcctcctagagctacagagtccacacagggaggcagagagagagaacccaaacacgcacagacctaccaaccaatctccactcaccacatctgcctccaggccatttatttcattatagcacaggatgctcaagagaactcagggagggggacaatttcatttttcctacactttggaaattaaaattatttccaaaaaataatgtgctttgttcttcaagaaagctgaggagaagagaaaagaggtcaaaggagtaagaggta

SEQ ID NO: 139825 - DNA, 333 bp, Homo sapiens
cccacagaaccatacaacacagaaagtaaatcctaatgtaatctgtggactttagctaatgataaagtaccaatattggtttctcaactgtaaattgtatcactaatgaaagttggtaatagagaaaactgtggtatgggggcacacataggaactctctatactttctgtgcaattttctctgtaaatgtgaacacattcttaaaaaataaaacctatttaagaaaataaacacatcatttccctttccagggactggcttaaaaatggtctaatgaaatgtcaaaagagttctcctgtggagcttcggagaagtttccttaccctttaaaa

SEQ ID NO: 139826 - DNA, 392 bp, Homo sapiens
taactgcaactggggaagagtcagcgtaggcccttctctaaatgggccttagcccagggaagtcatagggtcccaaactatcacactgtgtggcagggcacatcaccaacaacgtcaaggtagaaaggaggctttttccctcagagggtgtgtgtgtgtgtgtgtgtgtgtgtgtgtgtgtgtgtgtgttgcggggtgggctggaagacattcctcaatcaactattgttcttccctacctatgcagaaaagacccacaaccatggtcgtgaacaaagcaaacacctctacactctacagccattggtgtgcatattacgaacatgattgcctagctttctacatcatttgcaatgcagggcaaaaagtacttgttagtttttttcatctag

SEQ ID NO: 139827 - DNA, 287 bp, Homo sapiens
gaggcctgctctattcagctggagtcttctatcaccctcacgaccaccctgcctattcattccttctcatcaggcccagcctttagtgcccttggtcattgccagagctcccgcctggccagcactcccccagtgagacccaagtccccagaatcaatcctcaagtgacactgaatctttgcaccagctgatgctgactcatggccctagctttgactagacagctgctctgtttcaagccctaacacccgccgggtgtcccacgtcttatgctacagggtcccgca

SEQ ID NO: 139828 - DNA, 218 bp, Homo sapiens
gaaaaacaagaaatagaaaaaaaggaagaaggctgaactaaagcactaattttataggtttagttttgtcagaatttaggacatttggaatcctaacattaaaagggaatttatagatgtctgttcataccttgtacaggaattctttgtacagcatccctgtggaagggcattttaacccacattcaattccttcagtcctaagaaccagctccaag

SEQ ID NO: 139829 - DNA, 303 bp, Homo sapiens
cagaaccaaggctggggctaagccttacatttcacatcagaatagatccaacggaaccagacacagacacaagagaaaaataaaagcatgagctcatttgtaaacatatgtgcttcagggagagatctcaggatggcactaaactgagagtcttttaaagaaagatggatacatctgcttatgtaaaaattaaaaatacggctgggcgtggtggctcatgcctgtagccccagcactttgggaggccaaggcggtaagatcactcgagccaggagtttgagacctgcctgggcaacaaagtga

SEQ ID NO: 139830 - DNA, 394 bp, Homo sapiens
ttgatccatcggcaaattctgatgcctcaacactcaaaatatacccagaatctggccatttctcaccactccactgctatcatccagtcaaagccaccatcacaccttaccctggactacggcaacagccttctaactcatctttttcactgtcttcaatctattcccatcaatagctacagtgatccaattaaaaagtaaattgaaacatatttctccactcaaaactcttcaagagcttctcttctcatttagagtaaaagccaagccctctggatgacctagaagacatataactagtgtcacatttcctttctgacctcaattcctactactcttcttgctcatttcaccccactcatatcaactccctgctattcttcaaacatgccag

SEQ ID NO: 139831 - DNA, 508 bp, Homo sapiens
ccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctgaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgc

SEQ ID NO: 139832 - DNA, 282 bp, Homo sapiens
agaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgc

SEQ ID NO: 139833 - DNA, 303 bp, Homo sapiens
tgcttcctcaattttcttttttcaaattggcctattttctttgcctttttattctaccttcttggagatttacttgatttatcttccaattcttctattaaatgttttattttacttatcatgttgctaatttcaagtttttttcattgaaaatttttttctggttctcaatcataagagtcttttctggatatctcaattattttttgtttgtttgtctttagtctccctagttccctacactagctttgtctcctctaagccctctgttctgtgtggttttttttggtccctgatattcag

SEQ ID NO: 139834 - DNA, 138 bp, Homo sapiens
tacaccatgctctgaaactcagccatggttttgcacgtgttcccattccctggggtgctctcctcactgctctttctggcaaacccttgcccaacatacaagtctcatattaagagttaactgtttaatggggccctc

SEQ ID NO: 139835 - DNA, 192 bp, Homo sapiens
cctaggttttcagttcatggaaaggattggaggaaggtgggacaaaaaccagagaccaatttggaagctgtggtctaggacaaagatgatgataaactaaacatggtggtaccagtggagatgagaaggggttagattggagatctattttgtatttagaacaaaaattgcacagggattcaagatgagaag

SEQ ID NO: 139836 - DNA, 395 bp, Homo sapiens
tagacagatgacccttaaggacataatgttgagagaataaagcaagttgcaaagaatgcatacagtttggttctgtttataagaaatttgaaacattcaaaactaaatgatagtcaaggaacataaatatatgtgataaaactaaaaagggaaataataaactcagcaataagaatagtgttcaggggaaaggggatgggatcaggaaaggacgcaaaatttaaatttaaaaacaaagcagggtgcagtggcttgctcctgtaatcccagctactctggaagctgaggtgagaggattgttaagagtctgagaccagcatgggcaacacggtgagaccctgtctctaaaaattagctagtgtagtggcatgtacctgtagcctcaggtatttagg

SEQ ID NO: 139837 - DNA, 253 bp, Homo sapiens
cattgttttgtcatcatagcccttgtcgtcatttgtttctgaagtcaccataactaatgacctcagagaggctcctcctagtttatttttaagaggcgaggaagtagttccagcagtatgacaggtcctcagtgaccgatcacagtgaacagcaaactcttggagccctcttgggcctgtgctttgaggcccctgcctgccctggcatttctgggaccctgtgggttatcaggcctgaggcttctggacatcc

SEQ ID NO: 139838 - DNA, 367 bp, Homo sapiens
cgacaagtgcattctctgcacctgggtcctgggtggagaaggccaggggtggctggattccaggtgtgtctgctgccaggcaggccagagtcccagcgaggccagtgtgtgaggagaggccacctctgagagtggccctgaccctgggattgctgtgtagaccagggcaggcctgcgagccaaggcagcacagctcacccatgggccggaaagcagggccaggtatgagtcaggctgtggtttcggtgacaagggctgtctcggttgcccccacactgcaccccacaagtacttccggatgtggaacaggatgtgaaggagctgaggcacgcaaggactgtcgggctctgtcccagagatgtgcacg

SEQ ID NO: 139839 - DNA, 242 bp, Homo sapiens
ttaagtaaaaccttattatgaaaagagaagtctactcagcatagtcctgttttaggatagaatacttaattttcatttagctgactttatttcattttggctctactagcctttgtccgttatcagttaacacactcaaacatgtatactggaattaaacagaatttggcatgaagcataactgcttagaattcactccatgggcttttaatattaaaagtacaaaagcaactcactgtaac

SEQ ID NO: 139840 - DNA, 503 bp, Homo sapiens
ggtaaccctagttgagaagttcaatagcagaaattttctatatgtaatatcaataaaaaccctttaaaaaaaacaccacatatctgataaaggattcatatcaaggtatataaggaaagcttacaacttaataagacaatcaggctgggtgtgatggctcatgcctgtaattccagcactttgggaggtggaggcaggcggatcacttgaggccagaccagcctggccaacatggcgaaagcctgtctgtactacaaatacaaaaatgagctgggcatggtgccgtgcgcctgtaaccccagctactctggaggctgaagaggagaattacttgaacctgggaagctgaggttgcagtgagccgaggtcacaccactccatcttgggcgacagagtgagattccgtctcggggccggcggagggaggaaggttttgagactaagaataaactgtttctttccccaccaaccaggcaaatgctagctgatactgtaagcttaga

SEQ ID NO: 139841 - DNA, 308 bp, Homo sapiens
cagcatccctgacagcaagtgttgttaaacatccacgtgggttgctaaggaaggttagggaatctccctttcccagaagtctttaaaaataggataacatctgtttggatgggataatggtggtactgcttgacttggcagcttcttaagcaaacctatggtttggtaattctaccatttctatttctgatttgaaaagtaacaaataacttcagttcacctagaaaattgggccttataatgacttgtaatattgtcttataaaactattttcattgtcattaatagtgcaaaggtagataattgag

SEQ ID NO: 139842 - DNA, 276 bp, Homo sapiens
ccttagatgccaggtagacggccagtcaaggtacagtgtcctcatcctcccgttttcaatgcctcctttctccttaagagcttgtctctaccagagtgcaggaacttgagaagtaggtgtttagaaaacccacaatgaatattcctcctgggagcagagatgaggcacagtttgtttggttctgttgtggcctttacatgcacaaggatgctgggacagagctgctgtctgtggtgtttccagttctctgtcactgaatccctgtcactcagggcc

SEQ ID NO: 139843 - DNA, 439 bp, Homo sapiens
ctgacctcaggtgatctactcacctcggcctcccagagtgctgggattacaggtgtgagccaccatgctggcaagaggtcatttattaactgccaaagaccattctggtgttagcaatgtttggaacaggtgcttggagttgagggtatctgccatctcctgtacacttgtgctggtcaaatgcaatgagctcagcctttctctggtgtagggtgtaccgagtcccagtttaaaggacctcatttctggggtctcccatacgcgcatgattccatccttcacacccagagaaggcagggtatttccatggctttggtgcacactcagtggccagaagctttgagtatcctttatcacactaaagttggcctcaatctcaatctctctctctctctcaatctctctctctctctctctctctcacacacacacacacaca

SEQ ID NO: 139844 - DNA, 234 bp, Homo sapiens
gatgaggtccccactctaatggcctcatttgaacttaatcgcctctttgaagaccttatctctaaatagcactacagtctgtgctactggggattggttcttcaacatgtgaattttggaggggaacacagttcagccattaacagttggtaattaagaaggaaaacaagtgatttgtaagaattacttttttctcttttatttaataaggtttgtgtagaagtgcaattgtta

SEQ ID NO: 139845 - DNA, 205 bp, Homo sapiens
aggggatagcacctatgaaagctcttatgggaggactgatgggttagggaaatccacctgggccttagaagggattggagctggggattggagccttcttaaggttagaaggttaaagaaagtagtgctaataaatttcagatcctgaaatgttagaactggaaggggccttaatgattatcccgcacaaccccccatgttatta

SEQ ID NO: 139846 - DNA, 209 bp, Homo sapiens
cctgggttaagccagttaattatgtcatgaggcagctttaaggaaacggccatatgttgaggaacttagccccaccagcaaccatgtgagcaaatttggaagctgatctctccacctgtaattgaaccttcagatgaaactgtagcccctgctaagagcttgactacaattcatgagcgacctcgagccagaggcacccagctaagcaa

SEQ ID NO: 139847 - DNA, 407 bp, Homo sapiens
gattatatatccaggcttgacactatcttggttcaggcatcaggggggggtcttagaatgtattctcctgaggataaaggagaaccactgtatctaagaagcataacagttttaaagtcagctaatacaagaggagtaaaataaaaatggattcatttaaaatcagataaaattcagagcagaaaaaaatttgtttgattttgtctcagttatttgagtttgagatttccagtaaaaaatgacctagaatcctatgactatttctattggtccacaatccaaatttccagattgttcagtctactaagcttcaaccaaatcatattacctctcagagcagtagaaaccagatcaattaggacaaattctagaggaaacctcatcacacttccctcgaaaaaaaaaaa

SEQ ID NO: 139848 - DNA, 1003 bp, Homo sapiens
tagttaggaagctataatccaaatgagaagtgggaagggccaaactaaagtgataggtagggaaggaaagtaaacagataaaagctggacttggtaagtggcaaggaaacatagagggatgacttccagatccaagtgggtggatggttcgtgccttcatcaaggagagaaccaaaggaaaaggcacttactcgatgactgggaagaggataagtttttgggggcatggagtctgtgagattttaagataatgttggggcctccgctcatgaagtgctaagaccagcatgaaaaattttggtttgggtattcattatagagtttgacaaggcagataaagcacagcagcatatttattgattagaaattagcaaaaatgaaaaactgcctgcagatcatcttttttttcaagatcagaaaacagaggcaagtttagtattgatattttaacatccttggcaaaatcaatcttaacttctctgtttggaaactttagaagtgagtttcagtacaataaaatgtaattattttccttgaagtttcaaaaagcatttatagtttttaataacatttccattgcgtgttgccctttgagccaccacttttcttttcaattaactgttgttgttagtttttctccccctacatacccatatcctaaagttggtatctaccatttccctaaatgtttttatatttctatcacatgtgcacatatccctgaaattatatataaatttgttgaagtatcatgctgtacatatccttctccaacttgcttcattcacctcagtgtttttttaagatagatctatgttgaaacatgcaaaatatagtacagtagtcctcattatttgtgtcttctatatttgtgaatttgcctacgcgctcaaatgtactggtaaccccaaagtcaatactttaaacaagttcctttttggcaagtccattttggtggaaaccattgcccaagggaggggcaaaaacaaattacacggtttaa

SEQ ID NO: 139849 - DNA, 717 bp, Homo sapiens
ctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaacgggctgtcaggtggccgcggcggccggcgtgcgagggaccggatgcccaagccgggcggatttggaacccggatagctggtaatcgtggcttgttttgcttcgttttcttttccagcaacgaaggttttgggaacagtaaaatggttcagtgtaaggaacggatatggtttcatcaacaggaatgacaccaaggaagatgtatttgtacaccagactgccataaagaagaataaccccaggaagtaccttcgcagtgtaggacgatggagagactgtggagtttgatgttgttgaaggagaaaagggtgcggaggcagcaaatgttacaggtcctggtggtgttccagttcaaggcagtaacatatgcagcagaccgtaaccattatagacgctatccacgtcgtagggtcctccacgcaattaccagcaaaattaccagaatagtgagagtggggaaa

SEQ ID NO: 139850 - DNA, 406 bp, Homo sapiens
gaagcggtggcccgggcggcctcacatcggcggcgcctgccggcggggacaagaaggtcatcgcaacgaaggttttgggaacagtaaaatggttcagtgtaaggaacggatatggtttcatcaacaggaatgacaccaaggaagatgtatttgtacaccagactgccataaagaagaataaccccaggaagtaccttcgcagtgtaggacgatggagagactgtggagtttgatgttgttgaaggagaaaagggtgcggaggcagcaaatgttacaggtcctggtggtgttccagttcaaggcagtaacatatgcagcagaccgtaaccattatagacgctatccacgtcgtagggtcctccacgcaattaccagcaaaattaccagaatagtgagagtggggaaa

SEQ ID NO: 139851 - DNA, 364 bp, Homo sapiens
gatttatactcttcctggtgaactgaaccttttattattatgaaattttccttttaaagactttttgactaaaagtctgtattttctgatatatattgtttttctttaatttttttctgaatacagaatgtgagggcatctttgcttaatttttacatggctttttttcttccttttatttgtaatcattttacatcatttatggtgcatttctctttttgagacggagtctatctgtcgccaggctggagtgcagtggcgcaatctcagctcactgcaacctccgtctccagggttcaagcaattctgtctcagccttcctagtagctgggattacaggcgcatgccaccacgcccggctaat

SEQ ID NO: 139852 - DNA, 530 bp, Homo sapiens
ccaataaacgttggttgaattaaattgttagaatttccaagatggcccccagtgagccccacttcctgatattcacagccttgtgtaatgccctccctgtcagtgtgggctgacgcttctgatgaattgagtaagggggaataaactaggttacaaaaggcagtgtggccacttatgatctctttctgtctggactactcacgctgggagaagccagttctacattgtgagcaaccctatggagaagcccttaagttgctgaagcctccagccaacagccatgtcgctgattttggaaggcgattttggaagcttatctcccagaccaaatcaagcctcaggtgactgcagccccagctgaaacattgattgcattcttatgagaaaccctaaaaccagagccatcagctcccaaattcctgacccacagaaactgtgaaataataatgtttgttgttttaacctgttcatttttggaggtaatttgttacccggcattaggtaatgaatatactggccaattaccacat

SEQ ID NO: 139853 - DNA, 479 bp, Homo sapiens
tgctagatgacaagttagtgggtgcagcgcaccagcatggcacatgtatacatatgttagccacatttcaagtgttcaatagccacatgtgctgagtggctaccatactgaacagcacagattagaaaatttccatttccatcatcacagagacctctattggacagtgctgtcttagagcaagtttgtatggcatgtataggtgaggttggcttggaatcagaactggggtttaagtgccaactacactcttcactaatttgtgatactggataaatcacaaccttgttgatgctcacttgccttatctataaaactgtgctactacctttcctatccatttcacaagattgttgggaagaacaaaaaagacaatgtatgagaaactaatgtgagaactacaaaatatattcacaagacagaattataagtttagagggatttttgattaaagtacaaattggtctcttcctacaaaa

SEQ ID NO: 139854 - DNA, 574 bp, Homo sapiens
gttattaatgtggaacagagttcttgccagctttgatccagccccccaagtctcggagttatggggcagggttgggggccagtgctacactgtaaaaaactcccagagtgctggggttataggcatgagccactgcgcctggctgtgatgatcttttaaattaataacagggtctcctccagttaaatcaggatctctgtgagtagggcccaggtattggtatttttttaaatgcttccaggattattctaatatgaatcaagggttaagaacactggtttgggctggggacagtggtgcacacctgtaatcccagcactttgggaggctgaggcgggaggatcgcttaagctcaggaattcaagaccagcctgggcaacaaagcaaaactctgtctctacaaaaaaaaaaaaaaaaaaaaaaattagccaagggggtggtgtactcctatagtcccagctactcgggaagcagagatgggacgatcacttgagcccagaaggttgaggctgtagtgagccaggactatgccactgcactccagcctgggtgacagaatgagaccctgtctcaa

SEQ ID NO: 139855 - DNA, 359 bp, Homo sapiens
gagtttcagagagctccactcctcaacacaggcagtcagcctttatggacagaaaacagaagtgaggtagggaagcaccttgattagttacagatcagccttgcctcgttggaacagtacctgatcccttggccgcctgggattatctgaagctgagctgccgtgattggctgagactcagcaacctgttacagactcacattcccaagttaggctttcacttagttcacatactaaattaggctgtagtttgttaactaaggactcagtcacagaggcatcctcaggccaaatatagttaaatttaacaacactatctacagcagtaccttctggccgcttctattctctcagatgga

SEQ ID NO: 139856 - DNA, 406 bp, Homo sapiens
tgggtgtgccttgccttcgggaggagggctcctgtttgctgggtgctgaggttgtgcacagagccaaaaactgtttgctaagtaagcaatggattgatgcttacataaacagattcagcctgcttttaagacacggtaccaccctgcaagagttaggactaagataagcgcgtgaaggattataacaaaacccctagtggggaaggaccacaaaacagagatacgcagggtgcagtggacttaaagacgcacacagtggagcagggaactgagtactgtgtgggtgatttcaggagaaactttataaggagcgtggttttgaacttattgttgaaggataggcacgtttttcacagaagaagataaagaacaggctttttatttaaatgaggtagcataagaaatg

SEQ ID NO: 139857 - DNA, 551 bp, Homo sapiens
cccgtctctgcttcctcaatggcaccttcaactctgtatcctcatatggcagaagggatagaagagcaaaagggggatgaacgctgtgtgctcacatggcggaagtgcagaagagcgaagaggtctgaacttgttccctccagccgtcttgtaaggcactaatccattcataagggtggacttaatcatccatgacaatcacttcccaaaagaccctacctcttaataccaccacaatgagaattaagttgcaacgttaattctagcgggacatattcaaaccatagcagtactcatattattacaactacactactagttgaactagtagttgtgggaatagcaatgattggatggggaaaacaagagtaaatggccaataccaacagatacatgagccaccgtgtctggcggtaaaactttttaaaaattttttaactctacattttagtgtgctcttgagaggtaggaacatttgatgttttatcccaaaaggggattcacaaaattaattttctctatatatgttttttaattgaggtaaaattcat

SEQ ID NO: 139858 - DNA, 521 bp, Homo sapiens
cccgtctctgcttcctcaatggcaccttcaactctgtatcctcatatggcagaagggatagaagagcaaaagggggatgaacgctgtgtgctcacatggcggaagtgcagaagagcgaagaggtctgaacttgttccctccagccgtcttgtaaggcactaatccattcataagggtggacttaatcatccatgacaatcacttcccaaaagaccctacctcttaataccaccacaatgagaattaagttgcaacgttaattctagcgggacatattcaaaccatagcagtactcatattattacaactacactactagttgaactagtagttgtgggaatagcaatgattggatggggaaaacaagagtaaatggccaataccaacagatacatgaaaaaatgctcagtctggacatggtggctcatgcctgtaatcccagcactttgggaggctgaggcaggcagattgcttgaggccaggagtttcagaccagcctggccaacatggtgaaaccccgt

SEQ ID NO: 139859 - DNA, 134 bp, Homo sapiens
gatgaccaagagtccagtgtgcacaatcctggctgtctccagaggcaaccctcgcatgtcatagcaatggaacatgaagaggtggagatcttttggagtgatcagagaaaggattaaaacattttaaaatgagt

SEQ ID NO: 139860 - DNA, 610 bp, Homo sapiens
ccatctttgatatcccagccagatgttctattcgataaatgaaactaatttactctgcaagcagcaggcaacagctgaatctgagacttcccagtcctcatccccttcccggtgggatggggccaggtggggggaatatgtgcatctggttacctgcccactcaaattaggtaaacaggttgcatagctgcacggagaggcaaaatatagacagactgatcaagagtgtgggttctggagccagacagcatgggttcaaatcttgccttttctacctgttactgtggactttggataagttacattttagagtaagtaaatggttgaacaaaacaagatttttttttgacatactaactctgtgccaaacacagtttgtggtactagggatacatccgtgaacaaaacagataataatccctgtctcggtggagcttagattgtctgagttcttcagctgtaaaaatgagatgacaatatattttatattttaggttgtggtgaggactaaacttgacagactcctagaacagtacctggtacccagtcaatgctcagtaaacactactaattactgttttactgtacacgtgatcatcattggatgtgt

SEQ ID NO: 139861 - DNA, 283 bp, Homo sapiens
tttcagccttggatcaaatgctgcatgagagacatgtaagagttttaatcatggagtgcagtagactagctgggacgtctgtgacagcttgatttcttccacatctcagatttccacagtgtaccccggtgttttctcaccttcagtcactcataggcatcttaggtgaggaagctgagaaccagatagattcatccagtgtcctaggacacacaggatagaacgcaaggatctcacttagcccagtggatggcagtcaattaatggagcgagtggcttagtc

SEQ ID NO: 139862 - DNA, 565 bp, Homo sapiens
cctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggg

SEQ ID NO: 139863 - DNA, 391 bp, Homo sapiens
ccatccatatgtgtagccaatggaatccagcttaggcagcatatggagacccgacatctaaaaaaattttatctttatttttatattatttatctctgagatggagtttcgctcttgttgcccaggctggagtacagtggcgcaatctcggctcactgcaacctccgcctcctgggttcaagcgattctcctgttttagcctccgaagtagctgggattataggcgcacgccaccacgcccggctaaccctagcagttttcatgtcgtagcaccccgctgccccactcaccatcctgtttgagtgtaaaatctagtggttatgtttaatttatccctttgtctcatcctccctcactgtacgctcagccaatccttgagcacactctaaat

SEQ ID NO: 139864 - DNA, 127 bp, Homo sapiens
atcctggaaacctgtacaaaaggttgagattgggcaaaagagagccagtgaagatacaacttcaggttcaccacccaagaaatcttcagcaggaccaaaaagagatgccaggcagatttataaccct

SEQ ID NO: 139865 - DNA, 178 bp, Homo sapiens
ccactaattagttttgctcttagacaaagagaaagcaaggctcaaagaccagagttttcagctgtctagcttaaattgactacctctacatgttcagtgtttatttttactcttatcttctatttacaacacatgacaatgactttccatttacagtcatgacacacagtttcttttt

SEQ ID NO: 139866 - DNA, 257 bp, Homo sapiens
ctgctattcagaaacactccaaagagaggcacttacttcctgattacacattcaaataaatgcataacatgcatttcaacttggaatcactttcttaagaaattaactagtagaaatcatgttactgcaacatcatggttgaagtcatgccaaaactaaaattttaatacctaaaataacttcctcagctacactgactgtacaaatatattaaggcagtaatattacccactgtaactcataaatattattatcct

SEQ ID NO: 139867 - DNA, 443 bp, Homo sapiens
aaaacagacttggaacagggaacggggaaggccttgaatgttactaaagcatttactttgttttctaaaggtagcagggttctgaagtagggaggtaagtgattaaaactaagaagagtataaagttaggcggtaagtgacaaactagatagggaaaacactagttatctattataatgatcctagggaaagatgacaaaggtcagaactagggcagtagagatggaatagaggaagcagatataataagagatgctgcaaaggtagaatgacaggacttggcaaatgattagacacaaggagggaaagtacagggataagattacgatgtcaccaaagattttaggaagggtttctaggagaaagactgtactttttaaaagcttccttttctgtccccatttgatttttggaaacagttcaaataagtaacaatcttctct

SEQ ID NO: 139868 - DNA, 801 bp, Homo sapiens
aaaaaaaaaaaagagttgattgatattgcaaaccaaaagcctctgttaagacagtataggaaactagtggtcaaattggggcctagcaatacattcagaagtcaaatgctacttttcattctttggcttgaaacaccatttcttccaggattgcagctaaagttttcatgcatttcttggggtgtcgggaatgcctccaagtgcatctttttgtagaaagtgatcatggaaaagccaggctctgacacactttgagtcctgtggattggagagaaacttcaaaattactcctcaacctgacgaccctagtgtataacttgctcagccacaggacaggcagtctttcttgattttatgtacatctttacaggggaattggattattcgttgtaaaaattcattgcagttttagcatttcactcaccatggagttcctggttttatcctactccactttttccagttgattgctttcttgagtccctagtaagtagttcgaatgcaaaagaagttggaaattttaagctaaaaacaagtaattttgaagaagaaaaaatcctgagaatttcattagaagtagttcttcaccagtagacaaccaatcaactgtaagttcaggcaggcggtcctgctgcatcagaaatgtttaaaggcctgtattcccagctactggggaagatggtttgaatccaggaattcaaggctgcagtgagctatgatcatgccactgcactccagtctgggcaacagagcaagacctctctaaaaacaaaaacaaaacacaaaacacacacaaaaaaa

SEQ ID NO: 139869 - DNA, 166 bp, Homo sapiens
ctggatccaattaacatgactcttgtggagtaatgataacagggcttgagtagcctggattacaccctgccccagaaatccaataacagaaggcgtgaagacaggaggtcatggacagtctagaggagcggaagagtctgtctgggggatgacttgggtgcttgtg

SEQ ID NO: 139870 - DNA, 340 bp, Homo sapiens
gggccagcggacactagtggaaggtggattcaggagagtatggagacagggacaccagctagggaggctactggtgatggggaagaaatcttaacccttcatctcatcgtagtacaatcaagtcatccctcagcaattactcctatgttaaatgtgatgaatacaacgtgttaaagacaaggcacctgtcctcaacggagctttaatctctactattagcctttactaacaaattacagtgcagtgcccttagcagcaaaattttctcgccaaagattcagtattgttagcttatttcataatgacctgtagtaagtcattagtactactggtcccctcc

SEQ ID NO: 139871 - DNA, 119 bp, Homo sapiens
tcattctttccacacacaagatttccccactgcccagttactctcacctttttattttcttgactgttatgttttacttgacgctggaatcttaccttgtactctcacatttacatgga

SEQ ID NO: 139872 - DNA, 519 bp, Homo sapiens
taggagccatatatcatgtccaggatgctttttttctctggggccagccccattctttttgccactggttggtttataagataaaaatttcagaagctcatcactccctgaataatatctgtgaccaagaataataaggaaggcatggtttgttactgtctttctttagaagaaaccctctttgcctcttttggctcagatattagaacattggttcaaataatggaaaaaaagagctcaccaaatcaaaggaggaaattaaatcaaggatagttataagtatccactgataagttatttttgatctgtggtcctttgccatttatttcctgccattgctggtggtgcgaggtcagttactctaaagggatagtaggctttagtttgttgtaaatcatggaaaacctcctagagggcagcaatcagtaggatatgagctgagttcttgctatttactgtggcatttacctcagtgagattccttacagagacagcattcatcaggacatattttccatt

SEQ ID NO: 139873 - DNA, 273 bp, Homo sapiens
taaggtatggagctagaggactaataccttactcgtacaactgtgtacgagtaagaactgaaactggcaacggtaaggaagaggcttttcaggaaagaggcccaaggaagtttagtatgactcagacaacaatatatgcagagcgcaggggacaaggtcaggcatgtattccatataattcatcaatttctacttcttaggtctaggctagcccttacccatgctctagggcccagcttaaaggacgacttcctgaccatccccttgccctcc

SEQ ID NO: 139874 - DNA, 470 bp, Homo sapiens
aggttcttttcactaaatttaatactatttccttagttctccaaactgatttattaacagcctatccaaaacactataataaaatgaactgctttaaatttggaggcaaggtaggggtgggatactgagtttcaataatcaggtttcttcattattcttttacctgaatgggctggccaccaggccacaattgtataaaaatcagattttaaatgatggaaaagcttttctgtgtggctactgaagggagaaaggaagacaactgagacatgccccaccttgctggctgggggctggtgacatctgtgggcctcagtgttggactccagatgcaacaaagcctaaagttttgaatatgtatgaaggtcaatgtgatgttttccaaaaacagtcataaaagatggctgtgaaaaaccccctagtataacaactgtatgtaacaagagcatataggtagctgcagatgaatg

SEQ ID NO: 139875 - DNA, 391 bp, Homo sapiens
attgtaatgatttgaaaagtgataatgagagaaaaactgtttcgaagtttaatagggaaggaaaggggaatgatggcaccttagcttgaagggaagggtttagttggtgtgcctttttaaaaaaccctttcttttttttagatagaagattctagcatcttattaggggatcaagaaaaaagtcaagggtcagggaggaactcgaaagatgcaagggtataggaatagagttagatcttagaggaactgagatgggatattaagaataaagacagttggtgagccttggacaggagtaaggatgtctgccacctcctttcaggtggttggtaagtttatattggatagcatcttctcagggaagtggcaggaaagctctgctagagtgaga

SEQ ID NO: 139876 - DNA, 404 bp, Homo sapiens
tcgctgaaatcgctccggaaagttaatgagatgttccctctgaattgatcattcctcccatttggaaggaagataattttctgggtggatgagcattgagtagtttcagtttacctcagtttactgatttgctagaggatggcatattgaactttgattatgtactttcaaaagtgaaaatgccacagtattgtactgaaaatggccctccttagccttggaaggatggtcatggtgggaagcgtttgctgtattgctggtgcacagaccatggaaagaaatcccttttcacgtttcaaagtctatcattgtagccataataaaattggcagaattgaatgtttgctaaaatgctgtgatatagctgatagggttttaattttttaaaaagacaatttaccttt

SEQ ID NO: 139877 - DNA, 747 bp, Homo sapiens
gtggtatctcattgtggtgttgctgtgcatttatttattgattagtgatgttaagcatcgtttcatatgcttattggccacttctgtatcacctctagagaaatgtctattcaagccctttgaccattttttaatcaggttactcgatgtttttagttgctgaattgtaggagtcctttatatattctgaatattaatccattataagatatatgatttgcaaagattttctcccattccatacacatagtaccatttgtctatttttgcttttgttcactgctttttggtgtcatatccaagaaatcattaccaagtctactgtccagcttttcctccatgttttcttctaggagttttatagtcttagtcttactaggtctttaatccatttgagttaatttttggatatgggataaggccccagcttcactttggaatatgcatatctgtttggttatcccagtactgtttgttgaagagactgttctttccccattgagtggtcttggcagtcttgtcaaaaatcatttgactatttatgtgaaggtttatttttgggctctctattctattccactggtctatttgtctttacggcagtactaagctgtttcaattactgcagctttgtaattggggagtgtgagttctccaattttgttcttcttcaaaattgttttggctagtcagtgtctatgagattccatatgaattttaaggtgattttttttatttcctaaaaaa

SEQ ID NO: 139878 - DNA, 350 bp, Homo sapiens
gcagagacactgtcccttttgaccttcaccgtgacctcatggggaagagaggacagaaggagaccgaccctattaagtttggggccttgaccaaggtcgcacagccagggatacagcagggccctctgatccccaggtggtcttttcaaccagagtacatggccccacttccagctgaatgtgccgtaaaggcatcagatgtcccaaaagtttctctccaacagtccaaggtcatcatcacctcaggctttagcaaatcccagagcagggatcacggggaaggatggtgcattttcaggtacacctcctcttcccagttcaaaggaccctgccgcacaggccacatgtca

SEQ ID NO: 139879 - DNA, 236 bp, Homo sapiens
ggagacagagttgagaattcagggaggccaaggcagctagaattggcagagggagagtatcagagaggagggaccttcacagagaaagaactttagaaagctgcagaaagtccctttgagtctttaggtgagtattgaaacagtttatgtgtgtgaggaaactagtcggtattctgggaaaaataattacctgaaacgatcaagtgaacgaatcctcgattatcacaaaggacaag

SEQ ID NO: 139880 - DNA, 176 bp, Homo sapiens
catcaggttccagctgaccaaatgtaaacttatttaagtatgtttgtagatcttgagctcttagccacaaacatcactttaaatgatgagtaaaaatagataagtacttcaaacattggcaaacactcaaagattcaaaaccaaatgtttcttcctagtttaccttgtttaaaaag

SEQ ID NO: 139881 - DNA, 128 bp, Homo sapiens
taattcccagggtctaacacgtaagaggagctcacacaatgtggaataaatgacagggccctctgcaggagggtttgctcagggattttttgttttggtgaggaaacagaaaattgctcttggtggag

SEQ ID NO: 139882 - DNA, 536 bp, Homo sapiens
catctgcacagggaaagttttggttctgggcagggattatagcattgcccccccagaactcagatgcctggatctgatggcatcttacaatgaataaaatccatataaacaagatgatgtccagaaaatactaatgcaaatatccgtgaatgcaaaggattaaaatcacactaaaaagtattaatagtatttttttccatatcagccaaggaggaataatcagcaatgatataatttttcatttcattaggaagttaatacagatatgatttatcctctgggaatctttttttacaacccctctgaaacaaagactcccagcaagggaagaattatacctcctttaagagttttcaccaaaaaaggcctgaaagcaacagaacggcatctcagaattactgacccttgcccggacacgcattaattccagaacagctgcaatgccctcagtttgctgacccctgaactaaaaaagcctctatttatttgttactctttacttctttgaatcctgcatttttctttttaagtgaaac

SEQ ID NO: 139883 - DNA, 229 bp, Homo sapiens
caaccctgaagagcattgcacggagcccagcagaaaccccagtaagcagacatcaccacccctatgttacatgttacaggttggtaacatagggatggtgatgaggaaatgaggatttggtgggcggacgtgttggaatcccacagttaagctgcagtagcaccttctgacaccaaaactctgttctccttccatctcctggctttcaggtggtccacaccctctcctg

SEQ ID NO: 139884 - DNA, 644 bp, Homo sapiens
cagtgtggtatattttaaagcaaagtaatattttcctttaaaaaaaaatctgtattgtcatgctatcaggtggaaatggggaagagaagaaaatgaaagcaagtggttcttgataatattttattttgcaattccgaagaaggattacttctttgggaaatccattctttgtcttgcctttatttctccttcctaaaacttgaggaggaggttgaacagggctgccaggccatgctttgttttagaaccattgtgttcccttccttcataaatcttgctttgctaattctgcttgaatgttcaccctgaaaagttgataggctctagttccagggtgctgttaaaatacatttttaaaacacattaccattatattttcagtaatgaaagaccctaaaaagaggttctgtagagttatttcccttaatttgcttcatgttatttggtactaaaaataattgaagtaagttatttagggctaatttttaaaatactggcttttcagtaggttctgttacaagttgttatatgttaatacatgggtttgttatctttaaaaatctaggtctgtttatgtggtaatgtcagatttattcatttttatgtgggccagtcatccccactttttgccaagataataggct

SEQ ID NO: 139885 - DNA, 182 bp, Homo sapiens
tcaacgatacacaaattctcaggtttttagactttttgtccctttcttcaaccctgttctaagccctgacatccttcctagtcctttggttctattttctatcttgtttctttgaagtttaatttctatgtggaaagtgagaaaggaacactaacttcaggtggagcgcacagcaggacagg

SEQ ID NO: 139886 - DNA, 369 bp, Homo sapiens
cattctatctaattaactatatttttgtacccattaactatccccctttcctttcctccccagcctctgataactatcattttactctctatctccatgagttcaattgttttaatttttggctcctacaaatgagtgaaaacatgaaatttgtctttctgtgcctggcttatttcacttaacatggaacctctagttctatttatatttttgcaaatgtcaggatctcattcttttttatgcctgaacagtactgcattgtgtatatggactacattttctttaccatttgatattgtttggctgtgtccctacccaaatctcatcttgtggttcccataaacccatgtattgagggagggacccaga

SEQ ID NO: 139887 - DNA, 481 bp, Homo sapiens
agggaactgatgagaaatataatactgttttgtcccactgcatcactaaagtcaacatttatgttgaacttcatagaactaaaggcaggcaagtgatgtgcctattaaaaggaagctaaaagctcaccaagaaaacctgttctagaaatgtttattatgttcaaaagaatccagctgttaggagccagggtccactagacatgctgaacaatgaactcctttagcagagacttcccatttgggaagccccagtggcagtaaacagctcatcaacaggccccttcggctggcagtttccaaaagggcagctgttgagccagcataggttcctgtattgctacacaaaggatatttctctaaaatcgttctcaccctggaggtggctctgacagcctaaacacaatcttactatgttagttctagtgtgtgtcttccaggagctaatccataaaatcctcttgcccagttccaagaccactga

SEQ ID NO: 139888 - DNA, 413 bp, Homo sapiens
cctgaaaccgtgaattcaaggccacatttgttttaaccaaaaccagaaggaaaacactgaaagaccacactagtacagatttcgggatcccaagatgactctccctgaccccgtgacagctgctcttggagtgcagcgtccccgcgtggagggcaaccagcagcaccacctccccctgcagcagtcagccctgcaaactcaccccacggcacgcaagtcgacccccacaaccccacagcctgtcactactaggggagaaaaactatttcaaaagaaaactataaaaatgtaacacttaaatgtttccatgataaatatgtaaagaaaacttaggttctatcaggggccaagttgtaggctctgtgggccacactgcccaataggccatgctgggacaccagccttggatgatg

SEQ ID NO: 139889 - DNA, 474 bp, Homo sapiens
agcctgtgacatgtagatgcaggggctagatataaattacacaattggaatatccatcccaaactgagcaacgagctcaaaaagaccctcaaacctcagggcctgagcaaaagcaaattctccttgggatcatttctccacttcagggcacaggggactccctagagaacacccacaaaggtgaaccctgagaaagaactataaaaccacaactggatccaccacaaggaattgtcaatggatgaaactcaagccaatttaggtgatgttttcagcaatacaacatgaattatcaggatttaggatgcttggaaatcattttgtagcaacttgacaccaggacattagcttttcccaatgctggttgaggaatttctaaatgggaaggaggggcttatggatggcaatctggtggatgggttgggctagaggacctgtcttgaaatgatatcatcatgcaatgcataacgacat

SEQ ID NO: 139890 - DNA, 351 bp, Homo sapiens
ttatgtctcttctctcttgccctctatctttgggactctgtgtctctttatgtgtgtgtctttctctttcatatacatacaaaggattcattctatctttaggtcagttcacattaaaccatcactgccatctttcactcctacttctgttgtctaaaaaaagtaccattcaagttcagaaggcagaagtgaaatccagatctggctgattccaaagcttgtgatgttaggagctgcctcaatttccttcttccttaccttccacatctaaatctatttccagtccctgcaaatttcatgctctaaatatttcttgaacattaattctacctcccaatccttactactaat

SEQ ID NO: 139891 - DNA, 729 bp, Homo sapiens
cggggcactggcgccggtgcagccctgacccgggtcccccggggcccggctgcccgccggctttccggaactggccccggggccggccccgagggtggagctgccgggagcagacagggcgctccgcagcccacctgagcgcgccgggcccgtctcggccccccggccgtggctggtacttttccgcgtggggccagggcgagccctctgacctcaggaagcgcctgcggggcccctgctgggggcgggatggggagaaaattccgcaggcgccgggtgctccagcctccccgccgccaccggggctgccgccggctcgcccactccgcggccgaggagggcctgcgttccgcccggggaggggaggagcggccgggggcgaggcgggggctccttcgcttgggcctcgcccccgcacgcacacctgtgcggccaggactcgggtgcgggatccgcgggcgccggcggccggcgcaggtaggtccctgggctgccttctgccgcggcctggccgaggcccctgtgcccccgctgtgtggctggaccaaggggcggcctgcttgccagacaggtctgacggcagtcacttgtctggtcagaacccgctttcccatcatcctctaccccctggcccctggggtgcagaccctcatccaccggagagtgttgggattcctattctgacttgggaagtgcgaggagaacccgggtgatatggcctggtgaggg

SEQ ID NO: 139892 - DNA, 2155 bp, Homo sapiens
gatttggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagcagaactcttcagtctggtcccggaccttctggaggcggccaacacgagtggtaacgcgtcgctgcagcttccggacttgtggtgggagctggggctggagttgccggacggcgcgccgccaggacatcccccgggcagcggcggggcagagagcgcggacacagaggcccgggtgcggattctcatcagcgtggtgtactgggtggtgtgcgccctggggttggcgggcaacctgctggttctctacctgatgaagagcatgcagggctggcgcaagtcctctatcaacctcttcgtcaccaacctggcgctgacggactttcagtttgtgctcaccctgcccttctgggcggtggagaacgctcttgacttcaaatggcccttcggcaaggccatgtgtaagatcgtgtccatggtgacgtccatgaacatgtacgccagcgtgttcttcctcactgccatgagtgtgacgcgctaccattcggtggcctcggctctgaagagccaccggacccgaggacacggccggggcgactgctgcggccggagcctgggggacagctgctgcttctcggccaaggcgctgtgtgtgtggatctgggctttggccgcgctggcctcgctgcccagtgccattttctccaccacggtcaaggtgatgggcgaggagctgtgcctggtgcgtttcccggacaagttgctgggccgcgacaggcagttctggctgggcctctaccactcgcagaaggtgctgttgggcttcgtgctgccgctgggcatcattatcttgtgctacctgctgctggtgcgcttcatcgccgaccgccgcgcggcggggaccaaaggaggggccgcggtagccggaggacgcccgaccggagccagcgcccggagactgtcgaaggtcaccaaatcagtgaccatcgttgtcctgtccttcttcctgtgttggctgcccaaccaggcgctcaccacctggagcatcctcatcaagttcaacgcggtgcccttcagccaggagtatttcctgtgccaggtatacgcgttccctgtgagcgtgtgcctagcgcactccaacagctgcctcaaccccgtcctctactgcctcgtgcgccgcgagttccgcaaggcgctcaagagcctgctgtggcgcatcgcgtctccttcgatcaccagcatgcgccccttcaccgccactaccaagccggagcacgaggatcaggggctgcaggccccggcgccgccccacgcggccgcggagccggacctgctctactacccacctggcgtcgtggtctacagcggggggcgctacgacctgctgcccagcagctctgcctactgacgcaggcctcaggcccagggcgcgccgtcggggcaaggtggccttccccgggcggtaaagaggtgaaaggatgaaggagggctggggggggccccatttaagaagtaggtgggaggaggatgggcagagcatggaggaggagcctgtggataggccgaggaccttctctggagaggagatgcttcgaaatcgggtggagagaggaaattggcaaagggatagagacgagccccacgggccagacagccaacctccgctccgcaccccacagcctctccttactcttcccacgctgagtagtgtgggggcgcccagaagcgaagacaagcagcaaaaatgtagagaaattggcacggggagcggggcttagccaaatgatgcacag

SEQ ID NO: 139893 - DNA, 390 bp, Homo sapiens
tgagggcaatatgtggagaaagtaagcaaatgtatctcaggtagaacaaaagtatatacaatgtcctcaaagtatcttcaaacatggcgcatttagggaaccacaagaaatttggcatggtgggagcataagattctatggcagcagtggccagtggagaggctggagagagaggcaggggtctagtcatttcatgtcaaagggtctggttttattaaggaggaaactcagtcagatatattttttttttttttgagatggaatcttgctctgttgcccaggctagagcgcagtggagtgatctcggctcactgcaacctctgcctccccagttcaagagattctcctgcctcagcctcctgagtagctgggactacagacgcgcaccac

SEQ ID NO: 139894 - DNA, 340 bp, Homo sapiens
tttagtttatgttttcataaagatgcagtggaagccttttcttttttataagtaaaagtgtttttcatgtacataacctaatatttttaagtccttcacaaaaatgaagtaactctatgtggataacttcagtagtaacaaaaagaaacaaaacaaccatcctgtcccccacttgccccaccaacctggatttctccttgggattatgaaagcagtatgatggaagagaaggtacagctggctttggaggcagatagatctggacttttaatgttgttgggaggatttgagataattacatagaatccttaatatagtagtgctaggctcataataggtg

SEQ ID NO: 139895 - DNA, 903 bp, Homo sapiens
  misc_feature (1)..(1): n is a, c, g, or t
  misc_feature (7)..(7): n is a, c, g, or t
nctagcngcagagctccacgctgaggccaacgaggccagtaatttattttcagaatgagctagaaaattaattcattaacactttatcctcagcctcccaggaccaaatgttggactgaagcactggtgcaaaacataaagacaaacatttctccttaagtattgatctttttagcctacgagcttcggcgacaggtgtcttgctggttaacctatttccatctcattactttggcttctgcaaatacaatgccgggaaagattaaatactgtaagctgtatccagtcagctctccattatctgcattaatcgaggccagtactgagtgggataatccacagaagtgcctagtccccagatcatatttaattgatttggggtggcaattgatggtgagtgtgtgtacatgtgcgcacacacacacacatatgcttttggtgagggtgaggatcgaacttactcatctttgatgtggcatcaggatcccattttggaggcagtctcatttgggggcacaccaagggaatcccagaagcctgctagaggagacaacagggcttctagtctcccgactttttgtagggaagaagaggcaaagtgagagtccaggtgtcctctgagggtgaggggggcaggtcctggtggcattctccctgcaacaatgcctcccacctggagcaggtcaggcgatttccgggtgagctaccaaacccactcatttgttctctcttttggccgggtgtagtggctcatgcctataatcccaacactttgggaggtcaaggcggcaagaacgcatgaggcccggagttcaagaccagcctgagcaacataagtggaccctgtctctacaaaaaattttaaaactagccaggcatggtgatgcatgtgtgtggtcctag

SEQ ID NO: 139896 - DNA, 1090 bp, Homo sapiens
gagaaggaaaatgagtgttgccgcagcaggagagattgaagttagacactagaaggacgttccaactctcaggaacctgggagttgttagcttccccagggccagtcaagaacagactctgcttctatgtgtgcagaatgacaaccttgctccaaagtggaggtgtgcgtggactgaccaagaaggctcatcagacctcggtacacaaggaactcaaagaaatgggtaatttattttcagaatgagctagaaaattaattcattaacactttatcctcagcctcccaggaccaaatgttggactgaagcactggtgcaaaacataaagacaaacatttctccttaagtattgatctttttagcctacgagcttcggcgacaggtgtcttgctggttaacctatttccatctcattactttggcttctgcaaatacaatgccgggaaagattaaatactgtaagctgtatccagtcagctctccattatctgcattaatcgaggccagtactgagtgggataatccacagaagtgcctagtccccagatcatatttaattgatttggggtggcaattgatggtgagtgtgtgtacatgtgcgcacacacacacacatatgcttttggtgagggtgaggatcgaacttactcatctttgatgtggcatcaggatcccattttggaggcagtctcatttgggggcacaccaagggaatcccagaagcctgctagaggagacaacagggcttctagtctcccgactttttgtagggaagaagaggcaaagtgagagtccaggtgtcctctgagggtgaggggggcaggtcctggtggcattctccctgcaacaatgcctcccacctggagcaggtcaggcgatttccgggtgagctaccaaacccactcatttgttctctcttttggccgggtgtagtggctcatgcctataatcccaacactttgggaggtcaaggcggcaagaacgcatgaggcccggagttcaagaccagcctgagcaacataagtggaccctgtctctacaaaaaattttaaaactagccaggcatggtgatgcatgtgtgtggtcctag

SEQ ID NO: 139897 - DNA, 416 bp, Homo sapiens
cctgacctcagatgatccacccacctctgcctcccaaagtgctaggattacagatgtgagccactgcacccagcctcgttccttttaggaaaacaggatatattccttgtttttcctctctgccagttttcagagtaaagggttggggtaataatcaatgccattggtggtaaatgggtttttttttcctttctcttttgttactatcactgttaacttgtgggggttttttactcaatattacatagtcaattatagtcattctttttcttctcactgatgttcgtaatatctgaaatttggtcagcaggagacttgaagttgtttcttgcgtccccgtgactccatgagcatttccttgctctgtgccccagcaaatgacctaggcttaatttactctgtcccgtatctggtat

SEQ ID NO: 139898 - DNA, 478 bp, Homo sapiens
caggatcctgggggaggccgttggctcgagcctggggtgcagagagcactccttggactgtctctgacatgcgtgtaaaaataactgcatttgtttttctgatctctgggcagaagctcgagcctgcgtgtccagctgtgtctgtcttgccaccttgctctcgtcagggagaccatctttgttagacaggcagcctccagagggatgggatcgtgtgtgtgctctctcctcatgacgggaggcacctggggttcctgtcctgctgcctcgtgtgtgactggactctgagaagcgcgtgttcctcgcgtcctcgtcactggcaggtgacggattcagacccacggcaggaggggcgctgcctagcaggagccgtgtggacaggagccgccgtgagcctgctgggtggcttggcctgctcgtgcctgtccacattcacagtcccgcggagacagaccttttactcttctatacctgccac

SEQ ID NO: 139899 - DNA, 301 bp, Homo sapiens
gttgttctagaaaagagtcacacagacgtaagataatggaagaaagggaacagacaacagcatctctagatatggtagaatcatgtggctcggtcactcagtctcttagggtagaaagagaagagtgaagatgatgttcagatctccaacttgcggggctcaggagcagctgctgtggcaacttagtacacaaggaagggaaaggtgatggtggactgtttcatcaggatggtgggaattgggctaaaatgtaactaagcaacatgcacagtgtcctagaagactgaagagaaagtcaggg

SEQ ID NO: 139900 - DNA, 343 bp, Homo sapiens
acttccctatactttgaagggaacttgaaatagttccatcttaatgttattccaaagtttccatttaaacttatttatagctacattttctgttgtaacttggccctccagttcacctactatttctgccttcataattacttcaaaagtataaagtacttgatctcatagttaacttttcccccaacttactcatccttcaccctctgatttctccctatcacctactcattaaaacttttaacagtttccactgtagcctctggaatccctattctgataccaataactttttttgcaatctcaacatttttttaatgcctctccccctgctgaaaactgc

SEQ ID NO: 139901 - DNA, 381 bp, Homo sapiens
ctcaggtctcaggaagcgctgatgttcatttgagtctgaagacagaaaaaaaaaaaagtcctagcttgaaggtggtcaggcagaaggaattctcttttattaaacctttgggttctagttcagacctgagtaaggcagggataattccaacatctaagtctcatgtggttgcattcctacttcagctttttcctttgctttggttatattatcttgtctatccgtatgcttgtgtattagtccaggtttgccagagaaacaaccaatgggatgtatgcacatggaaagaggtttattataaggaattggctcacatgtttatgggggttgacaaatcccaagatctgtagtcagcaaactgcagacctaggaaagccaatg

SEQ ID NO: 139902 - DNA, 314 bp, Homo sapiens
gcttgtataggaagaagtagagggtgaaaagagaggacaaccaaaggattcccaaaacacacagatagcttgggagcagcctgaaggaggtggccacgagaattgaagggctggcctgaagattaatgagggagtctggagaggaaagcttcccgtagcagatgagcttggagggccacgcagtggggccgaccagcccggagagcccgaatataggaggaggggaggtgggctctggtggttcagaggttaacagctatcttcccagaaccttttcaggggagcagtggggagagattcgtttaattagcaga

SEQ ID NO: 139903 - DNA, 355 bp, Homo sapiens
agggtttccttatgttgcccaggctggccttgaactcctggcctcaagcgatcctcccgccttggcctcctgattacaggtgtgagacactgcgcctgctctcccagcaacttctgaagtaggcactattattatcctgattttaccccaggggtaaactgaggcactgagtggcaaagtcacttgcccaaggtcacacagaggaaggggaaccacgttcattagggtgaacttgggtcctttacaaaggaggatgggaaactgaggcatggagatggcaggtaactgcctgaggtcaccagcacctgagctttggtatctgtcatgctccccgctcaccagacccctccccaag

SEQ ID NO: 139904 - DNA, 313 bp, Homo sapiens
tccatatacttcaggcccccaagtctttatccacctctgtcactgaagcatatgacaaaagaagaatgaggataactatctaacttctgagctcccaatttagtggaaaacggtaagtaattatacggcaacgtgataggtaaagttccgagtacagaggaattcaatactgccaacgtgagtcagaaagaatttgtaagagatatgacacatgaatcatctcgaagtatgagccgataaggagagtgtggaggagagcagtaaagggaaaggcatttctcactaagggaaggacatctgctaaggcaacaaa

SEQ ID NO: 139905 - DNA, 259 bp, Homo sapiens
aaacgaaaattaaatccacagtgaaaggccactgtgtaccactaaaataactaaaattttaaaaactggacattgcaagtgttggtgaggatatggaataaccagaactcttataaaagtttctggtggaagcctgaaatgtgtaatcactttagagaactcttaggtggctccttacattgttaaatacacatttaccacatgaactggcaattcctatcctaggtaattacccaagagaaataaaacattttttctt

SEQ ID NO: 139906 - DNA, 220 bp, Homo sapiens
gactgtgtctcagagtttctggatagccctgggccatgctagcaccctatcccaaagttctagacaaaaaagaggttttacaataggatatattcacgtagaacagaggcttcctccatccagcatctcattgccttttgaggagaggggaatgaggagagaggagagggagaggtcatcttctgctgtctccctggcataccagaagcagaggagaact

SEQ ID NO: 139907 - DNA, 251 bp, Homo sapiens
cctgatctctaggggtagtgggtagagcatagtgaacttgtgtgttgtaagggctggatgataatgaccaccagaagcatagtaagcatagtaccaggtggtcagttcattcatagcagtcagtattccagctgacaactagaggactaaaagaaggaagcactccacctcacttctttggtgttcttgctccagggaagagtatacacgttgtttgcaggtgctggagcacatgaaggaccaggtcacta

SEQ ID NO: 139908 - DNA, 731 bp, Homo sapiens
ctcaacatttcaggggctgagggagtctctgctctaggagtaaaaggtccttggagagaaaattttgacaagtcctaactttaaaaaagaaaaattggttcctggtcaatatttgtactcactgtaaatgtgatggttggtaatgatactctgtataaaagtaaaaatcatattttatgtcctttgcaaacaaatatatttgtacctgaggtacagattagaggtgctagtaattccttgaagattctgaaaatgatctttttttccaaaatgctttcttggtttttattaaactttctattttcttaaaactctcacatcaggtatttccagtgttttcaagcatgtataaatattttaatgtataaatgttgtttaaaatcccctcaatcggtatctcctgattgagaaaatacacagtgaccaatagctaataggaattcagtattgctttcaaagaaatgtgcatattaatcactgtagcatctgcatacatttgaaacacggagtaatacaggtctgtgcaagaattagcagcttgttccttgctaataatgacttgtgtcatctggaaggcccccaagagcccatggtctacaggtggaatgaccaccacttgggagtgagctgatggagagcacccagcaggtctcctccatcttcctggttcctgtgctcagcatagggctggtgtacattgggccattaataaacgtttgttgaacaaatta

SEQ ID NO: 139909 - DNA, 1320 bp, Homo sapiens
ctcaacatttcaggggctgagggagtctctgctctaggagtaaaaggtccttggagagaaaattttgacaagtcctaactttaaaaaagaaaaattggttcctggtcaatatttgtactcactgtaaatgtgatggttggtaatgatactctgtataaaagtaaaaatcatattttatgtcctttgcaaacaaatatatttgtacctgaggtacagattagaggtgctagtaattccttgaagattctgaaaatgatctttttttccaaaatgctttcttggtttttattaaactttctattttcttaaaactctcacatcaggtatttccagtgttttcaagcatgtataaatattttaatgtataaatgttgtttaaaatcccctcaatcggtatctcctgattgagaaaatacacagtgaccaatagctaataggaattcagtattgctttcaaagaaatgtgcatattaatcactgtagcatctgcatacatttgaaacacggagtaatacaggtctgtgcaagaattagcagcttgttccttgctaataatgacttgtgtcatctggaaggcccccaagagcccatggtctacaggtggaatgaccaccacttgggagtgagctgatggagagcacccagcaggtctcctccatcttcctggttcctgtgctcagcatagggctggtgtacattgggccattaataaacgtttgttgaacaaattaatttggaattaatgtgttccctttttagctatcgatttattactaagagattatattgaaactcttccgtctatactggagtcatgtggtaagcagtatccaagtttctgttgtgtgcagaagatggcactagatatataataaaggggggcattaaaaattacaaaccttggtttctgttctcaacatgtctgggtgacagaataataagtgcaacatgttatataatatggcgggtttctgtatggtatcagtagtgttgggttgtttaggagaatgtagggttttgttcgggtaatgataaaaatgacaccatatctagtaattcttgtatttttaaaattgttggctgggtgtggtggctcacatccataatcccagctctttgggaggctgaggcggacagatcacctcacgtcaggagttcgagaccaacctggccaacatggcgaaaccccatctctactaaaaaaaaatacaaaaattagccaggcatagtggtgtgcgcctgtaatcccagctactggagaggcagaggcaggagaatcacttgaacccaagaggcagaggttacaatgagctgacattg

SEQ ID NO: 139910 - DNA, 365 bp, Homo sapiens
  misc_feature (14)..(14): n is a, c, g, or t
tctagaggatctcncggagccttaccacgggagccttaacctgggcgaggaaggcagaggtcacaggacacaaacctgtcgctgctctcaggagaagcatcctccttccttctggaagggattggaaaatgagaccagcctctctgtccagtcccctggcagtgggttcagctttccatggccagcctgagagcttccaggtgacttgttggagggggaggagcccagaggtttccctgctgagctgtgaaagggcttcctgagggcgctgagagattgagcaaaaggcagacagggaggaaggggaaacactgggtgcccagggggatagcatctgtacatctcaggccctggagggctgggcc

SEQ ID NO: 139911 - DNA, 899 bp, Homo sapiens
ctctttctccccagctgggttgcctctaagacatctcgttgtgactgccccacacaccccctcaagttcagcaaacaccaaaaggaactgatgacctacctccagtccctaatgtcttgtgctctactatcttcttagttgctgaagtcagaaactagtatccttctccccacactgctttgtttccagagctccccatgttacttgtgcctcccacgtggttctccaatgagtccacgtctctccgtcactgttctgaggtcagacaattgccagcgcttgccaggagaatatcaacagccccctgactgctcccctgcctctggcacctcacctgccgtccactttctacatggcacccagtgacttcctaaagtgaacatctgaccacttcattcctttgcttaaatcttctctttgcccgttaaccccagaaaaagaccaaactctttaacatggcttacaagatttgtcaggatctggtcactgattatcttttgccaaactcttctcccccaacccccttgcaacactccatctcaaaaaaaaaaaataataataataaaataaaatgaccttcactatggtccctcttgccctgtgcacagcgctattcctctgtatgaaacattcttccccacctttggatccttcccatttcatcttggctaccctttcctcatgacccaacttgggttggtgcctcctggatgctctcctttcatagcattagcatgttataattattgcttatctgtctctctcctccactagacccaaagcaacatgagggcagggaatgtgtccttctttcctctactgttttccctgttcctagcacagtgcccaggtacattgtagatgctcaataaatatgttgaataatcaaaaaaaaaatg

SEQ ID NO: 139912 - DNA, 509 bp, Homo sapiens
ttttttttttgagactgagtctcattctgtcactcacgctggagtgtagtggcacaatctcaaatcacctgaacctgggaggcagaggttgcagtgagcctaggttgcaccactgcactctagcctgggtgacagagcaagactccatctcaaaaaaaaaaaataataataataaaataaaatgaccttcactatggtccctcttgccctgtgcacagcgctattcctctgtatgaaacattcttccccacctttggatccttcccatttcatcttggctaccctttcctcatgacccaacttgggttggtgcctcctggatgctctcctttcatagcattagcatgttataattattgcttatctgtctctctcctccactagacccaaagcaacatgagggcagggaatgtgtccttctttcctctactgttttccctgttcctagcacagtgcccaggtacattgtagatgctcaataaatatgttgaataatcaaaaaaaaaatg

SEQ ID NO: 139913 - DNA, 326 bp, Homo sapiens
ctccgtcactgttctgaggtcagacaattgccagcgcttgccaggagaatatcaacagccccctgactgctcccctgcctctggcacctcacctgccgtccactttctacatggcacccagtgacttcctaaagtgaacatctgaccacttcattcctttgcttaaatcttctctttgcccgttaaccccagaaaaagaccaaactctttaacatggcttacaagatttgtcaggatctggtcactgattatcttttgccaaactcttctcccccaacccccttgcaacctccactctgcccaagttttttgctccagccacttaa

SEQ ID NO: 139914 - DNA, 488 bp, Homo sapiens
gagtgcaggggtgtgatctcggctcactgcaagttccgcctcctgggttcatgccattctcctgcctcagcctcccaagtagctgggactataggcgcccagcaccacgcctaattttttgtgtgtgtgtgtgtgtatttttagtagagatggggtttcaccgtgttagccaggatggtctcaatctcctgacctcgggatccgcctgcttcggcctcccaaagagctggaattacagacgtgagccaccacgcccggccatatcttactactattatttttcaatctgcctttctccatccagcacaaaaggtaagcttttggctgccttgttaatcactacacccttgacttgatgggcacattcacacttttactgagtaaactatgctgcactttcacaccccaatgcctctcatccaagctaaacaagagaagtgaatagatgccttaccccaaaggttctcaaagtatagccctgagaccag

SEQ ID NO: 139915 - DNA, 425 bp, Homo sapiens
agacatctccaccaggaagcaaaacaagccctctctttatggtgcttcctgtttcttatttttaaagcaacttcttttcaccaaatccaaaaatcccaccttacctcaaggcagctataattaaaagcctgtctgtcaaagattttgctattcagaatttcacatgccttctgaaaaactaaaactcctgaaaattgttatcattgaatacaaaaatagaatgatccctttgactaaagcttaaaattatctgaatatgaaagtgatacttttttgtataaaacttacaaaacataggaaagggaaaagatcatccagcccccaaaacaataatttttaatattttagagtatatgcttagacacatacagttatttgcacatctgtacttactcagaactgaaaataaaatcatactctacata

SEQ ID NO: 139916 - DNA, 358 bp, Homo sapiens
catcctcccacctcagcctgccaagtagctgggactacaggcatgcaccaccacgcccggctaatttctgtattttttgtagagatggggttttacctggttgcccaggctggtcttgaacttgtgagctcaagcagtcctcccgcttaggtctcccaaagtgttgggattataggcgtgggctaccacacctagcctctaacctactttttaatgtatgtatttattttatggcctgtctccctggttgagtgcaagctccatgagggcagatatttgtgtcagttttgtttactgctgtatctccaatacctagagaggtgcttgtcatgcagtagtcactttgtaagcatttatt

SEQ ID NO: 139917 - DNA, 334 bp, Homo sapiens
tatctgtggccaggctgctggtggatcacgcctgtgatcccagcactttgggaggacaagtgtaggtggtcggagttcgagtatactaaaaatacataaaacctgggagggagaggttgcagtgagccgagatcactccactgcactccagcctgggctccacagcaagactctgtctcaaaagaaaaaaaagaaaagaaaatggaggaagggaccatcagccaggaatgtgggcagcctccggaagctggaaaaggcaaggaaatggacccccttgccccagagcctccaggagaaaggcagcactcttgacactttgattttagcccggtga

SEQ ID NO: 139918 - DNA, 257 bp, Homo sapiens
agtgtggggttgcaggtgtgagccgtcgtgcccggcagctctgtctttttaaattgcttcaaagttctttgaagaatcctgagtcttcctcatagtgtctttaaaagttctgttttggaggattgcttgaggctaggagtttcagaccagcctggtcaacatagcaagaccccacctctacaaaaaaattaaaaaattagctgagcatggtggcttgtgtctctagtcccagctacttgggaggctgaggtaggagg

SEQ ID NO: 139919 - DNA, 406 bp, Homo sapiens
cagttttcaaaataggcagaaaaaactgagtgttgagtaagttatttgaatagtaaatatgttgtagacagacttaatttcttttttttcctattatgtcatgctgtgataattctttgaattattgacctttttgaaccatgtctttcctttagtagagagagtattatactttagataatgataactattattagggccaagttgtcatcttcagaaaactctcattaagatgtagatgttaccagacggttagggtagagataattatacactgcacatgatagcttaccagctgatttgtctttaaaccatattttaatagaaaagaactctacttttagggtttggcaaatgtagatttataaaatttttaacatgggggttaactgagaacatctaactc

SEQ ID NO: 139920 - DNA, 332 bp, Homo sapiens
tcctctaccgcaaacctgcactcctcccacctcgtgcaccatctccccttctagctccatctggcaatgtgtacttttcctcaagtcctgtgtcaaacgatgtgaagactgaggtcttcttctggtcggggcagcattatagcatcatgacaaaaagcccaggtgctgcctgcactggaagtcaagtcaattactggtcatgagatcttgagcaagttacttaatttcagttgccacatccataaaatgggatcatagcaggactactggtgtcacagagttacgtgaggtttaaataagttaccttaaaggacttagtacagtacctggta

SEQ ID NO: 139921 - DNA, 609 bp, Homo sapiens
catctcctgacttggaattctagcccgggttctagctgtggtcttccagcagcagtgcgcaggaaccttagcttctgaaactggtgttcttcctcctatgtggccaggaaattttgtgcttgagtgttaatcactttctatcgcttatgctttttctttataaatttaagaagtacagcaaacaatgagatggattgcttttctcttctgtttgcataaacgtcttaaaggtcctggaaaacaatttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctctactaaaaatacagaattagctgggtgtggtggcaggcgcctgttgtcccagctacatgggaggctgaggcaggagatcacttgaacctgggaggcagaggttgcagtgagccaagattgtgccactgcactccagcctgggcaacagagtgagactgcctcaaaaaaaa

SEQ ID NO: 139922 - DNA, 184 bp, Homo sapiens
ataaatgacagtactgtagctagctaaatattctcatatatatatgttattaacatggtgaagggaaccttcccataccatttttagattatatttttatggttcaatagtctttctgtatattgtaacttaacctttcctatcttcacctgtgcctacagtagcagaaactcacatccagcaa

SEQ ID NO: 139923 - DNA, 376 bp, Homo sapiens
tggttctacatacaaaatatatccagaatcttagcatttctcagcactgattggtgcttaccttgagccatcttcatctttcatctggatgactgctgtagcctccttactagtctctttgcttcttcctcttttgtttctttgcagtcttctccacgtagcagccagaatgagtcttgacaaaatactttacagcatggttcttctctggtgcagacctttcagtggttacctggtatagctgctgttatcgttgctatgggcctacaaggttctgaatgtgatgggactctccattagtattctgacttcttccgcagctctctccctttctggttctgtttcggccgtacaggcctccttgctattgaacgtt

SEQ ID NO: 139924 - DNA, 453 bp, Homo sapiens
gctgggattacaggcatgacccactgcgcccggttgtctctttcaaactcagcctgttctctacagcagatcatagcttatcctacctattcatgctcctgtgtctcctcccagcatccagcaggtatcaaggagatgtaagttgtcatctttttggatgctctttaacttttctgtccccaaaagttgaacagggaacttttttttttcaaagttgaacttagtgccttcacagaaaaatgatgagtaacaaaattagaattaggtctaagaatacctagcactgttttatagttcctggtgtttcttctcacgtctcagctccccagaatgtatatagtgtagattttcctctgtggtgtactggtggtcatgagcaaggagaacttaagagcagggaaataacaggatgaaaggaggattttaacaagacaattcagacaaagggaaaca

SEQ ID NO: 139925 - DNA, 481 bp, Homo sapiens
gactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaaca

SEQ ID NO: 139926 - DNA, 502 bp, Homo sapiens
  misc_feature (6)..(6): n is a, c, g, or t
tatgangtacccaggttaaatgagtgttaagtgaaagaacttggtcatacacctgggttttcttttttctttttgtagacgggtctcgctatgtttcccaagctggtctcaaatgcctgggttcaagcaatcctcccaccttggcctcccaaagtgctgggattacaggcatgtgccaccacatgcctataatattaagtccagtgtttatccttttccacccggatttttttaactagtcacaaattttggcatgcattgttctttataaatggttttaattgagacggtgtctcgctctgtcacccaggctggtctcaaactcctggcctacagtccattttggaaattaagacatgcattctcaagctagtgaacaagatgatgcaagttattcatagaatatttttgtggcattgaaaagcagagaattaaaacattattttgacatttgctgagtgcttaccatgtgctaaagcctgggttttgaaagataatgaaa

SEQ ID NO: 139927 - DNA, 533 bp, Homo sapiens
gcttgtgagctctccaagagcaggaactatgtgctgttcatttctgcatccccacacttatacctcgcacagagtagaaacttgaaaactgattagggaatacatggaagggtgaggaaattaatattaatatatgaccattacctaacccttacgcagaaagtcatttcccctgatcattccatttggcttacaaatgagtaaggcatttccctgctctggggctcagctccttcatctgggaaatgggaaggctggactagatcaccagctcaaaaaaactccatgacttaatatcattttatagtaatggcctactatgtgcagagctgtgaaatagaggaaaagattagacatatccccttccattaagatgctgagggtctagagtagaattctttgttttttaagggggaatagatccctttgagggcctctcctcagaaagatgcccctgccctcaaaatgctgtgtgcagttttcggggatctatcagtggattcgctagagaaaggtatccagaggcccgctgc

SEQ ID NO: 139928 - DNA, 338 bp, Homo sapiens
gtttatgtggtaaaattattatctatgtcaatattcagcagtcatggttttaaataaaaatttctttttttaacaaagttaaaaaccaaaatgaatacattaaataaaaactaataaattgatagtttgctatttcagatgttgtcaatgttcatattctttttttaaggctgtttgttaaaagttatagtttttacttatgcttaatgacactgattcattgtatgagtcagttatgtaccagtttagtattttagtcagtgacattgtttggtttatattctcatgttcattattaaaaacctgtatagtagatgcttgataaacttttgagttga

SEQ ID NO: 139929 - DNA, 398 bp, Homo sapiens
cagatctctctgtatcctcacgcttcccttttggatgcaccttaattttaaaatacctctttttctcattaattagatcacttcaagttaaatacaaaacatggcaagatggatttaaatttagagggatataagtatacataagagaagaccaatctctacttttaaaaatgcagttaattaacaataaagtaaaatatagtgaaggtactatatgcttatttgaactttgctgttgttaaggacttgcattcctctattaactttttttaaaaaactcgttttgaaaactagcattggatgtgggtttccaatgatctagaaacatgtaaactacaacataatcgtttcaagaatttaaaataattttgcagtagagaatgttaatgttttcacca

SEQ ID NO: 139930 - DNA, 354 bp, Homo sapiens
tatgattattggtaataaagtatagctttgcaacgtggattttatttaaatccgtatttagttttattaatgatctccagattataaagtgttttattctgggtgttttactgtttctttgtcttaattaagcttgtacaaagccaaagccctgtcctgactctgctgcaggtggactggcctccttgatgccccatgagcaagccaggatgctcccaccacagggtctttcaccgaggctccctctgtctggaacactcttcctgcacatatccccatagctcgctgcttcttctttaggtctttgctcagatatcattttctggtgagttatttcctgaacctgtggcaaga

SEQ ID NO: 139931 - DNA, 230 bp, Homo sapiens
cgggagtcacctcccctttctgtaaagggacagacagcagcatgctcggttctgggagccaggtggtccctgttgcaacgacttggctctggctctgccgtggcggcacacaggcagctggtgccaatgagccacactcacaaacccaggcgggggccgtcaggccctgggccgcactgtgcagacctgagctatagcactcaggaagtgctgtgtaagcaccagcggct

SEQ ID NO: 139932 - DNA, 426 bp, Homo sapiens
tagctgggactacaggcgcctgccatcacgcccggctaatttttttgtatttttagtagagatggggtttcaccatgttagccaggatggtctcgatctcctgacctcgtgatccgcccgcctcggcctcccaaagtgctgggattacaggcatgaaccaccgtgcccagcctcagtgagtttttaaaacactaaagtttacacagctctctacttaggttgtagtgagtgatggatgacgtagacacactgagagaatgaggttccatgtattttgttattttttaaatatgtagttcttgatccattgtattacttattactagtttttatttagattttgggaaatgaagactgtacctaatgaatgaaattatttcataataattttctaaataatggacacataaccatttggttctcttt

SEQ ID NO: 139933 - DNA, 293 bp, Homo sapiens
gatttgcaggtgatctagaggatcacagatccctattacatcaaaaggcattaacatctgcaatttagaaataactgcaatgtttaatgcttctaagatgtgccaatttaaaatatgctattggacaactatagaggactaagttaatgaccccaatcaacagcgtctctgcatccttgccctctactccgtaaccttgcaatccctttcccctggctctggtctcaactgtgttgttttggccaactggatgttagcaaatgggatgacacagaagctcagaatgtatggac

SEQ ID NO: 139934 - DNA, 312 bp, Homo sapiens
tcctgagtcggcagtgcagtcactacaatcgtacagaagaaaggaacagaggaagggctgaagtttaaaaataattctgcaacagtgaatgacagactgaaagcatgagaacctttaggaagaaatgatcctggacagatataaggacctacatggtagaggtgctgaaggagatgaaaatgatccattgaggggctcagaaaacaagaaagggctttaattatctacggcttgggagcatccaataaaaccaaacaaaagtcaggttaaagcgggtggggcacagcaacctgattcttgaggtggttaaaa

SEQ ID NO: 139935 - DNA, 167 bp, Homo sapiens
agatcatctctttgtacttttacatgtttttacatgtacctatttcaacaaatatgttataagctctttataagttgtaagttgaaattcccgtcttatactttcttatatgttccataataaaatactctcagtaaatattttgcaaatttattaattagtaaata

SEQ ID NO: 139936 - DNA, 374 bp, Homo sapiens
aaaagtgacggaagacaatctaaatttttaatattaaatgactcctatggccttcaagggggttcagacaactgaggctctacacttcacactgggaacctaaattctccttccagtcagactggaagggaaatggaagaggcctcccctgttccacagcctaacagctggcccctaggaaaagttgacaactgactgagttccacagctcccaactgggcaaagtagggaattctggtctgagtgacaaggaattgttacaggtcacacagagcagcagctggagaagacacagaagatatacacatatgttctgtgtgactgagcagttaaaatacatgtctgcagaggactctctggggaggagatgctat

SEQ ID NO: 139937 - DNA, 830 bp, Homo sapiens
ctcccgagtagctgggactacaggtgcccaccaccacgccccggctaattttttgtatttttagtagagatggggttcaccatgttagccaagatggtcatgatctcctgacctcgtgatttgcccccctcggcctccccaagtgctgggattacaggcgtgagccactgcgcctggcgcaaagaagatttttaatggctgtataatattctctcattaggcatcagttactcacctcccttgcagaggcacgttgggtggtttaaggggttttgctatcataactaatgctgtggtgaacattcttgcacgattctttgcccccatccctgatccttttcgtcagcggttttctagaaatggaaattagcagtccagccatgtaaaccttcaaacaacctatcagttcttgaaacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcttttcaaaatatttgccatcttcaaaaaccctgtcattcttcccatcagccacaaaagccagtgtttcttaaaatctggctctgagttcagcatggaggccctgggcctggcatgga

SEQ ID NO: 139938 - DNA, 516 bp, Homo sapiens
gagtgtacagctacgggggaggtacagctacgggtgaggtacagctacgggtgaggtcaactgagatatactaacttgaaaaatgtcaactcatatatatcactggtctctggagtaggagctttgggaggtacagagaggaatcggatgtgaatcctgcctctcgagtatcttactggcaagaggaaagagaggcaagtacacaaggaactatactcccaaatggcaagctgctatcttcttaggcaaaggaagataaagagatggtaccattgacaggatagcacaatctagacagtcactctttgcttcacttagcaaagttcaagggaaatattttatttgagcctaatgactctggacacttcccttaaaatgacatatgagaatataagtcagtttttctcctgttgagaggtggcaggctttggaatcaaccacacccttgtgaattctcttgggcacagttttgtttatgcttatatgtcacttaatggttacatatctgttacaggc

SEQ ID NO: 139939 - DNA, 433 bp, Homo sapiens
catcttgtaatgtaccatctggaatgcattgcctccccgcctccccagcccatgatggggaagacaacaatgaagggcaactcatctgcaataaaatgttttggcctggtagaccattaactgtagggatcaaagaacaaaaatcctccatgggcagaagcagagatgaagcaggcatgtgggtgagcactataattctacactgaaggagaaaaataaaaatcatctatcccctaccttgagataacctctgcttgctgtcttctgcctggcctcactggccttccttatcgccagccttatgtttgggttggtgggaattactcctgcttctggcagatcactgataattcttggttatgttctacctttgcgcctcttttgtcagattttatcagtgtataaataaaacaggaaaggacaaatcaagaat

SEQ ID NO: 139940 - DNA, 162 bp, Homo sapiens
tgttctccataaaaagaaaaaataaagacaaaaagaatacaataatcttttatccacagagcatatgttggacctctgatggatgcctgaaactgcgataggactgagctctagatataccatgttttttcctatacaccaatgggcagatagcatatacag

SEQ ID NO: 139941 - DNA, 354 bp, Homo sapiens
tttctgctgcaatatgagagacagacaaaggttaggaccagagtgaatgggccgggctggaagacacagctttgatgtccaatggttatggcttttcctttgtgacaggcaactttcaggagtatactgcaagccaggtacacacacctgcccacagtgctcccctcacctccgaaccatgggtgatcacgggcaggcagcagggagaagatggctttggtagaagcaaaagtgctctgtggaggacaggcagtagcactcttcccccagaaggaagaagactctaaaaaacaggcgtctcagtacatgaagttatcccagacagacaaaggccaggaaattccaggacaaagc

SEQ ID NO: 139942 - DNA, 212 bp, Homo sapiens
gggcctcaggctgatgcacaggaggctgcaggaactaagggagcctggtcaccccccttggctctagccgggtccaggcgcttcctggaactccatctagtgggagtggtgactgcagtcagcagtggggatcctggaacaccccagcctttcatactttctacaaccccaaggcaagaagaatgaacaccgagctttccagatggaacctc

SEQ ID NO: 139943 - DNA, 392 bp, Homo sapiens
ttcagctaagatggcacctctcagaggctcagtcatacctggagcaggggctgaagccatgcaccccactgtgggcccaaggcagcccaggtcctgtctcctgtctgctatggggctcctcttccactcagttgcactgagtaataagagaagccccgtctgtccgccctcctgtcacggagctctgctgcacagtgcctgagccagtgtgtttctgcttctaatgaaggatttatttaggtcactgctgccttctgtgcacagcaatgcagattaaacatgttgagaagtaacttctcctcttccttcactggggcctgcctcaccactgcacacacctggctgctcatcattcgttcaggagccctttatgaaggacccacagccactgc

SEQ ID NO: 139944 - DNA, 416 bp, Homo sapiens
acctctcttagtcacttggccaaaatacttccagggatagcatcagagcaggccagcctactacttacacatttttttcagctgtcattttcattgactacccaaagtgaaatgaagatgcactctgctttggattggagagtggttgtggttggggggatgggcagagagatcacagcaactttctctaaatccaaggctaacttccacttttgcccttgttcacaggcagttctgagctactccaatcattcaaaacacaatgtataaaggaatttttttgttttgcttttgtttcagggtctttttcgtctagttttcctcagatattaggcaagcctagctcctatttcatatttttaataatcacagttatactgatcatataccatacgtatgtgtgtatatattcataa

SEQ ID NO: 139945 - DNA, 317 bp, Homo sapiens
gggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggac

SEQ ID NO: 139946 - DNA, 197 bp, Homo sapiens
taatgaaagatagcacaggagagaaaggctggtggtgtcatttggccatggagtggcaggaacacagatggtgccggcgtttcagactcctggacaggccgactgccccggcatccccatccacagcagcttaggggatttgtattgagcggctttgcaattgcttttccttaattaaaaaaagcacctgtgtgcac

SEQ ID NO: 139947 - DNA, 878 bp, Homo sapiens
tactggtacagagactttatctttcacacagacttcaaatatctttgggaatttgtgctccttatttactgagtgcttgagaagaaaagacaaagccagtggaatggtccgagtgtggcatccgctgcatttataaagaataagagctgcagtgggtgtgattcttggacagagtggcgctcatccttgttcctgcaatgaaggacatgccagcctccaggctctttgacagatgattggaactgtgcaaatattatggaagataccccgtgtcaagaagctgacagcacacacgtttgggaaggatttagtggctgaagcacttctagaaggtacatacatgattgactcactctcactttgaaatgaagctatttacttcttttaccttgagaaatgccaaaacctagggggaaagacttattattgggtgcaatgcaaagtcttcacaattataattaaaaagtaaagttttcatgattgttattaatttactaagtgataatcataacagaaaataaaatatatctgaatattatatcataagatataatcgtaaaaaaaaacaaagacagaaaaatttttggggggcctggggccccgaagaaggtttgtagacccattgtgtagagagcacgggcccacatagggtagatgacacacacggggccaccaagacgaggccccaaaggagaacaccggcggcacagacaaagtgtcgggggtttccccacccctaaaaaaagaaggcccgggaggcaaccaaggagcgttctccgacaaaaatcccagggggggtccagcgaagcaccaacggggcgctctacaacagggggtgccacgcggactcgattagaataagccggcgggggagtcgc

SEQ ID NO: 139948 - DNA, 694 bp, Homo sapiens
tactggtacagagactttatctttcacacagacttcaaatatctttgggaatttgtgctccttatttactgagtgcttgagaagaaaagacaaagccagtggaatggtccgagtgtggcatccgctgcatttataaagaataagagctgcagtgggtgtgattcttggacagagtggcgctcatccttgttcctgcaatgaaggacatgccagcctccaggctctttgacagatgattggaactgtgcaaatattatggaagataccccgtgtcaagaagctgacagcacacacgtttgggaaggatttagtggctgaagcacttctagaagacatcaccaaaatgaaacagtctactatcagcaaagaatgccagagcaagagtgtgaaacagagagcacagagccgtgatgctgccccctgccggtggtgcaggagaaaggacgcaacctcagtctacgactcctgccaagattatcagccacgctagaaactaaagggtgaaaacagggtttctctgctgcaattccatctcttcctctagaaacttgtcgtaggaatgactccctgtaacttcccacacctgcctcttctttctgtaagtgttggctaacagaatcccctccttcctcggtccttgctaagtgactgaattcagaaactcctggacaatattacaaccatccgtattact

SEQ ID NO: 139949 - DNA, 208 bp, Homo sapiens
ctgcagaatggttatgataacactgactttgcaggatcattctgaggtttaaatgaactaataatacagggtaggtgctcagtgaatgttcttctccctcttaaagactggagcagctcgtggttctatcttttcattttctacttcccatctttggctataatgatgagtgtcagtgaggcccagcccctgtcggcaggaatgaacc

SEQ ID NO: 139950 - DNA, 275 bp, Homo sapiens
tgctcctgggtccctgcttgcttcaagctgaggagaagctgggagctacccttcaccaaacacttacccatgtgcccagccctgtgccaagcactgtcttcttaaccctcaacaaccttccatgaggaaggcaccctgattattcttgtgaagattaggaaactgaggcccagagaggtgaagaagcttgcctgtggtcacacggccagtcggtgacagagccacatttgaacctaatcacactccatgcaatcatgcctctgattaccctaaga

SEQ ID NO: 139951 - DNA, 313 bp, Homo sapiens
ccagtgacagtcctccattataaaccagagtcctgggcctcatcctagaaactttatctccttccagcacaccggtcctgtggcccgtatacaaagccctgcacatgaagcctctcaagttcccccagtcttccccatttcctcacgaccccgccctggtggagcccagtccaggcgtccttggatcctgccatggctgcgcccttgggctcctgcctccagggttcaacctcccctcatttgtcagccagaggtatattcctaaaaagcagataggtccatattcttccctgcttgaaaccctccatgcttc

SEQ ID NO: 139952 - DNA, 443 bp, Homo sapiens
agctgggactataggcatggaccactacacctggctaattttttattttttagaaatgaggtcccactgtcttgcccaggctggtctcaaacacctgggctcaaacagttctcctgcctttgctaccaaagcgctgagtcacacctggccacacagctcaactttaactctcctgtttttcccctttaagttttttctttaaattagggttgacaaactttcactaaaggacttgaaagtattttagacattgtaggccataagatctcagttgccactaatcagctctgcccttgtagtgaaaaagcagccataggtaatatgcaacttcatgcatttgtctgggtttcaataaaactcttatttatggacactgaactttaaatctcatttttccacatttgtatgtcttcctttgatcccctcctcccccattgcactat

SEQ ID NO: 139953 - DNA, 267 bp, Homo sapiens
gatggcgcttctgtccctgcccaccctccaaacacttgatgcagttgcagatgtctcaattctccctgaatcttcaattccctccattaacaatcaaagcccgagtcaggagcatccaggtagctggtttgagatcaggtgcccacatcctagctccccagaagtaggagggaagaccacctgggccctttggatttcctggcactctcacagggcagacctcctcctcccaataacccagctccacctttcccaccccaagaatcc

SEQ ID NO: 139954 - DNA, 274 bp, Homo sapiens
cacgtgggggagctcaagacccgctcccgccacaggtgtggatccccctacctctccttcccctcccctctcccatactgtctgaaccagggcccaaatctctgaaaccatttcccatctggaccctgccctatccaccctccgcgggctgagaacagggggccaagtcccttccacactctaagccaccagtcagagcaaggcagaacaaggccaaggaaggaggaaagggcaccggcccaggaaaaggtcagtggcgaagctcctgcctccc

SEQ ID NO: 139955 - DNA, 339 bp, Homo sapiens
cagggataatctcttaagaaaatgatttatctgagacctgaagagttggaataagccaggtgtgagcactggggtggggccaggaggaggaaaaggagtgtacctggcaagggaatagcatttgtgcagtttgtaattgaaaggtcagtaaggttggaaaataaagtgtgagaggaaaactggtaacagataaggcaggagagttattcaggcccaacacggatgccttataaggcactgtaaggagttttgactttattgctaagggtgatgggacgccattggagcattttacatagtggagtgctaaattttggttttaaaaagtacacttcttag

SEQ ID NO: 139956 - DNA, 346 bp, Homo sapiens
gatgatagagtcagggttgtcaagcatgtggatttaaattaataaatagtttttaattagtgagagtagttctctcagattgtaaaagccaatctagaaaatgtgcctggaattaaatagtgaaattttgtattgatagttttacaatttatatcttccataattttcatgtttacaagttacatcttccataattactgcatttttctctgggaccttttgaacactctgatataatgcattaagattctcttttttttttttattcttctaaaactttaattttaggttcaggagtataggtacaggcttgttatataggtaaactcctgagacaggcatatca

SEQ ID NO: 139957 - DNA, 1028 bp, Homo sapiens
aatggagtcttgctcttgttgcctaggctggagtacaatcgcacaattttggctcactgcaaactccacctcctgtgttcaagagaatcgctggaacccgggaggcagaggctgcagtgagctgagatcgtgccactgcactccaccctgggcgacagagcaagactccatctcaaaaataaaaataaaaaaaaaattagtgtggtgatgtgcgcctgtagtcccaggtactccggaggctgtggcagattgtgggcttattgaacacaggcagtttgtggccattcagcaaggagcataatgcccctgttggtggtgatagtgaataagcactcagtgcagtcaataagtatataatttgagttaatgcatgtttaatgattcctgtttcttgttgaatgtggatttctctatctcattcccaatacatttcctacaagccagtgccattcccttgaattgctttatagcaatctggaatgttttcccattggattttctcacttgcagctcaagtctgtgaacaccatgaggtttaatcaacatgaggtttaagccaactttataggcttcctatatctcccttcctggtcagcaatatagcccattctctggagcttcccgtggggatttttcttcccagtgaattcttcctattagttatctaagtggtttaactgttgaaatgttttccgtcatctttagatccttttgaaaccactttctctacctgcttcagttccatttgatgaccgccatcatctttgagattcccatccagaaccatgcatacctcttaggttctcacagccaggagctatttcctaagttgtctttctggtggaaagctcagctcctactaagcagtccttgcttcaaaatggctttgatgaatgacccaaaggagccaggccagtccctgagtcatcacagagcaccctaggtgagaaaccctgaagtgttctctgctgttgctccacccctaccctatatgaacagattaaatcgtttcgtttggcacagttctg

SEQ ID NO: 139958 - DNA, 426 bp, Homo sapiens
agttggtgggggctcgtggcccaccccacccctctctggccacctttgctccccgcgccttctgtcttcacacgggtctgaagctcctcactgcttaggcctcatatgaggacaggggtctgcagtgccgcagggtcttgccagaggaaatacagggtgagaagccacacatctgattaattgctcacctaataaggacttctgaccacagcatataacagctgtgtggtgccagggctgcttcggccaccccacagtggcaggtccctgggcggccggctctgccttgccctgctggtagcaagacggctgcagctgcaccaggcaccatttctagcatgactgtgttcaacactggaagtgagggtaggaaggcacacctgcccttctgtgtgctctctccacacgaaggatgacagatagggg

SEQ ID NO: 139959 - DNA, 467 bp, Homo sapiens
agttggtgggggctcgtggcccaccccacccctctctggccacctttgctccccgcgccttctgtcttcacacgggtctgaagctcctcactgcttaggcctcatatgaggacaggggtctgcagtgccgcagggtcttgccagaggaaatacagggtgagaagccacacatctgattaattgctcacctaataaggacttctgaccacagcatataacagctgtgtggtgccagggctgcttcggccaccccacagtggcaggtccctgggcggccggctctgccttgccctgctggtagcaagacggctgcagctgcaccaggcaccatttctagcatgactgtgttcaacactggaagtgagggtaggaacaaaaggaatttcctcgtgtgagtctctgtcttgtccaagcaggaaaattcttttccagagcctccttagcacgtttatcctaacacagcatcg

SEQ ID NO: 139960 - DNA, 210 bp, Homo sapiens
ttcttatgttcttatttaggcccctttaattcagatttgtcaacttgattattgtctctcatgcaaaactcaccatcattgttccttggtacactccttccacctagacctttcatgcttttctaccagttcaagttaccacctcctttaacatcagtcctaatacaccttgtccgcaggaagtctttcctctcccaaccatcagtctca

SEQ ID NO: 139961 - DNA, 666 bp, Homo sapiens
agttttctcattttttcttcctctgtagatctcatagtcattttgttaacatttctggtgatgagaataggatccaaagtggtccccaatttcttttcctctactgcctcaatcaatgcctaggtgccagcaaggatgctgtaaggtccagttgaattctggcatggtaggaaagagttgggtaagcattcttggatccaagatctccttttaggttgagatctaggaggttttattttctttaaatagggcaatccatctggtttgcaggtagaccttaattcttatgttctaagcaggaacacctgctctattgttacactctgaagttgacttctttaggtgagtgctttaggtagttcacccactaaagtaatggtcactggccagccaccattgggaactccagcagcctatatgtttaaaactatgggaaaaactcctgtgaatatttaggatcctggatgcaaataacccaggatgactcaaagctttgttggcaacaattgggaacttttgatatgcctaaattagtctatcaacatgcacaattagagcggagagaattctggacttttcaaaagcaatgggaggcctcttttatttcttttctcttctctttcttcctttcctttcttttcttttttctttttttttttttttaca

SEQ ID NO: 139962 - DNA, 398 bp, Homo sapiens
ctctgtccttggtttggatggactccatatcagtcattttctctctcatcctctttaaatggtagccattatcctatagctaatgatgcaggtgctttattgatctggtctctctgattgggaatcactgcctgttgagtcactgtgattcacacatgtgtatctctggtctggacctttctccatactctaaacttgtgtatgcaactacctgctcaacatctctccttaaatgtctaataggcacctcaaactaacatacacaatcgagcttttgatatccctctcccttctgtgccttaatatacatctcccaccttagtcaatggaagtttcatcttattattacttaagtcagaaatattggagtcaatcctatggtatatgaattctatcac

SEQ ID NO: 139963 - DNA, 325 bp, Homo sapiens
caagcctgtggggaggtggcacggtggtgtgggccaaacccatgtgcatttaaaaaaatcatttaacttaggatttggaatatatcaagtaactgtcttagtagagaaccatgggttaaactgtatcccccaacaaaggtaacgttgaagtcctaacccccagtacctcagaataagaccttatttgaaagagcgtctttacagagataatcatataagaaggttattagggtgaaccacactctaatatgactgtatctttataaaaaggagaaatttgtagccaggcatggtggcatgcgcctgtaatcccagctactcagga

SEQ ID NO: 139964 - DNA, 401 bp, Homo sapiens
tcatatatgcctcggtgtcctccctggtggctaacagggaatcttacccaccacaggcctccaagcaccagagagaactgaatggcaggtaagtaataactgagccacttcctaaaatacctgtatcacagatgaccttgaagaagaccatttgtccaatgaaccaaggtatgcctgaagtgaaacacagagaatccctttcacagggggtggaatatccctccacccgaagtgcacctcttgggtcctcagaatcagattccctaaaggcttaaaggactctgggaacaattctggccaatgttttacatgcttccagagtctgaactgagtttaaggcctctgtcattcattcaaattaaaaatgcctgccagacagaatgaaatgtgtcagagtttgc

SEQ ID NO: 139965 - DNA, 410 bp, Homo sapiens
ttgttttctttccttttcccacatctcctcccagataagcaagagttgttttaatgaaagaaagacagaaatcaggtttgttttggtggttgagcagctgagcttcctgcctttgttgtggaggaggcattgatgagcaacatgtggttgtccatcaaggccactgacaactcggtgactctccagctggtgtgcccccactggggctgcgtcctcactgggggaactgggataaggaagtattaaagctgatgtcagtttacctgcctttacatctttctttcctcacactcttctgtgccaagttgaaactgatatccccttgtgtgtaagaacgtaagagttgtcaaacctctggcccgtttggtcctgcaccactgctcagatgtggcagtttgaacgttgcctcc

SEQ ID NO: 139966 - DNA, 190 bp, Homo sapiens
cacaaaagcacccctggaattatctttacgtgacgctgtctatctactgtgtctctccactttctgtttcctccactgaatgtaaggctgggaggcagggaccgcgttgttgtatccctgtgcctggcagctactggctgtacacccatacttgctagtgaagaaatgtatccttatatcctaaattttt

SEQ ID NO: 139967 - DNA, 199 bp, Homo sapiens
tagaatccaccgggtggctgcaggagggagacagcactctcagtgaaggcttagatgcggggaaatggtggggctgtccgtttggagaccagtgactgtcagttcagcacagctggatatgggttgctcagattatcacaaaagtgagctaacagtggcctctgtgcattggcaccaaggttgtttatttatttactgt

SEQ ID NO: 139968 - DNA, 122 bp, Homo sapiens
acgtctagctttcgagggtcacaccgcggggagaggtgacattttgaaaaggtaatgggggccacgatccctccagaggctatagggaggacccttcctgcctctttgagctcctgggggct

SEQ ID NO: 139969 - DNA, 125 bp, Homo sapiens
aactccacagagatacaggaaagaaaaaagcttaggttggtgaatgagcatttgaaagcaatgttaaaccaggatatagtaatgagcagccagatttttctcatgtttcagcaccagaaaattat

SEQ ID NO: 139970 - DNA, 254 bp, Homo sapiens
tttacttagaatcacttttcacaaagttagggaactttgcgaaagttccctagggaactagggaaatcagcccacagtcaggatcatgagtgtcacggggaaacggctcagtattgtattacgtgaagttctgcccaagttggaatggccatttatttgtcttctccaactggaaggctccacctagaagcctcttggctggaggaaggggagaccagttttcagtttttgtctctctacacctctctgtccag

SEQ ID NO: 139971 - DNA, 152 bp, Homo sapiens
aggtgtgaccacctacctcccagatcttttgtgaggattaaatgtataagagtcttttgtaaacaccttaccaaagtagaccgttacactgttggtcccttcatttgagaaaggactgccttttctgcctcaccatcccctggccttcttgg

SEQ ID NO: 139972 - DNA, 349 bp, Homo sapiens
tgctgagttcctggaccattcacctcaggtctcccattcactggctggctggctttgctccatctccatcccttcccactctggctgggatgggagggccggcaccctctacttctgtttctcttgctctgcttgtgttttctgtcaggtctggctatagtcacttgagtgcttccaggtaggtttggggcagcacgctgctctgcttgctaccctgggactggaaaatgctggtaggatacagcctcctctgtcctccagacatcagcggtgggatttgctttctgtactccctgcaaccactaaagtgtgtgcaaatgaaggcatttaaatggtcatgtatgctgaa

SEQ ID NO: 139973 - DNA, 531 bp, Homo sapiens
tctgggtgtcacctggtgtgatcacagcatcctccacgtcccttgtgtgcgttcttgaaaaaagaccgtctctttttttacatggctactgagttgataactgagtttatctgctctcccttgtacttgcactttgtaatattcattagtgggacttgtacatttcaaggggttagcctttgtgtcggaattttcagttaacagtggattattttctagtatctgtagggattaatgttaagcagcagtttaggaaatgctttgccttctgtagtttactgacaagagtttctcaggattcctgaggaccttgtggctttcagcattgccacctctaaactggcccactcagctccactttcctactttgtgaccgtgccctttccccttccagctttctgatggcctgccttctgctgcacatgctcttctccctcgaagaggccactggggccatggtcccgtcctagcctcctggtcagtcagcctcctcccggcctgcctttcccacagccttgatcgcatggctca

SEQ ID NO: 139974 - DNA, 320 bp, Homo sapiens
ggaatctggtgtcagaactgactggctgctggtggtgaggaggaatccctacaaattttgatgaccatagatcacagaagcactcggtgttgtgagagtatagtaggagaaactgattttgtgttttcctatatccttatgcacacagatatgcaagcactggtatttttctaacatactagttttcataagaaatggaatcaggaatcaatgaattagataacattcacattggctggccattattggttaaaatttgatcgatgcccctgtcctccaacagaagcagcttttttttttttttgtgagacagagtcttg

SEQ ID NO: 139975 - DNA, 468 bp, Homo sapiens
ggtgtcctgactcatcgtcacatcactgtgacaagctggctcgcacgcaggtcaatcctgatctgttcccaggccgcacccacgtgccctgctgtttctcagagcctcctagagggtgtttgcttgtggttcctctcacaggtcagattcctccagattcttccagctgcctccacagctcccctcaccaccttggcttcccctgggtggccctgtgtcctttgtcctctgccctaggtggatgtaaggttaacggcttcctgctgtttggcttctcagcctttccatcccctgtgtgtaactaatctcccccattaagttccttttaatgctttctgttttcttggttggatcctggcagatgcaattctttttcaaaatatattctgatttgttatctcacttgataataatagtgaccagcctgatcacttagcatgggctaaaccattaggatggctacaatca

SEQ ID NO: 139976 - DNA, 250 bp, Homo sapiens
gaacatccacacagtgaaacccattttaaaaagagagagacaacactgtcttgctaaaacatactgatttataatacactggaaggatcagcaaggtactgattaaaagtggttatctatatgatgtgatgaagaaataagattatggaatattttagaagatatattatcctttatttccccacattaatttctagcctgatcacaaataatggacttctgaaagtgggttttttttgtgtgtgtgtca

SEQ ID NO: 139977 - DNA, 337 bp, Homo sapiens
tgagcggtgctggagacagagaggcagggaccgagggtgcggcacctggggaggaggaggacagagacatgaagatggcagagaatgacagggaagggagcatgcacaaggcggccagagccctggggctgggcacctcggtccaacccctgagccccaacccgagccccagcccaggccaagctcccagcgccctgcaggaaccgcctgggggccagcccaagagcaacacgccatccgcatccacgcctctccccagcttccaggccactcgggagcccacctgcgcccctcgtgagaagcagcccaggaagatgtcgccttcatgagcacacca

SEQ ID NO: 139978 - DNA, 483 bp, Homo sapiens
tacttttccacaggtatcactcttgcccaggcgtggagtgcagtggtacaatcatagctcacgtgcaaccgtgagaactctgagctcaagcgaaccctcttttacctcaacattcccaagtagctgggactacaggtgcgtgccaccatgcccagctaatttaactttttttcttttttttgagaaagggtctcaccctgtcacccaggctggtctcaaactcctgacctcaggtgatctgcctgcctcggcctcccagagtgctgggattacaggcatgagccaccgtgcccagctgcttcatgtattttgaacaggggttttagttgtaattagaagagaaatgtaatgggtgtgcttattccatctcctatggaactggaaacaacatttggcattgaaaattgttgtcttgataaccttcagggtgttacttctcattttagcggcaatacattttgcttccgtgtgatgaaacatcct

SEQ ID NO: 139979 - DNA, 511 bp, Homo sapiens
tgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtcataatagctaacccttctttagtgcttcttatagtctgggcactggactgaggtttatatgtgttatatcattaaaactcaatctctgggaacgactgttagtacttggtaggtatactattattattgtcgttttacagatgagaaaactgaggcccagagaaagtgagcaaaatggtgctgggggcgattaataggtggcagggctggaacatgaagccacagtctggcaccaaagcccattcatggagccccaactcaatgggctgcttctcagtagaaggctttg

SEQ ID NO: 139980 - DNA, 408 bp, Homo sapiens
ttcctatgtgaaggacaaacattcagaatccaggagcagtgttttgaaatcatatgttaagggcaaacatacagaccctagcatcaatgttctagaatcatatgtgagggacagacattcagaccctcgcagcagtgttctggaatcctagatgggggacaaacattcagaccccagcagcaggcttctggaatcctatgtgggggacaaacattcagacaatggcatcagtgttctggaatcctatgtgagggacaaacactcagagccttgtagcagtgttctggaatcctatgtgagtgagagtgcctggagcctacccaacctgacgcccccaaagccctcacagggtctgacctcccagcatgcacctgcctctccctgaaccccaactgcccaccctgcctg

SEQ ID NO: 139981 - DNA, 277 bp, Homo sapiens
atctcactcagagtgtgagtggcagtcctttttataatggccacaagactccttatcatctgacctcatctcctatcacccgcctcttcattcactctgctttagacccgctgctctccaggcagctacttgaacgtgccaagaacacttctccctcaaggtctttgtccttgtttcctctacctcaaatactcttccccctaatgccagtgtgacttgcttcccacctccttcaggtctctactcaaatatcatctttaccggggggggcctcccc

SEQ ID NO: 139982 - DNA, 897 bp, Homo sapiens
cttgatctgagtcctgggttttccctgtagtttgatcaagaggaagagtttttccccccacatcccaggaaacttgggacaatgaggtgctccctcttggcagttacataccatttcttcattttctgcttcaaaatccctagctcctcccaaatgcacagcatgagactatgtcatctgcctcttcttgttttgtaatcttctcccactgtcctggtcactccccttcattcattgaaagcttcggcaccttgctgtcttcttcataccacgattcccatggtcacccttcctgccctcactcttggttacttcagaactgatgaacctgatctatctcccaccttcatctctcaattcttaatcatctccactattttcctctgctccaccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccgtccactgaaggcgaggtcatctatcgtgtgctggaccctgccatccctatcccagaccccttaagctcacggattccgaacctgttgaa

SEQ ID NO: 139983 - DNA, 478 bp, Homo sapiens
cttgatctgagtcctgggttttccctgtagtttgatcaagaggaagagtttttccccccacatcccaggaaacttgggacaatgaggtgctccctcttggcagttacataccatttcttcattttctgcttcaaaatccctagctcctcccaaatgcacagcatgagactatgtcatctgcctcttcttgttttgtaatcttctcccactgtcctggtcactccccttcattcattgaaagcttcggcaccttgctgtcttcttcataccacgattcccatggtcacccttcctgccctcactcttggttacttcagaactgatgaacctgatctatctcccaccttcatctctcaattcttaatcatctccactattttcctctgctccaccccagccacacatgccctggatcagggtttttaaactgacactactgatattttgggtcagataactgtttgttgtgagcagctgt

SEQ ID NO: 139984 - DNA, 472 bp, Homo sapiens
gtgacagggaatgcaatgactagatcattgagaactagtgtggactttatcaggaaggcattgggagggccacttaaaattaataatgtagctgggtatgatggcacatgcctgtggtcccggctactgaggaggctgaagcaggaagactgcttaagcccaggaattcaagtccagcctgagcaacatgccaagaccttgtcgcttagaaaaaaaattaataatgtaataagatctgtgttctgaagacaacactgatacaaggcagagaaaggctgagaaggaaataagacacaaggcaaggtatcaggctattgcagtaatcgaggccaaggatgacagtggcccagaggtatgaacagactctagtgatctttaggaagcacagctgacaggacaggacaggactcacctcatgaggaaggagtaactgggcagatgaagaaggcattcatggagaggaaagcatagg

SEQ ID NO: 139985 - DNA, 269 bp, Homo sapiens
cttttgctcaatattcacttacgaggccaaccctgaccactctacttaacactgccctctgtccccattcccaccatgctcatttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggttttttttttttttttttttttgagacgg

SEQ ID NO: 139986 - DNA, 285 bp, Homo sapiens
gatgatgtgtccatgatttataaattagagcaactaaggtcggaaggggtaaaaatggctcagtatttttactaagaatgctagatagtgaccacatctactcacagacagaaatcagccaactgtaactaaatgactcacagagaattttaataatacatttcaatcagagtctgtaaaaactctctctgctgatgaaaaatctgtcctgtcagaagttcccaaccaaatctgcttataatccattttcaatgaacctcagcttcctttgaagtagaataagct

SEQ ID NO: 139987 - DNA, 503 bp, Homo sapiens
tcacaaaatgtaccatctattgttgcaaaggagatagaatattcctagataaaaatacctgactattgaacaactaaattatagtttgcgcattgctgactcaaacaataaagcactgtgaggagtatgggacatgctggaggaacacattcaaaagtcaaactcatcaaatgtggaacatgatccttccgtttgttggccttcctcacaggaggcagagagaggcctctgtatctgccagagtctaagtctatttacaggctgtcatctgggagcgagatggagatttcagctacctgtctaaagtggccttgtttgctaaaatatccttcaaaatcgctatttcttccgaaaaatccaattaccgtttactggtacctgctccggcaaccctgcactctgcaacgttaaggctgggaaggtagggaaggtcaccgctctaggctggggaaacccagggaatgggtctttccctagctcccttcaagccagcaggtctggtg

SEQ ID NO: 139988 - DNA, 444 bp, Homo sapiens
gattcaaactctacaaacctgtggtggaatgagaacaaaagctttcggcttgtttgctagctgctgaagtttaacagctaaaacattttgaaagcagatccatatttattttgggagacggaaaggtttctccatctcacaagtaactaatacaatcaaaaccctggcaaacacagcagtgcgcgaagaaatacagtgtgaggctggacaataaaaagttgcacagaatccatttgtcattttggcccactcaccagaggctctgcaagcctgcttcccacagctcagctcataaatccccatctcctccggcccactctcaggacgttcctcccccagcaccggaactaggacttcctacatactgcagagctcactcctggggcacccctgtccccaattcagcaggaccctctgtgaacagggactgaaagccagatctcc

SEQ ID NO: 139989 - DNA, 394 bp, Homo sapiens
tctcggtatttaaacagctgctgttgctcttcattctgtagctctacatcagattcatgctctagtcctgtatatccaaatgatgactagaggctgccggctctgctctttcaaagccacaatgagtgtagcccgtctacaaaactctcccttttccaatccagctttccctcctgcatcacctatctctctacatctggaaccatcggcagctgccttcataaggcacctcggtctggcatttggaaaaccaccctgtcttgccagagctgcttggtcttgggtagcaaaagctgtatgcaatctaaatcaagctttcaatcatgagaaatcacattccttcttttccccttgtaatatactcgtgtgtttttttttttcctttctcaataag

SEQ ID NO: 139990 - DNA, 380 bp, Homo sapiens
gaagtctgtctcttctaccttgatttctctcaaatccttgcacttcttttgggcttttgtctcaaacatactgggtttaaccactgactatctgcaattctgaattgcctttgacaggctatttaacatctctgagccttaaatgcctcatggaataacagatgtcaagtcagcacctactaagtgttctattacaataatgcatctattactattcttgcccagcccactgccatgactttaggagtatcaatgcagcccagattactgccatggcctcactgttatccctgctctaaacagcactccagtctactctcaccaatgcagccagaaggatctttcaaaaatgccaatgagatgatgtcactctcctgctt

SEQ ID NO: 139991 - DNA, 373 bp, Homo sapiens
gttaaatgcttccacagcacttggatgctgaccacacaggtaaactgaattcagtctctgagtttctcgcagaacatcagttcatgaggtcagagatgtatcagggcagtccttcaggaaccaagccacactgtaaattgctgcctatgtctctttacttcttgatatctcttctttttatttttccaaaccttggaagtacacagttatcatgaacaactctccatctgtctgtgcatcctttccctaaactttttgtcttaaaacattcattataaacccaaataacaccagcctgacaaaagtttctagtgttgcctgatcagacaccagactacatggtagtaacactgttacattaatgcagatcagg

SEQ ID NO: 139992 - DNA, 151 bp, Homo sapiens
acatggcatccctgggagtggtttgggaggaagggagctggggcttcgaggggacctgcacattcagtcctgtgctgggtgctggagactcgtccctccccactgccccctctgcccatcctcagtgctatgtggctatggctcctcggag

SEQ ID NO: 139993 - DNA, 489 bp, Homo sapiens
cctcccaccttggcctccagagtagctgggactataggtgtgtgccacgatgctggctaatttttttgtattagagatgtggtttcaccacgttgcccaggctggtcttgaactcctggcctcaagcaatctgcctgcctcagtctcccaaagtgctgggattacaggcgtgagccactgagtttagatcgttttaaaaaaaattactttacttttattttaatgggcttctgggagggagcagagtttaccttatttaactaaaagctttttcttctatttaacctttatatgttcttttgctttaaatttatctttttatacaagatattgatggattaaacaatatccaagataagaatctgaattttaatacagaagatgagcctgttatatatttactataattattattatattaggatttacctatgctgtcttatttaatgcttgcttgctttttatttttttatttttttattttttttg

SEQ ID NO: 139994 - DNA, 323 bp, Homo sapiens
ggtgttttaagctaaggtaattgctgttggatgccagttaggtcctaaagtaaaagaaggttagagaataattaaattcttacgtcccaagttttcagtttcaagtctgaattccacacaaattctgcttgattattattagacatttgatttttttctaattactgaaccacaacacccacagttctgttactccaagtctcctaatttattcatgcggagatgcatctgctatttttttttaattttgataatgtttgattacatatttgtaaatgaatgtgcaggtgaaaaaatgaattgtgaagaacattttaagaata

SEQ ID NO: 139995 - DNA, 397 bp, Homo sapiens
ttcagccataatcaaataatattccaccgcaaagtaatgggaaaagtatatgaacttattacttagcaaagagagctctgaataaataccttaagtgcttagtaaaaatataattaaagccttacgtcaatataaaaccgtgatggcaaaatctgtttagtatttttcaccaaccaaagaaaattatccaagttaagccatcagcttcacagataaacatttatttttgtctaaaccattgtaatatatgtaagccaaattccttttttttttttttgggcttaacctgaaaaaagaaacaaagcatattacaggggttaaattcctaggtctcccattggctaccagggtgacctgggtaaagtaacttggaggggtacggagctcgaatacgaaa

SEQ ID NO: 139996 - DNA, 211 bp, Homo sapiens
gtctgagatcctctgagctctaaccagactttccttccccacagtcccacatgtgtaaaagggactaggagaggtgaccagtacctttggggctcagatcgagaagtgctagggacatgtgggccatgagcttagttgtcaggctcctcagagggagggaagcttggccaaagggaagtgagtagagtccaggaggaggaggaattcgccc

SEQ ID NO: 139997 - DNA, 368 bp, Homo sapiens
ctttaagcaagacacaagtgttcactgcacacggcatgctagtgcagccacccaatttacggcctcacagatcttagggaccaaccaaggacagaacccaagttctttcttttatttttccatccctcacaatagtggttctggaagttaggtccctagaccagcagcatcagcatcacctgggaactggtagaaatgtgtgttctcggccgggcgcggtggctcacgcctgtaatcccagcactttgggaggacaaggtgggcggatcacgaggtcaggagatcgagaccatccgggctaacatggtgaaaccccgtctctactaaaaatacaaaaaaattagccaggcatggtagtgggtgcctgt

SEQ ID NO: 139998 - DNA, 534 bp, Homo sapiens
caccacagccaagactcggtttttccattggaacatggaatgaaatgaagtgagtttacatttggggctctcattgtatcggatgaactcttctctaaaggtcagaaggccgggcatcatgagctgtcacttgagcagaatgctcaccctgctgtgagacccagaaagaagccggcacgtccttgagcgccgtacagtgggatggccttgcctgggcggctgtctggggctcaaggacatgaagttgaaaatcacacacacttccaatctatatacaaggaggaagcacatgagagcccaacactggtgtttccaagagaaacgtttcctttcaggggctaatgcaggcgctacaatacctgcagcacaggaagcacaaactattttcagactcagaagagagccgttcaagtggtggcaatgccaccaatagggagtatctcatcaattgtctttggtgaggaaacgctgacaacagaccaagaaattggtgaattcaagaagcctgagtggtctgggcgcggtggctcacgc

SEQ ID NO: 139999 - DNA, 231 bp, Homo sapiens
ttatcctggaaactagtgtctgttctttgtagagacaccaatagtatcttggctttaattgccaaagagctctacatctggaaggaattgaattgagtaacactggtattcaaaagttgatctgacataaagcctatctgatggcttaaatttcatgatgtcctggaaaaattgaggtaggaatgattaataactagtaagatttttaaggacaataagtaaaaggaaaaa

SEQ ID NO: 140000 - DNA, 518 bp, Homo sapiens
ggacaacttcagaactttagagttaccaagtatttttgttgttgctttcctttggaaattctgcctgttaggtgctgggacaaatgacaagcatggttgagtatctatttcctataatgtgaagtcatccctgaaaataccatttcaagtggcagtattccagggattaagggcacacaggatgtctgaactcactctctggctcagaatgaaccccagttccattttagacatagccggatgtaagaaacatggtcactaagttaggagtcttctgggctttccacgctaaagaaaaagagaaaaatgaaaagagcaagaaagggataggtttataaaattttggaactttccaaaaggagttttgagatttggagataatgtttaatatcactttcaatttacaaataaagtaggtaggaaatgtcaagtagtttaaaaggaagaaataaattttcagaaaacaaattgacaatgtgctagtcttaggatgttactcattatcattttatttctgt

SEQ ID NO: 140001 - DNA, 405 bp, Homo sapiens
tataaattcataacacattaaaatgagcagactctttagttccttaatcctagcagtctgatttagtaatttctttaatggcaatattattctccccatgccacagttcatatttgacttctcttgactccttgcttcccacttactatcagcaaccaagtcctgcttattcttaccttattatattgttctttctatccctattgccacaacctacttcaggtccttatcatttactcccaatgcttcttttgcaatagcccactaactagctctctaattcttcaatttttctctttttctttttcttttttttttcttttgagatggagtcttactctgttgcccaggctggagtgcagtagtgtgatctcagctcactgcaacctctgcctcctgggttca

SEQ ID NO: 140002 - DNA, 483 bp, Homo sapiens
ctggttgtggctctgctgtgctgtgaggtcctatatgctgcccatggtgctttcccactgtcttgggtctctagatgagagaggaaaatgttcttatgtgtagcatctatgcagataaggaagctgtggatggagatggtgcagttggttgttcacaggtcggcctcagcctcggagtgctctgtggaggcaggcggagccacatgatgagcctggcgtggagggctgtactggggcctgtgaccacccaaacaccctctgtgcatgttttttcactccgtgttgaagacgtgagctgagagcacagcagtcacgccctcctgactggctggtcatgtgggactgctccttggggcccctcagatgtgggttggagctgcgggaaacaccctgtagctttttgaatctcttccaccctctctggacctctctccttctggcttttcttcaggaaggaagtagcctgcatttggtgagagtcac

SEQ ID NO: 140003 - DNA, 393 bp, Homo sapiens
cccacactattatcaatcctcttaacatctgggggaacagagacccaggaagataaactgaactcagggcacacagctggaagtggtggcattaggtgtcacactcaggccatggactccgtcaccctgtgtaaggagcagtaattttctctcccattctctgcaggcccctgaaaggtaccatgctcaataccagtgaacgctgttcagcccaacctgaccacaactcttccagatgggcttttattccccccatttttagggtgaccaacgggtgtgcctagggctgaaggggctcctgggatgcaagactttcggtgttaacaccagaaaagcccgacccattttacagacacggaaactgagatttggagagggtaatatattccacag

SEQ ID NO: 140004 - DNA, 136 bp, Homo sapiens
attaagaaatgcactggattttaaccttaaagtctacatacttgagaaaagatatagagtacattacagactagggtaataaacagaataattcatgactccctaaggggatttttttttccagagggcaaatgag

SEQ ID NO: 140005 - DNA, 272 bp, Homo sapiens
cacggctttaacacacttcttcgcactagtgagaacgcccgcaatgccttattcagtaaggttaaatgagtttgtttgctgaaacattcgccacatgatcccaacgctcctccagctccatcccgtctataatcgcagagcgaacactcactcaccttgggcgtgtcaataattgatggtctggggatggaagcgtgaaacaccactgcttcacagtccgccccatcatccagggacccgggcacatcttcaggcgtctccgcgggctgggc

SEQ ID NO: 140006 - DNA, 181 bp, Homo sapiens
gggacttggaggagttagggcttggcctcttaggatgacctgagcccagactcctagggcggccagtggatggggaggcagccaggggtgccaagctgcttgggtgttgtaggagagctctggggaggactcagcctcgctagcgggatctggttggtcctggtgggaaggacgcctagtg

SEQ ID NO: 140007 - DNA, 107 bp, Homo sapiens
tttttcacaggggactccagatccttttagtggggaataggatttagaagcccagatccaggtgctaggtgttatcgttactatggattacatagtttttcatggta

SEQ ID NO: 140008 - DNA, 299 bp, Homo sapiens
ctgaagtcataagcaagttgcaaaaaatcggcttactagaacaggaaacattcttttgcttttcaaaggctttcccatcatctggagccaaaaatattatcttctgacccaaaaagccactaataaaccctgtttctataggctaagcaagagggaagattttgccctgagcaaaacggcaaagagggcaagactgttctctgggtcctcccaccctcacttctgccccctctcctacctcctgccaccctccacttccaggtatctcccaactgccctctggctgcctagtgtcttac

SEQ ID NO: 140009 - DNA, 106 bp, Homo sapiens
ttgctatgccattatgttacagaatgtattcatacagcaatttttgctaacttacttcttgcccttccatacgcagtaacaaacagagagaagtccatccaccatg

SEQ ID NO: 140010 - DNA, 765 bp, Homo sapiens
tttagttcttgaacacctggaattacttctgacttttgccctcctactccttcactatctcatcagttatcaagcagtgttgaatttttctttatcgcctttgttggcgttcttcttttcatttcttccagccatctccaacctgttagggagtttaggaaattgttcaaagactgattaataagatggtatggagaggatatttggttggggatgtgggaatgtctgaatcctgtcttggccagccatctctactcatcaggagtgtggggagtacatgtgcaatgacacaccagggaaaggaacactttattattagctgggtatgaaccacaatgcagaagtcaggaaagataggctggattctggtcatctctgtctatcctccccacatcaatgcccaaatttgagtcttggaacttttcttccgagtgggatagaggcacactaaccagaaaaagtagagagaaagacaaatccacagcctctttgccccaagcccggggccttgctaagactttttctgtgggccatagccttagggcctggctaccttgtgggagagggaaagagaacaagctggctgggctgcctctgagaaaggcaagggcagcccttgttaccactcagagtatgttgaagaacgggaaagacgcagcactttctgttgaacgtgttatcttttaagggctccatcccaagaaaatgttattccatattctccaattttagtaagattttcttcctttgtgtgtgtttggtggt

SEQ ID NO: 140011 - DNA, 427 bp, Homo sapiens
gctcaggaaccttccaggtcctatttgggcttggcccttccaagcagttccagccccacaggaggatgctcggctattgcccaggatccacgaggtgaggaggatggggccttccatcaacagtgggccccgaggaggacagcaatggccaagacgcaagggaggaggcagattccagaggtggccccgcccaggcatgcagagaagggaggctctaaaggcatcagagagcaaggggtacctgcggggccttgaaggatgcagggacaggacgagctggaggagctgggcaagatggctgctcagggaggggacagagaaccaaggcacccaacagtccctccttttcccatctcacctggcaagtgaagaaagggaagggataaaggcagggagggtgaaaagaaatgaagggccagaaggaaaa

SEQ ID NO: 140012 - DNA, 621 bp, Homo sapiens
tttcattcgttgtcaaatttgtatgtgtacagctaaaaaacaaaattgaagtatctacttttatgatgactttcagtttgtagcatataatccataatcagggtgtttatcgatgccacaatctcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaaagggcctcttcaccatctcacccgagactggagagatccaggtgaagacatctctggatcgggaacagcgggagagctatgagtcgaaggtggtggcagctgaccggggcagtcctagcctccagggcacagccactgtccttgtcaaggtgctggactgcaatgacaatgaccccaaatttatgctgagtggctacaacttctcagtgatggagaacatgccagcactgagtccagtgggcatgggg

SEQ ID NO: 140013 - DNA, 232 bp, Homo sapiens
ctcttcaggatctctgcctgcctctagtagggacagagactttgagactatgattgcaaaggagagcactgggccctcaatgacccagtatgggccaagccaagtactagtaagaggtcttccctggggctgctgtttggctgttgctttcaaacatgtttaagtgtcttttcagcaacagcaactccacagttggcatggttgtgtgcaaggataaagcagtttcccttag

SEQ ID NO: 140014 - DNA, 461 bp, Homo sapiens
agctgggactacaggtgtgtgccaccacgcctagctaatttttgtatttgtagtagagacagggtttgaccatgttggccaggctggtctcaaactcctgaactcaagtgatccacctgccctggtcttccagtgatgggactacaggtgtgagccaccatgcctggctttaggcatcttcttagaccactttttctagagttgttttcctaatatttgtcttgtgattacaagtgaatgtcactatatgcaggttattatgacaggcaggttttaacttctctgtcaatcaagttaatcatatgatgtaggcctaatattttgaataatagaatcactcattctttcatttaagtatttatcaggttgctattgtgtgccagggactattcttaattctgtgtaagataaggagatttctaagtaaaacagattttcagttctccaagagcacttagact

SEQ ID NO: 140015 - DNA, 417 bp, Homo sapiens
cacaagagaccctcacactacagccttccagaagcctccatctacataccatgtcacaggagaccctcagaccgcagccttccagaagcctccatctacacaccatgtcacaagagaccctcagactacagccttccagaagcctccatctacataccatgtcacaggagactctcaggctgcagcctcccagaagcctcctgaggaaagcagggcttcatctgaagacaggtcactggcactaagcttacttgtttttttgagacagggtctctgtctgtcgcccaggctggagaatagtggtgtgatcacggctcactgtagcctcgacctcctcaggctcaggtgattctcctacctcagcctccccagtagcagggactacaggtgctcaccaccatactcagctaattttgt

SEQ ID NO: 140016 - DNA, 234 bp, Homo sapiens
atatccagcaagaatgacaggctaggatttccagaacttaacatgtggcatgtttcgtgtcacagttgtgttgactctactatttatttcattttaaattttttgagacagggccttgctctgtcacccaagatggaatgtagtggggagatcatggctcactgcggccttgacttctgggctcaggtgttcctcccaccttagcctcctgggtagctgggtctacaggcacgc

SEQ ID NO: 140017 - DNA, 435 bp, Homo sapiens
tttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagg

SEQ ID NO: 140018 - DNA, 350 bp, Homo sapiens
ctcctgccttagcctcctaagtagctgggattacaggcatgcatcaccacacccagctaatttttgtatttttagtagacacagggtttcaccatgttggccaggctggtcaagaattcctgacctcaagtgatttgcccacctcggccttccaaaatgctgggattacaggtgtgagccactgtgcctggcagtttccttcctttcttatgtcttggatgagtcacttgacttttccaagccttggtttccttgctgggaaaacaggaattatagccggaatcaggggatggtcatgagggtgaaataagatcatgattagggcagagcctcaggggccaggctgctcc

SEQ ID NO: 140019 - DNA, 321 bp, Homo sapiens
tacttcttcacagcaataactcagatgcaacttttcctccttggtgaaagatagcatgacttgcagtctgtgagaaggaaaaggaaaaacagttgatttgttttcccatgagagggaaaaagaaggaggggatacaagctcacacactatcaggtggatggatcatttcctccactgaaaagatacacaaataatttgatctctaagcattagcaaggtctttgtagggtacgtagtgaggatcacatgcatgaagaatccattgctcgctgaaagaagatcttggaatgagtgcgtggatccacaattcatgtagatggc

SEQ ID NO: 140020 - DNA, 133 bp, Homo sapiens
tcctgcgccccctcgtggcggtacttcagcccttcgcagcccgacgctaggggcctggcagggggcagcaagagaccgcggattacctgaagctgagtaatttataaagaaaagaagttcaattggctcacag

SEQ ID NO: 140021 - DNA, 477 bp, Homo sapiens
aatgcaaggacacaatcacagctcactgcagcctcaaaatcctgggctcaggcaatcctcctacctcagcgtcccaagtagctgggactacaggcgtgcaacaccacacctggctattttttatttttttactgcagacggtggtcctgctatgttgcccaggctggtctcgaaatcccagcctcagtgattctcccaccttgtccttccaaagtgctgaggttacaggcatgagccaccgcacccagacagaactagaataataattattattttgcgtcatagcagctgtgcagaggatttgaatcagcacagccatgaagtcagacccacctggtcccattctcaggttgcttcttgctaataacagcggtgactgccagctcacccatgtcgctagacgctaggcatgattctaagtaattcatgcgtagtatcccaattaatcctcacaagaactgtatgaatcaggtatga

SEQ ID NO: 140022 - DNA, 590 bp, Homo sapiens
ttcccaccaattaaaactcctgtaataagataagtagagctgaatgtagtttcttaaattgtatgaggaaatgtgtcaacatttggaagatctgcataactcagtgaaggaagagtttcccaattaccaatgcatgatatgaccaaggtgtgatttttgtaacagatctttccaagtgcaagataaaacagtggattttaatgtaacagagcatgaaaaatccacattgctagtgacctttgaggaactaccacttatgtagtttgggtgtagcatcaaagaatatctacaattatctgaaaggctaggtattaaaatacttcactgagccaggtgcggtggttcacgcctataatcccagcactttgggaggctgtggcaggtggatcacctgaggtcaggagttcgtacctgacttgccagggttgttataagaactaattgggaccttatgtataagtatactattacctggtgcatattaggaatactaatttctctcttcctttccatttttaaagcatattacagtgtcaatcttttttttttgaattttgtgcagtataccttttatagagctatttttaatt

SEQ ID NO: 140023 - DNA, 385 bp, Homo sapiens
tttcccagggaaatggttcttgacagtcctgctggttggaaacacacctctgcgtaggttggtgtgtgttctcctgcctcccgtctccaagaggcgtgagttctaagggctcccatcctctcacatgcaccatgaggactgtcagccgcatccagctcagctagatgatacgagtagctatgtgaggggtaggaaaaccaggtattcagttttgaactgagaagtccggtatttctgcttgctataaaatgagagaaatacaaggcatagaaatgcctttttctccataaattaagttttattatgaagagatgacctggttcgaatgcactcaagtggtaccaactcacacaaaatagaagtggggtttagattgctgccgaca

SEQ ID NO: 140024 - DNA, 529 bp, Homo sapiens
gagtgtagtcgcatgatctcagctcaccgcaacctccgccccccaggctcaagcgattctcctgcctcagcctcccgagtagctgggattacaggcacgcaccaccacacccggctaatttttgtatttttagtagagacgggggtttcaccatgttagccaggctggtctcgaactcccgacctcaaatgatccacccacctcagcctcccaaagtgctgggattacagacatgagccactgcgccaggccagcagggagggtcttttgagacaatgacatttcagtaagggtctgaaggaggtggaaggacatttcaggcagaggggatagccagtgcaaagaggtgatatagaagaaatatgtttggggttttgcaggaacagtgtggctggaacagagtgagtgagagggagagtggaaggaagtgagggcagggaggtgatgggacagattgtgaaggagttacgtgccttggggagaactctactttgagacaaggagagatcatggctcaccacagcctcga

SEQ ID NO: 140025 - DNA, 179 bp, Homo sapiens
gggtcgagaagccctctggggggaaactaggagaggtcagctggcacttctttagacgggtttcaggagactgtcattcctgcagtggggacccagtcccttcgcccttgaccatcaggcgagactgccagatgagtgttgagcagggctgatggctcttccagcaggaaggctttgtg

SEQ ID NO: 140026 - DNA, 755 bp, Homo sapiens
gagacagagtctcactatctcccaggctggagtgcagtggtgcgatctcggctcactgcaagctctgcctcccgggtttacgccattctcctgcctcagcctcccaagtagctgggactacaggcgctcgccaccacacctggctaattttttgtatttttagtagagacggggtttcaccgtgttagccaggatggtctcgatctcctgacctcgtgatccacccgcctcggcctcccaaagtgctgggattacaggtgcaagccaccgtgcccggccaattttttcactttttaattatgtacaacaatagttgaaaccatacatatactcaggagtggaatataattagcaaatattttcttcagattgttatttgtctttgtttatggtgattttttgacatgtgtaagtcattcagatatatttttatgtagctaaatttattaatatttaacttgcttttggaatttgggctttatttatgacagtttttctgtttccagattaaagaggaatacatcattaatgacaagatatgaaatgcaaatgcacacattaaaaaaaccctaagtatcattagcctttcgggaaatacaaatcaaaactaccatgagataacattgtatagatagataacatccatttgattgattaaaaaggaaatatatggatatatcaagtgatgtaaagactgaggaataattgggattttcatacactgctggtaaacaataaaaataatatacccacac

SEQ ID NO: 140027 - DNA, 329 bp, Homo sapiens
gagcacgagtggctcctaggctggcagcacactgctttgtggcagaagggctctgatatgctctggtctttacctcttttctttaaaaatctaatttggccacctctttatgaagaagacaaatcagacaaattggaaggtatgagtgaacatcatttactccttcaacagctattattgagcaactcctatgttgtattacagtgtcaacattacatctaaattaggtgatgacctctctgggaagaagtcctatcttccagctatctctgaatcctcagggtctgtgcaggatccaagacaaggcaaatggttaagtgtttactgaa

SEQ ID NO: 140028 - DNA, 223 bp, Homo sapiens
ctactcacagccccagacggccactcatagaccagatggccacccctagccccagacagccactcacagccctggacagacactcctagccccagacagccactcaactcacagccctgggcagccactcacagtcctggctggccactcacagccatgatggccactcacagccaagagggccactcaactcacagccctggagagccactcacagccctgg

SEQ ID NO: 140029 - DNA, 255 bp, Homo sapiens
cgggaacacgtatacctggcagcacagggaaacagctcggagatctcacagcacatgcactctctgcacacacatgagcacagcacacagcacatctatcatgcacacagcacacacgcatgcacagacagccactcaactcacagccctgggcagccactcacagtcctggctggccactcacagccatgatggccactcacagccaagagggccactcaactcacagccctggagagccactcacagccctgg

SEQ ID NO: 140030 - DNA, 287 bp, Homo sapiens
tcaggggctttggttgtaagtcacacaatctgactctggctaccttaaccaagaaaaagaactttggggatgagatatcagaatgttctcagttacaagtaacataacagcaggacttcttacatcacttaacaagaaggcaacagatcgttctcaagattggttccacagctcaattaggtcattgtggtagcagcctccaagatggcaccaatgctgcctacctcctggtagccttgcctcccatgttagaaagtgttggctcatgtaaccaataggagactgca

SEQ ID NO: 140031 - DNA, 863 bp, Homo sapiens
ggggctgctctgtctatggagcagcgattcttttgtttctttacttcactcatgaacttgccttcagtttactctgtggactcaccctggattccttcttgcacaaggtccaagaaccctctcttggggtctgcatcgggacccctttctggtaaacctttatttggctgtaggtagagtaagtatcttttttcttcctattgatccttccaaactatctatccttcttttgactttgaaaaccctaagtctgttgagttcatgtcttcagactttaccacctaatctctcttctaatagttgtcatctttcagaatctcttgctgtctctcatcattctttgatgactttatcatctagtttattgtatttgatttcctccattattcctacaatcctgttggttttgctgtccttgtagattatccacccagtaccctggtctctcaatttcttgaacttctctacttcaaatatcttcactccactgcaaccagccactgccattcttacagccacaccatagacattattaacagtcaataccaatagcctttaaaatctctggacagcaatcactatcctgctgtctgattatcacattttgagtctctatctcactcctaccagttcccttggaactgttctttgaccctatagggacattcaatccattgatcctgctgattttattttttaatttccctaactttcatattgttatttatcttcttgttaagctagcttccatggtctggcacttgagccagattcttgcagaaaacctgaactttcttgttttcctttctctccactgaacacatctgaaaaaactcaccccttgtgaaacccagttatcctcc

SEQ ID NO: 140032 - DNA, 154 bp, Homo sapiens
atactagtaaaaaactcttccccaagttgctagctgaggcttctaaagatctgctggttttcaatataaaggatgaaacaggctagaaaatctggagatgctttagaaaggtcttcacagaaggccagaagggcccttcgcgccgtgcctcctg

SEQ ID NO: 140033 - DNA, 258 bp, Homo sapiens
actgtattgatagtgttttcctcagccaagaagttacagctgcagtactctgctttgctactcagcacatcccgatgagacaggagagcttaagtatcattttccccatgtccagggaaaactgactctgactggtgctccttagtttgagcctcatgaactattgacagaggctggaagcaccacactccttgtcctcttgcactgtttggagctaatgcactgtgggaacctttaccagggctctccatctgtgtg

SEQ ID NO: 140034 - DNA, 146 bp, Homo sapiens
tacctgatacctgctatttgctcctgagcctatggtggccactctctcttctctctacacctgtgaaggttttaattcagtgctgtccatttatacccttctaagagtggcaggactccaggaatctctgtcctcaccaatcataa

SEQ ID NO: 140035 - DNA, 347 bp, Homo sapiens
tttgagttacaaataatggtcataattatttccatcctgaaacaataacctgacaaatgacataaaagttatcagtgatagggcaaatcactgacaaatgaagtcaagttatcagagacattcaatgtaaaaatcgtattaatttcagaaacatttcctgagacactgggcttccattctacctaggaagcaaactaatcaaaaactttcagtatataaaacaaactgagtttatatatgcttccaatgagaaatgactaagattggctttaggcttctcccatcacgagaaaaacaattatcttcgtataattctttttgaactgttcatttttctaaaaataatt

SEQ ID NO: 140036 - DNA, 363 bp, Homo sapiens
gccatctagcgttggaaattactaattgcggtcttcaaagtattataacaacaaaatgcaaaaaggaaaaaataatttttcttcattacttttacaacattctttccaggagtgcactgagagaataccgataattctcctctactttacttgcagattttcgtttttgaaactgtaatcatgactggcagttagaatcagtgcacttgtgagctcatcaagccaaagctatggttactccttcaagcaggagggcctggcacttcacataaagatgaaaggaggaaggtgtctgtcaatcagctgagctgggggagtggaggcaactgtgatgaaactgaaggattcatgcccagtccaagg

SEQ ID NO: 140037 - DNA, 349 bp, Homo sapiens
agtggagaaaagggaacatggactgtgactctatgtcacaaatcagacgggagaaagggagacactgtgttaatctattctcacattgttataaagaaatgcctgagactgggtaatttataaagaaaagaggtttggccgggcgcggtggctcacgcctgtaatcccagcactttgggaggccgaggcgggtggatcacgaggtcaggagatcgaaaccatcctggctaacacggtgaaaccctgtctctactagaaatacaaaaaattagtcgggcgtggtggcgggcacctgtagtcccagctactcgggaggctgaggtaggagaatggcgtgaaccctggagga

SEQ ID NO: 140038 - DNA, 421 bp, Homo sapiens
aaaaaggaagaagaaaaagaaacttaagtggggttcatacatagcatggcagagggacactggagaataaaatggcatgcagagaggaacacgcgggccagtggatgaggcttctagacctggcagtgaactggagtctatttgcttacacaaatttaaccttctctccatgatggaatacaagtgtttcttgccaaaactcgcagccccagctgccctagatgaggagcaccgtgctggaaaagtgcacaggctgatcacagagacaggtaggaagcaatggactgttaaaatgcatgttccgggctggggatggtggctcacacctgtgatctcagcactttgggaggccgaggctggggaatcgcttgagcccaggattttgagactagcctaggcaatatggtgagaccctgccctt

SEQ ID NO: 140039 - DNA, 152 bp, Homo sapiens
gcacatgacatcgagaacattctcaggtatattaaagagttagcattagaagtaggaacatgacaataagcaactgaattctcaaaaattctgtgaagagaaagtaactttaaaaacaaatcacacatgcaaaaaaatatttgatataaaaa

SEQ ID NO: 140040 - DNA, 404 bp, Homo sapiens
ctctaatctaggacagttccttagtctttctctgtttcctgccctcgactcttgatgagtgctgccagttattttctagaatgtccttcaatttgggtttgttagatgttttcttatgattagattgagactatgcatttttggaaaactaaaactgagactgtgaatttttgccaaaaatagcacagaatgttgcagtgtcctcagtgtaccatatttggagaacctgaatttgatatgtctcattactggtgatgctagctttgatcacctggttaaggtgctatctgtcagatttctctgagtattaataaatcattaaagcctgaggactagcaaggtatatccagcttttccctgtaaaatatgcagaatttttggctatgctattcaagtgaactgtg

SEQ ID NO: 140041 - DNA, 765 bp, Homo sapiens
tgttgaatggcagtaagagctgaaaaaaactttcacagaaagagaaacattcttggggcccctcccctcattccctcctttacatcccacaaagatgacatcaggaaggaattccctgggtgagaccccccaaacgtaaaaataaaaggaatcctgtgaaataggaaacaacaacttcaatctctccagaaagggagagccttggctggagacaggatgtggaaatgatgacatccagaaggccaaaggaatctaggactctaactcttactcccaagatcatagagaggtcctgcagaaaatctacccctctcacagctccttctaatcttggctaacaggaaggaatgccaggccttgccttcgtttctaaatatgctgctcttctattctgaaatgtagggctgatgttcccattatttcaaactccagcacactcacactttgtatagtacttcccttcttccttcctgtgttactgcccgttgcttgggcagtggatttgctcagcttggtttgatgactgccttatacccaccattaaaaagagaatgctgtcccttatagctcccagtggtctcagggctggctgcatccccccaacccccataatgttgaccgccttcagagggtctgggttccctggaatcacctctagggactttcaggaggtgaagctaatgttggatagtgcaaaagatggatggaggggcatctcaaataggaagtggacttcaacatcctaaaggtcttttgaacagcgac

SEQ ID NO: 140042 - DNA, 716 bp, Homo sapiens
gcagaatcacgagtgaacagacgtcagatgcctaatagcagggtgcagtgttgtttatacttcattgctccttcaggacatgaacttaaaccattggatattgagtttatgaagcgttcgcatgaaaaagtgattatcatccaacttattgccaaagcagacacacttataccagaggaatgccaacagtttaaaaaacagataatgaaagaaatccaagaacataaaattaagatatatgattttccagaaatagatgatgaagaagaaaataaacttggttagagaggatgatcagaggatccgttgtaccggtcttgcgtgtgtgtacggtagtagatacgtatctattggaaggtgtaatgggcagaaagcggtgcagtagagaatggcagatgatccttcgggagtagtcatgatgcaagatttgaatacatggttgagaccattcgtagactttattaccaatctctactgcaccagtattgttggatagaagaagaacaacattgcagggactttgtaacagcatggttaagctaaataaatgtgccaactagtgtagtaactacagaagcagaaaactggcagctgtgacttataatggagttgataacaacaagaataaagggcagctgactaagagccctctggcacaaatggaagaagaaagaagggagtatgcagctaaaatgaagaagatagagatggagatg

SEQ ID NO: 140043 - DNA, 385 bp, Homo sapiens
gcacctgggcacacacacaaacaaagaggaactcaccgcagatatattcatgtatatgcatgcgcattttctgaaagaacccacctgaaactgctggtggtggttaatgaagcatgggggcagatcttttcttccctggccacttctttgataatcaggaattacctttcccctcaaaaattgattttgtataaaaatggatcacttccatgagtgttcagaaaatatattcattcatttcctttaagacattaagcacatgtgaccaatctaaatggaattgtcacgtttgtgtggttatggagtaaatggaacaaggatgagatgactttagcagctgtttaagtaataaactgtttagatccattttcctttatgcatctgg

SEQ ID NO: 140044 - DNA, 336 bp, Homo sapiens
cgtcggcacaaacactcctttgcgtcttggcaaacgagactgcagcagcgccaaggtcctacttgctgcggggctgccccaggaatctagagctggtaggcaagaaacgcttttggagttaagaaaaagaactgaccatcctggtccgcccacaggagaaacggcaaaggaaagccacctccaatggagtcattatgacaattatcattccggactgggccagcgggaacacctgagcccgacctagctgcacagccccggagctcagacgttagcagggggataacacctgtcaccagcttgggagagccattagcgctggcgcgttgcgcgcag

SEQ ID NO: 140045 - DNA, 427 bp, Homo sapiens
ctgatccacctgtagtctgggtttcacagtaaccacttttaacaaactaaagactcaaaatttaaagtatatttttagttcatcttcttgcaacaaaatggtaagctttcaaatgggtaaaacctaaataaatttgtcaactttgaattttgtatgtaaagtagaagttatagaaacaaaatttacattgaaaagggttttgttattacagtatcaacgcatatttataaatgtccttcatttccaaaggtgctcacaatatcgacctgtaaatagaaaagctaccaacatcaacttgtaacagtcatcttcacaacaaacaaaaacatcaaatgtcatatatcactgggccttattttggataagcattacaagctgttctcagatgcatacattttatatggtcaagaaacagaactacagtctc

SEQ ID NO: 140046 - DNA, 393 bp, Homo sapiens
cattttctgtaactacttcatgctgaataggggtgatgatatttttgcctaactattcagttttcttgaccctgaaacaaaggatcagtgacattttatgtgaagtcaaaaagtattactttcatcttccattagttcagtcccttcagttaattcctgttctgtttgattgtcatgaacattccagttctccatgtatactgaatgttttttctctattctaatgtcacaatttctaaagttatcacaaacttgcatttaagaacatctgttgctgggcacagtggctcctgcctgtaatctcagccctttgggaggccaaggcaggtggattatctgacgtcaggagttcaagaccagcctgatcaacatggtgaaaccctgtctctacta

SEQ ID NO: 140047 - DNA, 329 bp, Homo sapiens
gatgacctggaaagattcccagagtgagagatcaggagggcaaaggcctgatggctgtggtcattcttgttggctttactgatgaaagtgataggaggatggttgctccagaagtgaggatgaccagaaaagattcccagagtgaaagatcaggaggctaaagacctcgagtgggaagggaatagagtgttccatgtagagagagaacaaaggtggcctggactagcaggttctgctgactctgacctctggctttgattgaaacattcatcagacttggttgtttgctgaaacaaaagtcaggggacttcgagaaatcaagtcaagat

SEQ ID NO: 140048 - DNA, 739 bp, Homo sapiens
cttatcttttgggggcacctgggtacccatttctcatggtcacgtacctaggagtggcattgctgtgttagagggtacgttatagggtatgtgatttttgtaggttcttctttatcctatcacgattacatttttttacttttgttcaacctggtgtagactcaccttggtcacaatgcactgtcctttttatatattgctagattcaatttgaagaatattttgttaggattttagcaactctggttacaagagacgctggtctataatttttttttctttataatgtttttgtcaggttttcctgttaagatgatgctggacttagaaaagcagttggaaaatgcttttaaaatactctttggaagaatttatgtaatattcataatatttctgccttaaatgtttgggaaaaattaccggaaatgccagttgggcctggagatttctttgaggaaagtttttaaattagaagttcaatttctttctttctttctttctttcttttttttttgagatgggttctagctctctcactcaggctggagtgcggtgtaatttctttaatagtttataggactgagcagattttccatttttgtatcagtctggggagtcttcccatttccactcagctttacactgattcatgcaaagttgttcagtgtcctcttagatggctctgagcccaacgctgacatcctcctcttccttctgagaatcttatactgatcttttg

SEQ ID NO: 140049 - DNA, 427 bp, Homo sapiens
gttgtacagattatttcatcactcaggtactaagcctagtacccaagagttattttttttgctcctttcccttttcccacaccccccaccctccaccctcaaggaggtcccagtgtgtattgctcccctctgtgttcatgagttctcatcatttagctcccacttgtaagtgagaacatgtggtagttggttttctgttcctgcattagtttgctaaggataatgtgtttttcattaagtaaatacatatcgagtacttaccataccaggctctgtgcaggctgtgggaatacaacataggacataacagatactgtcctgacctccagcactcacagcatatgaaggaggagagaaaaggacagggcacaggtcattaggacccagtgcagtggggaaagatggcagaggtgcttgggaaccccta

SEQ ID NO: 140050 - DNA, 262 bp, Homo sapiens
aattcgcccctcaacttataaaaggaatgatactcaaaataattagatatgcttgtcattctgcagatttttaatgagctctacactgtgcatgcctccctattatcaaatccacagtatgtggaaagctagcaaagaaaagttcagcctccccagattaattatatacaagtaaaatgttgttaatatgaatacatttcagcaactgtttacttttcaatttggatagaaacatattcacgttcatgcataaagactggca

SEQ ID NO: 140051 - DNA, 303 bp, Homo sapiens
cttctgcctctcactaattctcagggttctccctgccctcaataccttccactcacaagaaaagctaattgagccaaccaatccagacctctccccttccaggaatttttttttcacaaagcacaatgcttcaagggggcaacatttagctcatatgaatgaattgctattaactgaatttcaagtatttttgccttggttgagaatggaagggctgctctacaaggggatttttggctgatggaagctctcctgaggtagtttaaggcaacttaaagagacagcaacctttctgcctacttc

SEQ ID NO: 140052 - DNA, 195 bp, Homo sapiens
gaggctggagaggggagaagcagctgcaggtttacagatgggaaagagcctctggacccccctttcaactctcctagagataagttcaagctgagccggtccttgcccttccctgcaacttccacacagaggcagggcggggacagcaaagcccagggccacatacagaagctcaaggaggccctctcagccctc

SEQ ID NO: 140053 - DNA, 415 bp, Homo sapiens
aattttcctgaaaggtactttctgactccatggagaccgggtcaaacccttacactttcttcagcgttagggacaggaaaatccccctagtgggttaactttctatcattaagggctgtcaagaacacctcttcccagcccgagagtcccctacttctctatgtgggctgtcccgcagcatacaccaacacacacaaaccacaaacgcagggtggaggctcttggggcttcccgctcccgcgcccctgcccccgacaactgttcctacagaggggattatcttggggaatcccgagtgccaaaactaagctcttactagtggttttcaaacttgaccttccaccagaatgccctggagggctccttaaaacttggacgggaagactaagtgttttcggttcagcaggctgggaga

SEQ ID NO: 140054 - DNA, 506 bp, Homo sapiens
gaactgcttctattgggtgaaaacagtgatttttctgagattccaagacattacagtttttcctgccactgggcagcttaatactaaataataacattttggtacctgatcagtggcttaaatatagtatagctatagggacaaatgcccctttatctttgcatttatttatttatttatttatttatttatttatttatttattttagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggtaagtttgattatttttataataagaagcactttgggaggctgaggtgggaggatcccaaggtcaggagttcgacacaatcctggccaacatggtgaaaccccgtctctattaaaaatacaaaaattagctggg

SEQ ID NO: 140055 - DNA, 240 bp, Homo sapiens
gtggagaggaggagccaagtggttctagaacagtgtccttttgcctagaatgtccctacagcaggagcagctgggcaagactcagaagtcctgattataatcacagattaaggtgaccaactatcccagtttgcctaggactgttccagttttagaactgaaattcctgcaacccagaaaacctctcaatcttgggcacatcccaatcagctttgcaggctttctctatctgacaatacc

SEQ ID NO: 140056 - DNA, 866 bp, Homo sapiens
gcttcaccaactggaaaagcctgtgaaatgcggcctccctcaggggaatgccagtgaccccagcccctgtccttctgaccttacccatcctggtacccagtcccccgtagccttctctccagacccaggaactcccaggaaagagcctgaaccttggtcacccagaagagtcatccccagtgggattgcctagtgcaacccttgcccagagagattggcccttttgtgctagcacagctgcaagctggggcaggggcttgcctgcccgctggactgcccacagcccagggatctcgggtgtgctttgtagaactgcacccattttagacattgtgtgtccgtgcccgcaatgctggacaccgtaacaagccacatactgaaaactggctgttcatttgagccgtggaaagatatttattgcccctctcaagtcgggcaggcagctctcctccaagcagcttcaggctcctcccagctcccagctcctccatcctgaatacgcagatgcccaggtcaccgggctcggccgcctctggctggcagaagagaaagtgcatatcacttccgcttctgttccgttgactgcaatctcaactggcggtcattcctccctgcaggggaggctggggcaggcggtcttgctgtgcctctggaaggagagcacatgccattctctgctgttgatctcacaatgccttgtactggatcctcctagacaagctaaagcacgtttaagaaaaaagcatagtccaggcgcagtggcttatgcctgtaatcccagcactttgggaggccaaggcgggcagatcacaaggtcaggagatcgagaccatcctggctaccacggtgaaaccccatctctacta

SEQ ID NO: 140057 - DNA, 745 bp, Homo sapiens
  misc_feature (525)..(525): n is a, c, g, or t
aggtctgtttgatgatcttagctcttgacgtcagcactcagactcttagggtcacccaatccatgtgcctcatcccagcaacagggaaggcatttctctatcagtcagttggtaaatgattattgacaaacaatgtgctgggaaggtggagtgatttgagtagatttggcctctattctcatggagcttcctttctagaggggaaggcagatgatggatggataaatataaatgattctaataggttggtgcagcagtcattaaaagtaatggcaaaaaaaaaccaaaagaaacggggaggagccgttgctgccgttcattgatagtaatggcaaaacccgcgatgacttgtgcgccaacctaacccagtaaccacgggtgtgcaaatgtggcgatgggcaagttccgagtgctaggagagcatctagcttcccggagtcaggagacgggggttggcaacctaaccaaggttaagtccaagtgaggggggtgggcagggaagcggttatttattttttttttttnatttttattttttttttttttttttttttttttattattttattattatttttttttataatttattttttataatatttttatataatttaattattttttatttattttttttttttataaatatttatattatatttttatttttaatattttttttatttatatattaattaatatttttttatttattaattatttttatatttatattttttcc

SEQ ID NO: 140058 - DNA, 1633 bp, Homo sapiens
tggggcaagcaggggagagggctggtgatggggtcacagcggaggggctggggatgcacgggaggggctggggatgtgagctttcctgagttcccacagttctctgcccctctcctgtctcatggcacaagggccccctggggcttgcggtggttttgcgccaagctaatatcttgttcttcccaacagacggaggcccattgaggcttctgtgtcctccacggggaccagcattgggctaaacctgcagacaccattgcaaagggaattcaggcaaacctgctggtgaagaatgattccagcgtggggacagaggctgacatttcttgcctgggtgatttaatgttgggcctcaatttttcactccccccgtaagagtatgacatagccacaacctttccagggcccgagggagggtggatggacttatccatcccataggtgttgctcgtggctgggtgacttgcttctgccaacgagattttcacagacacggcacaagcagaagcctggaatgtgtgggcactgccaggcctgccctctaaggttcttgattttccccatgagatgcacgtgccccagggaacggccgctctggctgtgggatgagaggcatgtggagcaggcatggttcccatgcttagcctggagtcaaggccagactagatcagcctaagcccagccacgccatgggtgcaggagtgaagagcaaatgctaactgtccatggaattgactttcaaaggggcgtgtcatgtgcctcatcccagcaacagggaaggcatttctctatcagtcagttggtaaatgattattgacaaacaatgtgctgggaaggtggagtgatttgagtagatttggcctctattctcatggagcttcctttctagaggggaaggcagatgatggatggataaatataaatgattctaataggttggtgcagcagtcattaaaagtaatggcaaaaaaaaaccaaaagaaacggggaggagccgttgctgccgttcattgatagtaatggcaaaacccgcgatgacttgtgcgccaacctaacccagtaaccacgggtgtgcaaatgtggcgatgggcaagttccgagtgctaggagagcatctagcttcccggagtcaggagacgggggttggcaacctaaccaaggttaagtccaagtgaggggggtgggcagggagcgatatttcagtggagactccaaggatgaatggtatttagagagtaaaccccgatagagggtttgtgtctggcacagagaagagcctgtgcaaaagctggtggggcgagaggacaccgtgtgttcatccacctgacgggcgaccagcaggctggagctcagcgggttgagaggaggatgcagaacccgggaaaggcaccctaggcagagggcacagaagcgcaaaggcctggagtcaggcctgagcctgtgtggtttgaggaacggacagaggcctgtccgtcaggaagggaacggcacaggggagagaccttaggccacagcagagggcagggcagagggcagggccgtgctgggcagtgtgggctgtggatggtgctggcatttaagaggggagaccatagaccagggcaaagggcagggccgtgctgggcactttggg

SEQ ID NO: 140059 - DNA, 2392 bp, Homo sapiens
  misc_feature (14)..(14): n is a, c, g, or t
  misc_feature (1732)..(1732): n is a, c, g, or t
gaattcggcacgantcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggaccttgggaggccagccttgactgactcaaagcaaaaaaggaagaattctcaaaagcattgccntgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaacctacttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtgggg

SEQ ID NO: 140060 - DNA, 3042 bp, Homo sapiens
  misc_feature (14)..(14): n is a, c, g, or t
  misc_feature (1915)..(1915): n is a, c, g, or t
gaattcggcacgantcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccntgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaacctacttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgt

SEQ ID NO: 140061 - DNA, 3118 bp, Homo sapiens
  misc_feature (14)..(14): n is a, c, g, or t
  misc_feature (1991)..(1991): n is a, c, g, or t
gaattcggcacgantcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatgtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccntgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaacctacttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgt

SEQ ID NO: 140062 - DNA, 474 bp, Homo sapiens
acttgtctcccccatactttcttcctttattttagctgaagatggtatttaaacccaaatttttaaattttgttttgttttgagacagcttcttgctctcagatcccaggctggacctcagtgacatgaagataactcattgcagccttgactcctgggctcaggcaatcttcttgcctcagcctcccaagtagctaggactgcaggtgcataccacatgtctggcaatttatttttatttttgtagagttgtggtctttctatgttacccaggctggtcttgaactcctggcttcaagcgatgcagtcacctccaccttccaaaataaatccaagttttaaacacctcttctgggttattcattgctgggtactcatgctaatacgcttctgtttcttttctgtcttgttaatctgtcttttgttacagataaccagccaatcacacgcaagagtagaaggaatgaaagattt

SEQ ID NO: 140063 - DNA, 509 bp, Homo sapiens
tgcaggcagacgggatgatggaaccccagggtgttggggggaggagcggccccaggtgatgctcctaggctcatggccaagtgccgagcccctttccccatagccagagtgcctggagggcctctgtcgcaggggcagaggagaaaggggcctctatggcatctgtgattgagctcccggcataccgtcctgctctctgacaactattcctgtcttcattcaagaatcatccagcccctgggcctctcagtttcttgatgtcttgtcctcctccacctcaacctcacggccatagctgtacctcagcttttgtcactgcctgccattgtctttgtcatccccagcagcctagatctattgttcaggttgcgccctcgagtcctgcaactcccagcgagcctttgagtctactgtggggtcttcagtcagttggtcctccccatgtgtcactcagccccttgtgtccttggttcagtcctttgttagctttgagtccatagttgaatata

SEQ ID NO: 140064 - DNA, 329 bp, Homo sapiens
tgcaggcagacgggatgatggaaccccagggtgttggggggaggagcggccccaggtgatgctcctaggctcatggccaagtgccgagcccctttccccatagccagagtgcctggagggcctctgtcgcaggggcagaggagaaaggggcctctatggcatctgtgattgagctcccggcataccgtcctgctctctgacaactattcctgtcttcattcaagaatcatccagcccctgggcctctcagtttcttgatgtcttgtcctcctccacctcaacctcacggcctacccgtcttccacagcctacccgtcttccccagccta

SEQ ID NO: 140065 - DNA, 275 bp, Homo sapiens
cttgggattgaagtaaacccatgtaaattgatgagaagctggagtaaaatactaatattagtatgtctggagaaagacccaagtcagtcattcttggaggaaattcttcaaaattgccttggatttctgtttttctttgcaatttttttaaagctatgcttgtgccatactgaagacaggatttcttatttataaagtcattcaagtggcctgatataagaaacttatagtaacacaatatatatgcccatagcttatgcaggtacagaccgtgg

SEQ ID NO: 140066 - DNA, 350 bp, Homo sapiens
agagcttccggaggctgctacgtagaatgggctgtccgagaatgaagacaaataggcaaatatagaggaaaacagagagaggagaagagacagggagcccctgggccaaccatccgggatggatgttggatgcactgctgcttgttccatcctagaaagtaacacatcctcttcctcactcctgctatttttcccttaagcccactttattttttcaatcacttgcaataaaaggattctctttaaagcaaacaggaagacagaacttcttctctgccatggggacttctttttccctggagtggatgggaatgtgccccccaggaagatatgttgaagtcttacccctt

SEQ ID NO: 140067 - DNA, 560 bp, Homo sapiens
ccatgtgaacattgtttattgtcgtatactcctgggagagtcccagggatgagcttttataaagttgcagacgggaaagggactctcactttggagagaattaagcatgtcacccagttgcctaacaagttattgctgtgcaggcaaaaaacagacaaaagactcacccaactctaagatttttttgatggacttctctaagttcattatgataaagttaatattatgatttttccagttctcaatattttgggtctaacccttttttttattactttatgtatatgttctgggctccgtagactctctggagtgacaagaaaatcttgaaaaataaaaggcgaggtctattggagagctgttcgtggatgattctgatacgtgctcttggttaagaatcactgctctggttttcttcccagtgcctcttacccaccactgttagatcagttctttaaacaccacttaaactcccactttatgtcagcaaactgttcattcttctgtcaacatgtcatattcaactctgttcacatgccactcaatacaagagtcctcta

SEQ ID NO: 140068 - DNA, 780 bp, Homo sapiens
ccatgtgaacattgtttattgtcgtatactcctgggagagtcccagggatgagcttttataaagttgcagacgggaaagggactctcactttggagagaattaagcatgtcacccagttgcctaacaagttattgctgtgcaggcaaaaaacagacaaaagactcacccaactctaagatttttttgatggacttctctaagttcattatgataaagttaatattatgatttttccagttctcaatattttgggtctaacccttttttttattactttatgtatatgttctgggctccgtagactctctggagtgacaagaaaatcttgaaaaataaaaggcgaggtctattggagagctgttcgtggatgattctgatacgtgctcttggttaagaatcactgctctggttttcttcccagtgcctcttacccaccactgttagatcagttctttaaacaccacttaaactcccactttatgtcagcaacctcctcttgacagtcaagctccttagtctggcatgtagcactcaccattacttggtgtgagtcctgaattctgagcagccagtgtctccttatctgtcacattcgtactcatttttatgactttgcaggtcttgctgaaaattcttccttaacttgccttgagaaccaccttttccaccaagcattcccaatgaatgtagctcgtggtgttctttccttccaaattcctgttctcttatctctactgcttataacccaatacttgactatatattgtcttgtataaatg

SEQ ID NO: 140069 - DNA, 380 bp, Homo sapiens
gtgttttggtttaaccaatagtcctaggagcttagcacacctggggtgtcaccttttgcttgtgtttgtgaacctctcttatcagggacaagaaccatgtgtccatctagctgcaggcctctagggtggggacagtatcccatcagacagggattccccatggtgcaaatgatggtctctcctccttcgacacatctgtgctgcactcaagccatttgtcaggttagcagagcctgggggaggcagtgtggagagagctggcttcggagatagctgggcccaggtctgaatcctggctctgctgccacttcccagcccaatgactttagtcacttcacctcacaaggctgagtctctgtttcctcatttgtgagggggca

SEQ ID NO: 140070 - DNA, 386 bp, Homo sapiens
ctaagtgataaaggaattcttttccaagagaggtgaataaagtgaaaatgagtttgagaattaagagaagggtgttaaagtatgtgtgattgccaagagttagacagtgataaaggagagacatgtttgacaaatgactctttttgttactggagtttttaagaatacttctatggatcaaatgtgaatttaattttcaatctgtacttattacaaagttcacatctgttttaaggaaattagaatgtaaagagattatatctggggagtgcttctacttgtttaaatagatggcatgattgtaaatcaggaaaactaatagaaaggatttaagtcactttaggatttaagctagtggcagtaatttagggagaagtaacagctga

SEQ ID NO: 140071 - DNA, 512 bp, Homo sapiens
aaatgataatgacagtacacaatattgggtaactttattttctgattttaatgggagcacattcattgtttagccctgggaagaatgatgcctttgggtttgaaaaacacataacagaaatatactcacatatacacatacaaattcacacatatttcctgttaaggaagcattcatttattcctctctactatggattttaatttttgtggcttttatattctaagagtgctttagttttatcagttttgattttttagaacttctataaccatcatcatctgcattttctccccaggctacttaatgtgaattttatcaacagacttcctaatacatattcatcattatattcaaaggaagaataccatccaagcctaataaaagtactattatttcaatgtaatgctgtattttccacttgttaagttagatgttgtacatcagtattcgtatgtaagactgatatacagcaacagttttcacaagtggggtccaaggaccactgagcg

SEQ ID NO: 140072 - DNA, 486 bp, Homo sapiens
tattgaaagaagagttcaaaaataccaacattgaatatcaaactatttgaaattatgtgctatattggttttatttttcaattttgtatggattaacttgcaataacagataaacacaagtatggtgcactttggtaattttttggtgaatgctgtggaagacaggcctttagtaaggttaaatattctactttcctctattagatctcatttgacttcacaagattcacttgataatagttacaaagtaaatccagttcttcaaatggaagataggatttaggtattttttactttagattttacttaaaactatagattacatttaaataagcagcatatttcacagagattttcaaaaatattagatttcaccctaatttatgttttgcacaatatttcaatgaaaatttgatgtggttgttaatgttttattccttttgatcattgcaataaaataataaaatgtaacatcagatttactgt

SEQ ID NO: 140073 - DNA, 337 bp, Homo sapiens
tgggctcaggacaccaaaaatagaccaagcctccaattcaagtttggcttggagtggggaggagagtgggaaagcacgtttctggcaggcagcaggggctgcattcagctttgaccagttgagattctctgatttctaggaagagggtcgtatgtttcatgcccctgactcacttgacggcttcagatcatcagctcgtccggccttcatttttagcgtctatctgtatttgctgtgtttcttaggacaccggttctgagagatactgagtggcagttgcatgaaaaaatgagtcttggccaattaagttaggggaatattagatataatatccccc

SEQ ID NO: 140074 - DNA, 518 bp, Homo sapiens
agatggcgttctgaggatccctcataacgtatcagaactcaacatagtatgatgatctttgtaactcttgtaagatgcttttcagttcacatctttttaaatgattgtctgtccacactgttcactccatctgtgcagctttatgttatttgaaggcatagtgccccctgctggattcactttataacaatcagttctcccaccaggatgattagcgcccagaaagtgtaagtaaatatttgtggagaaaactgatttgaatggcccagatggtggcactcagcccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcc

SEQ ID NO: 140075 - DNA, 363 bp, Homo sapiens
ataaaagacatattaaagtgttccagaagtctacaataacagttttattagccataaagtctagaagaataattctgttagccataaggtatttcatatatcataccctcctctatctccgttttcccccagttgagttcttgtgaaggagaagggactttaagaacagcaggtcattttaaaaaaatgaacttactctaccagtaggtaacactgagtagaagttaaatccaaggagtgctaagaatggcaagtctggctgcttaaacacaccggtctttctgactaatgatttaaatcagcagtaagaaattcgtttttatgagttcaaactattctacaaatcaaagacaaaaagaaaca

SEQ ID NO: 140076 - DNA, 303 bp, Homo sapiens
tgtgctaaatactggaatgaaagcatgtgaaataatatgcagacaataaacatttttcctgttatagaaagcattttaaatgcagtcatttatatatatactaaaaatatacatatatgtatttttgagacagaatctttttttgttgctcaggtaggagtgcagtggtgtgattacggctcaccatagcctcaacttcctggggttgaggaaggaagcttctcacttcagcctcctgagtagctgggactacaggcgcatgccaccacgcccagctaatttttgtatttttttttttttttg

SEQ ID NO: 140077 - DNA, 191 bp, Homo sapiens
atactttgaagtgttacttaaagtgctaccagactggggcgatgtcccggtatgttgagtcctggagagtaggagacacagctttctggcgaggacctttcgtggatttccttctacaactctgataactttttctcagtctgctttgaatgctccttaaatatttgtgcttcctaggcttctgtcattgt

SEQ ID NO: 140078 - DNA, 581 bp, Homo sapiens
aggctggagcagagcacaggagcatttcctctgcctggagggttgggagagccttctgggaggaggttatgcctaagccctgtcttgagggattgagtaagaattcacttaagcaagcaaggtgggatgggttgtagccaaagcaacagcatgagcaatggatggagtatttaggaggactacatgcagttgggggttggctggatggaacagtgtgaagtaggaattcctaggaaatgagcctagagagcctggtgagtgtgaacttgctggtgggccttgtgtaccttgctgaagaattcagggttatgggctgagtgctgtggctcacacctgtaatcccagctctttgggaggccagggtgggcggattgcttgagctcaggagtttgagaacagcctgggcaacatggcaaaccctcgtctctacaaaaaatacaaaaattatatgggcatggtggcgggcggctccagtcccagctagtgaggaggctgaggtgggaggattgcttgagcctgggaggattgcttgagccagcgaggtggaggttgtggtgagctgagattgcgccactgcactc

SEQ ID NO: 140079 - DNA, 355 bp, Homo sapiens
gtgtgtatgtgtgtgtgtatgttgggtggggcaggtgggaacctttggagaatgcctgtaggctgctagtgaggtgctatgatctctagaccttggtaggtccttgcaaagagacagggttctgaaaggctggcaccattataggtttttaaaatatttttgttatccataggggtgaccctggagatcattaccaaaatttaaaaatttcaccactgggcacacatgttacccttctcgtgatggcatggcaaagcttgatttgcaagagtttcttttggattgtccccaatgattccctttaaaaataggagctccttcaaggtaagaaaggaaggagaaaatatcccttcta

SEQ ID NO: 140080 - DNA, 405 bp, Homo sapiens
gggggtgcatctagccaaccgtgctcaggactctcatcagaagcagacatctgggctcctgcgggagtggggccgtgtgtgggttcaagggtgcagggtgtcaggttctgaatcgcttgttctctggggtttgtggatacctgagaactgcctgagccctgcgagtggatgtgccaggaccacaataccccaccccagtgcgctgtgtcgacacttttcctttccgtcctgttgatgcctggattttcctcccacctctgctcctcgccttacctctgggctcttttctacccgctgcgtgtgtgctcatgcaggtgtgcaggtggggtgctgctggagcttgtgccgtgttgtgggtgggcctccccttggcccctgagagcccagacagtatctagaatcata

SEQ ID NO: 140081 - DNA, 444 bp, Homo sapiens
gaaattgggggccggggagggggtgcctatccaaggatctttacctggaggcctgaggatggaagactgtgggccgggcagtagctctttctcttgtcactgggtcaggctgtgagtgagctgggggtgggctctctggtcatacctttttcctgtcccaccgtcttccacctgggataggcagggcagaggcttctgctgggaacttggggagtgccctggacgcagcttggcctccatcttctttcatctcacctcctagcctccaggctgagtttctgctttcccaagaagtcttctgagccataagcattgatctttctgatccctgcaaccctctttcctcgagctgtcagggcacagggacagaagggcctgcacaggatctgtgatctcatataatgcttgtccaggcgtggcttggctttcatgtgttaacatgca

SEQ ID NO: 140082 - DNA, 521 bp, Homo sapiens
ggcctcagtttcttacacatggacccctccatagctacttgagtatcctcacaacatggcagctggtttcttccagagcaagttatctgagcaaacctagggagtaaaccacaatatcttctatgtgctagccttggaagtcaaactctctatttccacaatatcctattggtatcacaggtccgctctactgagctgaattatacaagggcgtgaatatcagaaagtgaagctcagcagcatccatcttcaacctggctacaccttacatgagagtcccttgtgttgtcaagaggtaatagcaccagcctagacagagccagccctgagtcctggccctgtgtgggtgaatggcctgggggaaaaaacgtaacctgccttaccgtcagtttcttcatctatcaaatagaaataagagtagtacctacttctctgagttgtaatgaagattagatgagatagaataaataaggtcctccacagtgcctacaagatagaaagtggctataatggtaactact

SEQ ID NO: 140083 - DNA, 325 bp, Homo sapiens
ttgctatttctactttctcacctttcattctttcctcaactactccagttgggcttttatccccatgatgcctctgaaatagctcttatcaaggttctcaaggagctctattttaccagattgaatagataattctcagttctcatcttgttaaaccctttggcagcctttgaaccagctgaccactcccttcttggattttttttttttaacattgtactcacctgtttttcttcttaactcattggctgttaattttcagtattctgtatggcttccctcctctgcttaactctcctgaataaggttcccaggagtctacttt

SEQ ID NO: 140084 - DNA, 162 bp, Homo sapiens
ctggcacacaggtactgagcaaatgtttgttgaattggaatgaatgaatgaattctagtggtaactccatgaggcagggactatgatgcccattttgcaaatgaagacgctgaggcttggagaggctgaatggcttgcactgggtcacacagctgggagtgc

SEQ ID NO: 140085 - DNA, 307 bp, Homo sapiens
cgctcccacataaacactgctttccacaaaactaaaactgattaaaaatgactgatttcctcctgatttactagaaaaatttaagtgtcttgaaaaagtttcaatttaagatttccattcctattattctttcttaaatcactgatacattatatatctcattatatcagcaccctgtatctgatatgtattttagaattaagcttaatacatcagtgttgcgtggtattctgggagcagaaaaaaagtccaaggattgtgttattcaaataattaaagcccttgtatggtggggaacttaaggtcc

SEQ ID NO: 140086 - DNA, 334 bp, Homo sapiens
ttttcagctacctaactcggttctaaatcaaaacaccaggtacagtacagggtgaaaaccggtgagccatattgttaggatggacacctttgttatacaaacacactgagcagggctcaggagaatacggggcaagaagaaatatcttgtatcctgctcacaacctgctaatgaggacgagaatttcatcaacacacacagcagtagctcccattcatgtagcatcttaagtgagcatcaggcaccctgttaccagcatattagcatgccatctccacaacaccagctgtcacaccctgcaaagctgtgccaatattcccattttctagatgaa

SEQ ID NO: 140087 - DNA, 319 bp, Homo sapiens
tttgggggctgagtttacagttaaggctaaaactacagaaaacatgtagatagtgcacatccttggctgccttggtgcctcacacctgtaatcccagcactttgggaggctgggacaggcagatcacttgagcccaggagttcaagaccagcctgactagcaaaaccccatctctctattaaaaatacaaaaattagccaggcatggtggtgcacacctgtaatcccaactacctaccatgttgggtggtggaggcacaagaattagttgaacccaggaagtggaggcttcagtgagccacgatcctgtcaccgtactc

SEQ ID NO: 140088 - DNA, 132 bp, Homo sapiens
cctgtctctcttacttccactgtctactggccccctgtaacagcattccttgccagcaacaattctagcattcagccaactagcaagctatgaactgaatcaccaagtagactttaacagataagaaaacag

SEQ ID NO: 140089 - DNA, 160 bp, Homo sapiens
aggccaggtaggacgaagactgaaaactgactttgggtttagaaatgcagcactatcagtgtctgtgacagtagcaattttggaatagtggtggaggagaaaacttgacaagtggattcaagaaagaaagacaggagaggaattggtgacaatgagtaca

SEQ ID NO: 140090 - DNA, 357 bp, Homo sapiens
tgtggcgttctagaggatccctggtcgcgtatgggggctggtgtttgctaaaaggaacttaacaggggtgtgggtgtgcagttctccctctgcccaaggttaagtaatagtaacatcctgtgtaaagagaattgaatgtggttttctgctaaacttcaatgttttagggctgtttattagatgtgtttaatcttgggccaatttaaccagtagcagactaataaaataacagatttgggcttgctgccaggacaaatgttgacttacccttataatgttgactaaaacgagtaactttgaaagttattgcagagtgaaaccttagccagaaatacagcgtctgaaacagtggttttg

SEQ ID NO: 140091 - DNA, 109 bp, Homo sapiens
cggcgttggccatcccgatacccatcccgatacccatcccgataccggtctgaatcataacgatctcgatacttgtctccaaagctatcatcacctcttctaggtgggt

SEQ ID NO: 140092 - DNA, 430 bp, Homo sapiens
agacacgggtttggggttgggaaatgttggtgtcttaaatgtaaaactctatgtcaaactggatgttgagttgaagagaacaatattgttaatgtggctgaagagacaaagataaaaattgaaagaaagaaattatagtgcaataattaagaaagtttagtcaatctgggaaaaggggaagagggagaagagtgggctatccctgccacacccttttttttaccccttccttactgaccacacatatggagctgaaaaggaaagaatgtgggtttgaactgaaaaggttgcacaggattgacgaattgaagttcattgtgggggcagggtaaagctacaaatgtgattcaaactgcagccccaagaagcacctctctccatcagggaaaaaacaaaaaatgatctttgcttaaaagtcagtagcaagaaa

SEQ ID NO: 140093 - DNA, 718 bp, Homo sapiens
tgattgatggcctcattaatattttgtcctttcttcctatacatttagtactgtaactttgcctttaaaagtactattttggttttatcccatgaattttctgtgttgtattcattgttattcagttctgtactttttcccagtttccattagtatttgttctttgacctatgtttattaagttccaattgaacagggaaatttgaaagtgcattgttaactttgaattttattgggctagacggaaacatttctttgatatttgtggaaacttgcactgcagcttgatacatagacaatttttataaatgtgcttaaaagtagtgtaagttcttttaattgtggtatgcagggttataaaattatcagatcaaacctgtcaattttctattcagagctatatccttaaatttctttaactgcttgatcatcagagaaaagtatgttaaaatctctattgtaacaattttttttttttttgagacagaatcgctgtgttgcccaagctggagtgcagtggtgccatctcggctaactgcaacctctgcctcctgggttcaagtgagtctcctgcctcagcctctggaatagctggctttattggcacccacgaccacgcccagctaatttttgtatttttagtagagaggaggtttcactgtgttggtcaggctggtctcgaacttctgacctcaagcaatccacccaccatccatcc

SEQ ID NO: 140094 - DNA, 321 bp, Homo sapiens
tcgggtggcgttctagaggatcccgaaatgacacccacaaaaggggagaaaatatgtgcaaatcgtatgtccaatatggggctggtcatttcactatcttgatggtatccttggaagcacaggtgttcttaattttgatgaagtctaatttaacttattttttttaaactgctgatttattacaagtcccaagagggctttatttttggtcttcaacatccggttcttcagcttccttgtctcttggccggtatgccaaagagccgggcgtcagcatggaccatgtggagactagcgaaggctttgaaattcttctcctcg

SEQ ID NO: 140095 - DNA, 290 bp, Homo sapiens
gtcaatatgcctttcctaggcaatgtctcacaatggtgccaaaaatgagaatcttgttttctgcttttccactctttgaaatttgtggccttgagatgtaaggagtcgccgctaggagagcttcccggaaagcttttgcttttctgacaaaaggagacagatacagctagcagcccctccctccatcctgccctcgctcgagcattcgagtattactgggcaatagcagccattttgtgaccctgatatgacacccaccgggaaggaaacccaacacatagaagatagcg

SEQ ID NO: 140096 - DNA, 313 bp, Homo sapiens
cgtacgtaggaaaaaaagaactcagagacacacatggttttaagaggctgtgactgtcaactctgccccttcctattgaatattgaagcctttatgttattgaatacattgaatatattgcaaattggaaccccattaataggattctaagaagccttactactagatctggattctaagcctccttgcttgtatgataggttattgtctgagacattaagcaactagacctatgttgggacacttgcttcacaaggtaatgcgatgtattaataatgaggaaagaaaaattgccctgcttgtgctagtgagg

SEQ ID NO: 140097 - DNA, 409 bp, Homo sapiens
cattgtaggatatctacacgcctctacccgttagatgctagcagcacatgcatcaccaccaccccccaattgtgacaaccaaaaatgtctgcagacactgccaaatgtctcctggaggcaaaatcttcacccctcctccccaagtggacagccactgggaacagaatggggagaatgaaggggaataactgatgagaaaagactgccaaagaagcagcagtgaagcctaaggctcctggcaaaggactgcctcaaacagcagaagaagcatctcatcccctgagacaggaggagagggcaactctggagaagcagggatgacaaactggtagaagtgtgaagaaaatcaaccagatggctcaaagttctcagtgaagtggaggcaaggtcatgtgctgagtatgagtgg

SEQ ID NO: 140098 - DNA, 269 bp, Homo sapiens
gacattggaggagttttatttagtaaggctgtttgctgagttttggttggacagtggcaggaatggcttttgagctgggttataagagtagaggaatttcatttattcaacaaatatgtcaagcagtgttttgggcagcataaatataatggggagcaaagcagacaatgttcttgcccttgtggaactgccgatatcatgtggggaaaaaagatattcaagcaggaacagtgggaaaagcaaaggcacagctgagggaaagaaatttt

SEQ ID NO: 140099 - DNA, 409 bp, Homo sapiens
ccaccggcaggttgtactatctctggttttcagtgatgctatttctcctagggctttatctaccattgctttgtagaagcagggccagccatgtggcagaggtaatggttaaggaagtcaggtgagtgaagataaagacagaaaggcacagcagcaaggcagcatcaaataaaacctgagatagtactcctggaatgtatgacactgctcagaacctctgtgatcaagagttaattacataaaaaagaaataactcaacttttcatttacataaaaattaagttattttgtgatacatttctgttaattccctccttttcttcataatttctctggttgataattttagtatatagatttattttaggacatggtgaataagattatcagtgctaactctaaatgctaa

SEQ ID NO: 140100 - DNA, 401 bp, Homo sapiens
ttccttataattaaggtgggttttttgtgcattttgtaaacaacatatagttgattctaatttttgtaattcagtctacttttaaaattttaaatggctatttcaatctataatatactgatctagatggttgtaagtccatcatttttctgttatttttctatttgttcttttaattcattttttctgacttatttaaaagtgtgtccttaaatatttaattatttgattaaatacattgaataatccagtattttgttattcccttttaccttctctattttatcttatctattagcatttcagttttgccctactttattattcttttgaaattataatacagaaccttgatttattaccatctacctttaattatcattttctacaacttctcagca

SEQ ID NO: 140101 - DNA, 234 bp, Homo sapiens
ttaactctggtcaataggtaattctacaagttaatccttgcatatagtgacaccacctactcaaatgtaatatattcttaggagcaaatgcaacttttgagcactgaaatgtcctgtctgcaacatgtctctaagctgctgtcaccataacatttttttaatgatattgaaggtagaaatttttcctgggaaactcagattctcccaaaaatattcacaatttgatttattttt

SEQ ID NO: 140102 - DNA, 383 bp, Homo sapiens
tacgaaacttggaggacagattcactagacttaacatgaataacaagagtgcctcgaggagaaaaagagctagagagaagaagaataatagttaaataaaagtagaagaaaagttctctgagttgaaaagtcaggcaaggtgaatgaatatttcaaactacatgtatagacatttcctggtgaaatcctagaattttatggataaagagaaagttttatgcatctggagaggcagaattagaagaatcagactagtgccagatttctcatcaccagccctagaaagtagaagaagacaatagaacaatatctgtagatgatttatacaaaaaaaaattgcaatacacaattctacatcaagctcaataaccattttttgtttg

SEQ ID NO: 140103 - DNA, 885 bp, Homo sapiens
gcacatgcctgtaatcccagctactcgggaggctgaggcaggagaattgcttgaacccgggagacggaggttgaggtgagccggagatcgtgccattccagcctgggcaacaagagcgaaactccgtctcaaaaaaaaaaaaaatgccagggatctctctgagcatctcatgtaatccttgctatggtctgaagagatggttagtagcagggatcccctttcactgtgggagaaacagcttgggtagatgaattggctctgctgtgggtttgtgtgttgtgaaattccctctttatggcttgggaagattcggaatagcctcagggccacggaagcaagccggtgagagagctgccaagactgtggtgcacttcatcttttttttttttaattaaaaaaaaaaatgttgtgtagagacagggtcttgctatgttgcctaggctggtctcgaactcctagattcaagggatcggcctggccatgggcctcccaaagcggcggggattacggcgccttgagccacaaggctggagggctatccaaatgggtacgtgacgatgttcgatggtacgtgcctgataacctcagagccttgccgggtgtatgggcctaacccttgcgccatttgcggcgtgggaaaaaaccccttggatgggtactggctttggacgggggcgtgcaaaacctgctaactggtgttaagagatcccagccccacctgtcaacgcgggtcctgtgcctaccccgcgggtttggaatattccgccacagttttgccaacaacaccacgagcggtgggccactcgtaacaccacagagtcattctgtttccaaaacaggcacaaagggagccagtacaccttcgagatgcacgctaactcggcc

SEQ ID NO: 140104 - DNA, 138 bp, Homo sapiens
ttgtaaatcttgcaagagactggtttactttgaaactgaagcctgtaaaatccaaaaaagaatgaaatcaagtttgctatgagaagcactttcctcctgtatcctacaatccaagttgactgagagcagtgatctgaa

SEQ ID NO: 140105 - DNA, 354 bp, Homo sapiens
cagtgtactcacagtactcttctctatcctcaaagtttctgaatagcttctctgttcctgtctcctctgttattctgcctccctcctcccttccttgcctagtttaagtggatttttagcaaacaaaagtgttgactagaggctgtaagtgaagggcatttttacctcccctggcccccagtgtagattcctcttctgtctacacagaatccttcagatcaggataaaattgagccttccttactagttactacgatttttgaagaattggtgtgattgataaccacagcaacagtgtttggactttagagaaactttattcatgcccacactatgtctactgacctacatttt

SEQ ID NO: 140106 - DNA, 261 bp, Homo sapiens
ggtgggcttccatttaccaacactgatatagcttctaccaatgctaagtgtctaaactgccagcaacaaagaaaacgctgaactcctaacatggtaccatttctagaggagcccaactaagtatgtggtggcaacttgattatattgagtcccttccaaactgtaggagacataggtacattttaacaggagcagacacatattctgtgcatggtttgcctttcctttcttcatggcctcaggtcagcactactatccaaa

SEQ ID NO: 140107 - DNA, 2580 bp, Homo sapiens
ttttctcagaactcaattgagggtgggcagagatagctgatgctccagggcttattgaaggcctgtcacccgttctcacttcagtgcggcatgcagcttcttagcctgcagcttctttcttgctcctggagagctagaacattcatgttcacagggtttgggagcttttggttctctagggtatgttaactgcttaggagtccacctcgtacatatctgaagagttgattaccaatggccttgacctgtttcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttacagacacctcaggtacccagaggcggcagcactggacacttaggacgttagtatttaaggagatttttattaaagaagagttccctgctgcataagccaatggctattgtgagggaaatgtccctttgcctttaatttatttacgtactgggtatagatgaatgtctcagttgcatctgaaattgaatcattctaaagagaagaaaataagaaccaggtaaaaactgactagatgctgccaaatcaaacccaaggtctcctaaccgaaccttaatgggcctgcttctctcccagggcaagtagttaagagtctcattccaggaaccctttgtagttagttggctggcatgtttacttgctgctgtagccagccaagatgagtgcacctaggccctcaaaaaggatttttttttacctcaatctagcctgaccctcatatctgtggttgcctctgagacgaacatccatgctagtataaaaatagttaggaatgcccttggcagaactgaagctcttattaaatggtggacagagctcttgccagctttgatccagcccctcagtctcggagttatggggcagggttggggggcagtgctacactgtaaagaatttccaggctgggcgcggtggctcatgcctgtaatcccagcactttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtcttaaaaaaaacaaaaacaaaaacaaaaaggggggggcaaaaaaccccgagggcaactaggcgcacccgctttggacagggccaaagggcgaaaaagaagggggggggtacacggggggaacacccggggctggaggaccttccggggggatggacccccaaacggaaaaaaggg

SEQ ID NO: 140108 - DNA, 469 bp, Homo sapiens
tcccttgcttgcctagtcctataatacaggccaatttccctcctagttctgccccaggaaactcatctgaacatctgttgttacacaagttcccagtccaatacagacctaacagcatgaatatcattttctcatgatttcagggccctattaacattacataaagatccaaatatatcattttccagtatccaaaggcaatttttatcactagatgctatgatattgaatcctacaagaagtcttaaccctcttctaccaattttcaatttttttcccatatcagactacgaatagacttatacacagaaagaactgacagttttagaactgacatagagcctaaagaccatttactctaaagtactttgcaaatcaggactctaagcttacagcaattacagagatttgtaaaagatcataaaatgagttattactaacccgatctactagaatacatagaactccc

SEQ ID NO: 140109 - DNA, 301 bp, Homo sapiens
tgttctttagacagatattttgaaatcactcatcagaaaatattgatagatgagacatacatcacaaaaatccttgtagttgcaataaacaacttgccaatatatgcaaactattttcccctccattctcttgaattaagggagtatttaagggaggattgattctcctatgaagcaaccatttggatagaggactgggtgaatcaattagccacaccactgttctaaatactcagctttaacattcttggccatgtccagttcattctctgaccacaaaagttcagcttggttctttgcc

SEQ ID NO: 140110 - DNA, 305 bp, Homo sapiens
ccagctgggcatcgctggttactggcctaccttcatctcttctacttctttccactatcacaagattccaccttctggaaagctgaggataggctgtaccagcatgtcaaaacactccttagttagcagccactgatgttatgggtagtggctcttcttccttccgctctcttgtaagccacaaagcaaagaatgaggaaggagttagggccaagaaggacataagtcatcagggtgtaaaacaaagccatcctcagcacacaaaagaccacaatctaaccacctacctagtataccattcaata

SEQ ID NO: 140111 - DNA, 158 bp, Homo sapiens
catttcagcattctagggagcagatcagcttcccactgtattctaccttccacatgtattctaggccttggctttcgttgtctagtttcatcagttattatgctttcatttatgtcattccaaaaatttcatgaagtggctcatggccttttcattat

SEQ ID NO: 140112 - DNA, 299 bp, Homo sapiens
gcagcacctaggccttgagggcaggaatggtggtttactcttttctgattccctagcacctagctctagtgcctgccgtactcagcaagtgccctgtaaatgtctgcgaatggaagatgacttctagaagttaatcatttcaggctgtacaaaccttcaggggatgctgtatcttgggctctcccagtggctggcacagtagctggccaaaggctttttctgtcttctgatggatggtggaggctctgcctccctctctggggcacatcagattgtccagtctgaaactgaatccaccc

SEQ ID NO: 140113 - DNA, 350 bp, Homo sapiens
tgttggtcctctgcaatgaaggggccaatctcaagactgaaagggaagtggggcccagtccaatcacctgatatttgatgccagaatcctggccgatggttaccctccctcaggtcagataattgcgattccaaggatttgctgcctgtttgattagggggctgcctttccctgagcaacagcagcggggtaagacccaagccatggaggcaggtgcattagccccagaccaaagcaccatgctccctccctcatgattgcttcccctctccagggttcagaccccgcagccagcaaacatatagttgttccctgaaaacagaaaagcaccctctcttgaccccattttt

SEQ ID NO: 140114 - DNA, 542 bp, Homo sapiens
aacaaggggcttgatcgacactatagaccaaatggacctgataaacatacacagaacattctacctaatagcagaagaattcacatttttcccaagaacacacagaacatttttttttaatagatcacatgctggatcacaaaacaagtcctatcacatttaagattgaaataataccaagtaccttttccaatcacaatggaatgaaaccagaaatcaatattagaaggaaaattggaaaattcacaaatatgtggaaatgcaacaacatactcttgaacaaatgggaaattagaaaatatctagaaacaaagaaaataacataccaaactttatggaatgcagcaaatgcaatactaagagggaagttgataacaataaacatattaaaaatatctcaaataaaaaatctaaccctacatgttaaataactaaaaaaagaagaacaagctaagcccaaagttagcagagaaaggaaataatgattaaagcgtaatggtggcttatgcctgtaatcccagcactttgggagcccaaggtag

SEQ ID NO: 140115 - DNA, 171 bp, Homo sapiens
ggcagataacagtaccacctggtctggttcctagccccaggacccttacagtctaactgggacacaagggcttgaaatcaaattgcctatcagaagatatacaaggagcatgagaaactgctacacttatgtattaagtgctctaagacttagaaacaaaatgcaatgctg

SEQ ID NO: 140116 - DNA, 806 bp, Homo sapiens
gacagtacatgaaacattgtaggaagaaagaatgaaaggaaaagagcacctatgaagagttttggggcacctcctaaaactaaaggtctggtagtggaaactcagaagtaattgccagttaaaaaaaaaaaggcaaaccacaagcctgtcataaaagtggtatcacaaaaattgaaagagtgtttccaggagggactgctcagctatggcaaaaggctgcaaagtgttcattggaagacagccacatagacatcagggagtcatggagccagtgcattggtgggcccgggagccagaatggattaggaaatgagagggagacaatagcttgttgtcagcatatggctactagttgtagaaaccttggcaagtactcaggggattgactgcttctggcgtgcctggagctgttgagcccagaaagaaacaatgctgaaaagggattctcatcttgtgacctgaaaaaaaaatgctggtaatagccacttaaattcatcagaatcccttaaatcacttaaatttctcagaatttatttgggggcttattgtttagttttttgggtttttgctttttaattacagatactaacttgagtacattctacctctcccggtttccataccccctgctatgttgagattcagccctccttacccagcctgcgttattgtgaagtttgtagaccagtgctctccacttgaactttttgtagtgatgggaatccctgcccagtaaagtagctcttagccacatgtagctattgagcacgtgaagtgtggctcatgtgactcaggaactgaatttt

SEQ ID NO: 140117 - DNA, 218 bp, Homo sapiens
atgaacacctaatttgaataacacataacactcacaaactgtcctcttcaaccaacagttgcagtgattcaatctttgggggcctggcccaaatgttctctttcaaacaaatgccaaatgtgattgagattttaaagccagcaaaatacaggtgcagtggctcagcctgtgatcccagaactctgggaggctgaggtggctggatcgcttgagtccag

SEQ ID NO: 140118 - DNA, 122 bp, Homo sapiens
ctcattatttattaaaaggctaattacaagaaggattcattgaaaaacataattggactattgcctgaggagtatgtcatccatcctgaaatgcaggcttctctaagttaggctggaagaga

SEQ ID NO: 140119 - DNA, 431 bp, Homo sapiens
acccatccttaatgtgtgcccatctccataacgtctgcccacaaccagcactctatttgaaatccagacgaccctatccagttggtttatcttccaatctttcttgtttccaacccactcggcagattcatcttcctaataaactaccgaaaataaaaattttcaatggctctctattgcctgcaggataaaagtgaaagacttccctcccacccttaacattcaagccctccaaaatctgatgtaatcctgcctttccaacttagccttctactgacgccaaaatcaaccatgtgctccagatggtctattcgttaaccatagcccagaaatccacgaacatacctgtctctgcaccttcgctcttgccagtgtctgatttggaatattcacctcttccccttcctgtagattttgtccacagttcaaag

SEQ ID NO: 140120 - DNA, 1143 bp, Homo sapiens
aaatgtaaaaaacacataacatacaatttaccacctgaaccatttttaagtgtacagttaagtggtattacgtatgttaacattgtggtacaatagatcttcagaacttttttatgttgcaaaactgaaactctatacccattaacaactcctcagttcttctccctccagtccctgaagccaccattctcctttctgcttctatgaatttgacatcttctagatacctcatataagggaaatcatacagtatttgtctttctgtgactgccttgtttaatttagcataatgtcctcaaggttcatgccttcctttttaaggctgaaccttaaaaaggtaatatatattccacttaaaaaggtaataaaataattacttaaaaaagtaataatattccactgtgtgtatataccacattttgtttatccatccgttcgtggatacttgggttactttcaccattggctgctgtgaataatgctgctacgaacatgtgtgtgcaaatatctccttgaaatcctgattttcaactgttttgaatatgtacccagaaatgagattcctggaccatatggtgattctatttttaattttctgaggaaccaccatactgttttccatagcggccgcaccattttacagtcccaccaacagtgcgcaagggttccaatttttccatattcttgtcaacacttgttattttcatttttttaatagtagccatcctaaaggcgtatgaggtgatatctcactgtagttctttacggattcttgatatagcacagaatatagtcatagaaaatatttctattatctctaagttagtgaaattatgtttcatatagtatacaaacaataaatttatcttacagttcagtgtaaggtaaagcagatccttattcagtcttgttctgagatttgtgtttttaaagatatgttttgtgttgcttattttctaaattccctccatttatgttaaatctccttcaccatacaacttctcaaatattggaagacttgatttgcaatgattttatggttttgtcagtctgctttttgcatgctgacttctttagcactgtgtggaattgttctgcttcatccagcattttaagctttggactgtcacatgcttgtcaaaa

SEQ ID NO: 140121 - DNA, 304 bp, Homo sapiens
cagacttgtggcctgcccaagtgtcagaaggcttactgaatatgtaagtactttcttgccttgtcctttaaaaagtttagggaattcacttatatttctttttaccaatttgtttttgagggaacagtgatttttaaggtttttcagatgcataattccttttggtacttaactccataataatcactgaataaagttaccttgatataaatacagtaggtaaaatgtaaaaccctctgaagagagggtgaaaatactgcaaagccttccaaatagagaggatagtaaaatgccattttaactt

SEQ ID NO: 140122 - DNA, 3607 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaagggagcatcacagaaagaagtgaatgcccaaagcagtgatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140123 - DNA, 1693 bp, Homo sapiens
ttttccttattggataagaaaaacgattaagcagtgcatctgcttttaaaggattattgtttacaaaggtgtaattattgaatggtcatctagtaaaacaccaaacactaatatgtgcaaaacccctagcaatacagttgtcactgctgggacttgtggaaggtgtctctgtcagggttaggccttttattggcagcataaaggcctagagtgcctccaaaacacccactctgttacatttgtttagaatatacttaagtgcagattccagaattaaagagaagaaagtcagtttattatgagtagagattaaatataataatgaagaagcaagatgtagattcataaaaaggcattgttacgtagtagaaagaaggcagactttgggattcaaacatttctaggtttgttaccccagttctcgttattgtgggtcagatgaattccttaatccctcagagaaagtttcctttatacaattaaaataatactacctgcctaacacattgtaaggatcgataattaaagcacctagcatctaattagtgttgttaatttcagcactattgctcagcaagtatatttcctgatgtttccttccaaaatgtctattagaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140124 - DNA, 960 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagattttctccaggaaacatgttttacttgtgcacgttcagttttcaaattttcaggtgtgaacgctggtgagagctgcttaaaaacaaagctatgggccgggcgcggtggctcacacctgtaatccccacactttgggaggctgaggcgggcggatcacctgaggtcaggagttcaagaccagcctggccaacgtggtgaaaccccgtctccactaaaaacacaaaaattagccgggcgtgtggtggcgggcccctgtaatcccagcttctcgggaggctgaggcaggagaatcgcttgaacccgggaggcagaggctgcagtgagccgagatcacgccactgcacccttctcactgcactggtgacagagcgagactccgtctc

SEQ ID NO: 140125 - DNA, 1203 bp, Homo sapiens
gtttgcaccctgtctcaaaaaatgataattataatagaaaaatattttttaaagatatatactatagccccaaatatctggtactgtagaatattcaattatcctaaactgttcctattcaataagattttgcacacctgaaattttgactcttattcccatttagaatgaatgcctgaaagggctgaagatatcaggtatcacccagttccactcgggataaatgatgcagagtgctacataatctttaattcagagctattccccagctacttccacactgcaggcctcaacacatgactgggtcccactgttggcaaaatacacttcttcctcatattgataggttccttcttacttaacattttagtagatttgaaataaaactcaaatggttattcttaataaaaggtcattcctaattggtggatgttgggtgagagaacagatcatatttttgaggatggttaatgttaatatgaaaattgatataatttggttcattggtagttatttagggtattttatgattcttttcaaatttctactttctaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140126 - DNA, 3477 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaaggatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140127 - DNA, 1713 bp, Homo sapiens
tctgcggcgtgctgtatcaatgagatttgcctcagggagcgctcagtctgcctcgattcccaggcaagacttacgtaacagacagaggctcacctactgagtgacgtctgtatggtaattgcgttgagcacacggcgcagacgatgatgacaatactatctgagacattgagtaatatatatctagcataagcgtatggagaatcttatagtggagcggtgtcctagcattcgtgaaggtggagacgttcatcccgagtacagagactagcgtaccaagcaagtcctctttagacaaagcttgccttaaagagatcatagatgaataaatagatctctatctccaaagatggttctagattagttgatataccccataggcatgctattaactgattgggacatagccgaagatgaatagattaagcattataactggaattattcgcaatttatctagtatacaagtatatatagcacgagcgcaggctaatgttctggaatgaaaccagccatttttcaacacaattgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140128 - DNA, 2515 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaagtaggctttgtttcttctgtgaatgcctacctcttctgcctgtttctctgtctcttgctcaatacctgtagctcattttcttagattc

SEQ ID NO: 140129 - DNA, 2058 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcagatccacattctacacatcctgcctagacgttcatctctcatacttctcaaa

SEQ ID NO: 140130 - DNA, 459 bp, Homo sapiens
cttgaagttactagttacagagaacaggaatctatacactcataccataagagaaaggaaaatttgtttttctcctctctatgttgagggagtgctgggagagtcccagagcacattcctttgtgtcctggcttcttagatagtattaacaagactttttctgggtctgggctgtgcctattgctgcctctgggataagtcatcctaatacaggaaagcttatttctctttttaattttatttttctttctttaattccctgcctcacaggagcatcacagaaagaagtgaatgcccaaagcagtggtgagatttgagagcacattataccaccctaataggtgaaagggaggagcagaggggcacttctggaagaacacatgacttcaaagataaatgggtcctatgagaataagtgaaagatttgtaacagtgtctgtctgagtatagtactgactt

SEQ ID NO: 140131 - DNA, 3505 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140132 - DNA, 3030 bp, Homo sapiens
ggcgtccgactcctcccatgtagtgatcggtttagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaaggatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacaaaaatcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaata

SEQ ID NO: 140133 - DNA, 3132 bp, Homo sapiens
cgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatagtctcactttgtcaccagtggcacaatctcagctcactgcaacctccgcttctggggttcaagcaattctcatgcctcggcctcctgagtagctgagattacaggcgttaatgaatcacatgatgaatgtgtggagatggcggctagtgggcaacagagcaatactggaatagtgctaatatgaggaaatggtatcatctatttagaagcctcggaacgacgatacataatgactatcttcagcaaagaaatttgttgcttacaatatctcctctccaaaaggcttgtttgttacagtgatgtaaaaattaggttctgtacatcttcatattaaacttactttgtgaaaactttttgtttaaa

SEQ ID NO: 140134 - DNA, 328 bp, Homo sapiens
ttgaccttgtgatctgcctcccaaagtgctgggatcacaggcatgagccaccacacccggcttaaaagcaattttaagttaagattacacaatgatcatctttagtatttcctcccaattaaggcatcttatctagattttactttataggaatggtcacattttgtgtctgggactaataacatgctgctaccacccccttctaaaaattatctcatgaaaagctagtgattaattctcttactgaggtggttatcttgtctgtccattaacctctgaactcttcttggccatccatgtgggaattagaaagcaggcagagccaagg

SEQ ID NO: 140135 - DNA, 156 bp, Homo sapiens
ctggccccgggtggaatactattgccacagaaagacaggttagagtttgaaaacaagatgtactcacatttttcttgcctagtccatcaagtttcaacaagcaagcagtacatattttcatcagacatttgccatagactcaaaggatcatcttaa

SEQ ID NO: 140136 - DNA, 380 bp, Homo sapiens
ttatatcagcagaatcatacaggatctctttttgagactggcttttttctcttagcataatgttattatggctcacccatgttgtagcatatatcagaattttctctcttttaaaggctgaataatattccattgtgtgaatataccacatttggttgcgaatgtttttgcatctatgatttaaaaattatattcgaggttattagaaggtgattttaggggttctttaaaagaaaggctaatgttggtgtctgagaaccaggcttctgggagccaggaggcatctggccagagcagtgcagcctgcagcccagagctccaggtctttgcgtgacccacgcactggtgctcatgttcctccaagagcccgaaagaagagc

SEQ ID NO: 140137 - DNA, 333 bp, Homo sapiens
gagattgttgtattaggtgaaatcattccaatttcttatatagctgcagatactccatcatgctgatggatgtaggcatgggatggatcacataaataaatctttcctatgcttgtttcagaatcaggagtcttatggtattcatcattgaatcagtggtcctgacttagcttgaggagtgtattagtcattattaataattagtaagtgaataaaagcacataattttttataaggatacctagaattaaagcaagatccctttcttcaggatgcatactttttaaaatggatatttcaataaaagacaattctcatatattataatagttc

SEQ ID NO: 140138 - DNA, 418 bp, Homo sapiens
ctttgggaggctgaggcaggtggattgcttgagcccaggagtttgaaaccagcctgagcaacatgatgaaaccctgtctctacagaaaaatacaaaaattagctgagcatggtggcatgtgcctgtagtcccaactacttggaaggctgaggcaggaggattgcttgagccctgaaggtcgaggttgcagtgagccctgaaggtcaaggttgcagtgagctgggatcgtgtcacctgcactccaacccaggcaacagagtgagaccctatcttaaaaagcaaacaaataaaaaaatatgggagtgtttttccctaccagcaagcaatcagttctgcatcaggcaccagctaggtgtcatctaacttaatactgacactgtctacttgagatagtgtcacatcccacagtttgaggtct

SEQ ID NO: 140139 - DNA, 529 bp, Homo sapiens
tcaaaatggaaattgaagagaaaaattaacaaaattaatgacacctatcaccaaggccacacttgcaaaaatagtatcagttcaacttatcatatatttattgagcactaagtgatgaagggattgaaaaagcttaaaaaatgttaaatgcagggatctcaggcagcttcatagaaaagtcacatttggattggaccttgaaatttttttttcctaattctaaaagtaatacaatggctgggcatggtggctcatatttgtaatctcaacactttgggatgcccaggcaggcagatcacttaagcccaagaatttgagacaacatggcaaaaccccgtctctacaaaaaacaaacaacaacaaaaaaacaaaacaacaacaaaaaatcaaaacaaaacattagctgggtgtgtagcacgtgcctgtggtcccagctacttgagaggctgtggtgggagatcatctgagcctagggaggtcaaagctccactgaaatgtgatcatgccactgtgctccaacctgggcaac

SEQ ID NO: 140140 - DNA, 250 bp, Homo sapiens
tcaaaatggaaattgaagagaaaaattaacaaaattaatgacacctatcaccaaggccacacttgcaaaaatagtatcagttcaacttatcatatatttattgagcactaagtgatgaagggattgaaaaagcttaaaaaatgttaaatgcagggatctcaggcagcttcatagaaaagtcacattgtcttaggtcttaatctattaagacctaagacaatgtttactttcttatatagaaacttctgac

SEQ ID NO: 140141 - DNA, 423 bp, Homo sapiens
agtgtctacaatgtgtaagcattatcacattcgttaacctttctttgaagtagaaactagccaatgagtgtttttcatctttacacaacttacagttgaaggcaaatttataatctagtaataacactttctaagtactgagatgattagaattgggggatacagacagggatgcattaagattttaattcccaaagaatttcttgacagtctttatagctgtggcttaataaagcacctagaagtagaacagagtcaaaggggatgacacttgttgactccattagtctaaagactccttatgatatcagctttgaggcttttcaaaacgaatctagtacatatagcctatgatgattgacacttgatgaaagaggcctaactgctaaatacttttgcctgacctggaaagtaaagacatct

SEQ ID NO: 140142 - DNA, 431 bp, Homo sapiens
cctgtgttgccatgtagaagcccccatcgtgggtcatagtacttgccgcagtactcttaaaactaggcggctatggtataatacgcctcacactcattcgcaaggcccctgacaaaacacatagcctaccccttccttgtactatccctatgaggcataattataacaaggaaggggtaggctcacagggttgcggaattgagaagagtgtggccagagtataaggtgtgcatttataggatgggtgaataaggctggaatagcacttgggagaaggctggaaggccttgagtggcaggcagaagcatctgaccttcatccttgagggaggcaacaaggagctgtgagacattctgagtaggatgccaccagggggaagtctgggtctgcagcgacctggagcagagagggaagcaagctctgatgaaatg

SEQ ID NO: 140143 - DNA, 418 bp, Homo sapiens
agcggatgcagtgagctgatatcatgccactgcactccagcctgggctgatagagcaagactctgtctcaaaaaaataaaaacataaaataaataaataaacaaacaagccaaacttaggaatctaaaaccaaggtcacctcacattcaacatgtcccaaatttaactcattgtaaatacctcaaaactatcttgccatagctactggaacaactatcacactggaggcaccttagtgtagggtctacagatttattgagagggtgtgtggaaaaaggacccagctgtattccattatgaaatgaacagcaggtgaaaaagaggaagagccaaatgtaaacaacaatgcaagagtctggctgggaaaaggagaaacagaaatcagatcttactccagcctcatctttgaaaactgaat

SEQ ID NO: 140144 - DNA, 790 bp, Homo sapiens
actctctgatagtaatctgtggacaggtcacccctgtggctgcggctttttccctagggtaagaggaagtagtattttttaaattagcctaggagggagccaggtagagagctctgagatgagggtggggagcttcagctcccagccgaagcatcctgatcatttcattacaagatcaccttctcctgtaggtgagtttctgttgttttaatcagaggtaacgttgtgccctgactatgttgtataattgtgtgtgaattatattccagctccatataggcgagggctatttttttccttccaattttaaagctatttagagggaaggccaaattgtagcttgaaccctggtgctctctggctaatagctatatacagggagggagaacttggaggaacatttggggttatatttgtaattagtttcctttgaagttaaattaattttagcaatcggcaacgtaaaatattgttatacctttttccagtggtcacctgtgggtgacctgaggcctgtggaattgatgagagacgaagcggtgggaatggtgggcaggcacactttcttggacatgtgggcttattttaagtcatttttgcattcagactcttggcttagggatctctctggcctgtcatttttttttgacagctttattgagatataattcaaataccatataattcactcatttaaaatggtgcaattcaatggattttagtatattcacagatatgtgcacccatcaccacagtcaattttagagcatttttatcacctcaaaaagaa

SEQ ID NO: 140145 - DNA, 295 bp, Homo sapiens
actgcgcctggctggatttgttatttttaatgttcaggttatcgtccagaaggagctttttgaaggatagaagtttcatgaaatgtggtagtatataaataaggatgatgtttaaattatctatcaaaaattaaagccatggtgtaccatttcaacagtgtttatactttgtttaaagaagaatgggatctctatttatgtataattgcaatattttgtcattttgtgggacctcaatgcagtcaataagatggacctggagaggtggaagataattaactagaggagtaggcac

SEQ ID NO: 140146 - DNA, 144 bp, Homo sapiens
ttaaaggaaaggctatgacccgtcttctacgctctccatcctgcctcctggaacgtggatgtgatgaagacccatcttgatccacgaaataagggaaacagaacttaagctatagatgcaagaagcagagaagtagcctgggtc

SEQ ID NO: 140147 - DNA, 334 bp, Homo sapiens
aggcccagaattgacatagatgatgacggaattagcagacaaggacatgaaaacagctattataaatacattcagaatgctcaagagtataaagaaaaacatgaacgtaatgaaaggaacagaagatataaaaagaagtgaacagaacttttagagaatgatatacacatatctgaaagaaaaattttactgaaagggattacacagattagacaccggcagcagaaaagatgggggaatttgggccaggcacagtagctcatgcctgtaatcctagcacactgggaggccgaggcaggaggatcacttgaggctgggcctctgctctccgggt

SEQ ID NO: 140148 - DNA, 544 bp, Homo sapiens
cactttgggagccaaggcgggtggatcgcatgagcccaggagttcgagaccagcctgagcagtgtggtgaaaccccatctctacaaaaaaatgcaaaaattagctgggcgtggtggttcatgtctgtagtcccagttacttgggaggctgagtaggaggatcgattgtcctgggtgattgaggctatagtgagctgtgattgcactactgcactccagtgtgggcagcagagccagaccctgtctcagcaaaaaaaagaaaaaaaaaaaagaaggaaacatttgaacctggagaaaagcaggaagaactgtagcaaaaccataaacctgtcacccagactagctgaagcatttcacagtaaactgcagacactctagctcttcactcttacatacgtcagcattccttttcataaaatgatgttttccaccagaaccacaatgggagtagactgaaacatcaccacacagtaccaccatccgtcacacctaaagcattggacaggagtcctccgtgtcctgaaatgttcacttgggtacttcat

SEQ ID NO: 140149 - DNA, 271 bp, Homo sapiens
tacatttcacatggcaccctttggctggagctgagttgttgctgtctcctccatacaggtcatgtgccttccagttcagtaagatcccaccaccataccccaacttagtatttgaaggggtaacccctgctcaatagtcacttgttgctttgggtaccaaacagaatgatgttccccaagctcagagctgacagctcttggttactgctaaaaatcagttcaactgtccaagtaccattttctaccactgagtatcccagtaaaagtattt

SEQ ID NO: 140150 - DNA, 315 bp, Homo sapiens
ctgggaaaagatgtgtgttgcaattttacaaatgggattctctatataaaaatagtataattctccactggagtgataatgacacaaagatgcagtgtatgtgatatgttttatggaagagttgaatatttttgttttgctatgactttaaatagtttttccctcttaatgactttttatcccttccagcgcaacagaaaatttagggagatagcattcttttgcagttagatttattaatttcccagtaattattatttcaggttagaacatatgccttgtctctctctaatacataaacctgttttttaatag

SEQ ID NO: 140151 - DNA, 221 bp, Homo sapiens
ctgatgagtccccttctatattgaaaatgctggtagaaacactgaagccaggaaagcagaggaataaaggagggcagggcattgaggaaatgaggccaagggtagagcgatcatacttgaacctgccaatcgtgaagcaggaatctgtgctgccttgggaatggagaggctggggaggagtctcgagccagccctttggctgtggccagggatgggtcatg

SEQ ID NO: 140152 - DNA, 423 bp, Homo sapiens
cctgcagagaaatagccaaatcagtgtgaactactggcttttatatacatatgttctcacatcagcttactcatgactgccttctaaagactgcctctttcaggaatcctaatagaaaaagcaactaagagaaagaaaatgaatcacgtcagaggttacagaaattataacctacaccatctttcacaactagaacatcatataaagctgtttcattatttttcttactccttttacacatttttcttactcctctttgtcttgttcctatcagcccagggactctgttgcattttgctttactttctggtgtttgtaatataaaaacaatttatctattgtacatgttttccatttccagtacatacacatgcacaaaccccaccttcacctcaggctttgatttgactccaccttcaagct

SEQ ID NO: 140153 - DNA, 340 bp, Homo sapiens
gggtataccatagatggagaatggagagatgggagtcagggcaagatctcccaagatgaggccctggcacagcccccttcacctttcagcttctgcccgccctctctactctcctggctgcacttgttgcctgggtgatactacattctccacattctccaaataccagtcccaggggctctgtcagcgggaggggctgttcttgctgcagttaggggagagcctgcactgaagagagaggttgcactgaagagagaggttagcaagggagacgaagtgttgcaggtagcagaagcgggggagagaagaaggagagaaagggagatttagaagaaatgag

SEQ ID NO: 140154 - DNA, 506 bp, Homo sapiens
cgggggattaagtgtggggatgggagttgatatttttggaagggtagacagggaggaaggtatatgagtctgctaacactgccataacaaaaatagcacacatgcctggcaaatttttgtatttctaatagagacagggtttcactatgttggccaggctggtctctaactcttgacctcatgatccacctgcctcaaccccccaaagtgctgggattacaggtgtgagccactgtgtccagccaatttttgtatttttaatagagacagggtttcaccatgttggccaggctgatctcgaactcctgacctcaggtgattggccccccctcggtttcccaaagtgcagggattacaggcgtgagccaccacacacggtcagctactttttgtttttgaggtggagttttgctcttgttgcccaagctggagtacaatggtgtgatcttggctcactgcaacctccgcctccctggttcaagcaattctcctgcctcagcctcctg

SEQ ID NO: 140155 - DNA, 533 bp, Homo sapiens
agaattccagtagcttcctccagcaagactgcacaggttagtttgggagccaccactcctgagctgtggtttcccttgccaagtcagactccttgggaaaactctaaaactaaggtggcctgacatgctgcactaatggagaaggccaggaaagcctggattctgtgtgtcctcattgtgctccctcatcgatacactgtctctcaccagcctttggaatttccttcctttggttttctgccatttttttctacttttgctgaacttgagtctgaggctttcactgctcaaaccgcccttccaggttgtatttaacagggcttaacaagcaccaccaggctgggcgcagtggctcacgcctgtaatcccaacatattgggaagctgaagtgggaggatcccttgaagccagaccaagcaacatggtaagaccctcttgttcctggaccaaactgagggttgggctgctatttctcatggcccagtaacaagatgcagatgaactagggaggaagagagtttttatttctgcaa

SEQ ID NO: 140156 - DNA, 189 bp, Homo sapiens
cctctgggccacttggagttttccatgtccttccacgtcctcccatgcccttctgtgtcctcctggtctgcacggtgcctgtggctcagtcctcagacccggatgatctcatccagtctcatggctccttttgtgctgacagttcccagacatctctctttagccccagaactgcagactcagccctcc

SEQ ID NO: 140157 - DNA, 423 bp, Homo sapiens
tcatatatcagtgaattaattttggagtattgaaacgtggaaggtgctgagtgaacagtatcttcctagaactaagcattaggcccttgaatatttcacctcctgcaaggaactgacccagaataaaataagtggcaagtggaagatatttctaagaagggcttataggtaggtacctgggatgcaaggtggggagcaagcagagtatcaggaaggtgtttaaaagtagccagcactcttctagagaaaggtgggaagacctccaaacacatcttaccaatgagatctcaatacccctagaggcaaatcaacaacaggttatcaaagtaattcataataggagtttaccaacagagtttaccttaccaggtatagttgataggtcaaagagagcttgataaactaaatagagatctcattggt

SEQ ID NO: 140158 - DNA, 427 bp, Homo sapiens
ctcctcactcccttgctggctcttttttgtgaacttgaccttgaacatgttggcacattctggagctcagtccttactgtaccttgttttattaccctctcattcccttactgatctcatcctgccttgggcttttaaatgccctccagattccaatgactcccatgtacgcctccagcctggacctctgtcctgactcctgacctccaaccaggttttcaacgtggatgtcaaagatacctctgctcacatccaacacgtccaacactgaactcctcatctcctcccacctccctgtctgggttggtggctgccctgtcttccccatggcttgggccaggagcctgtgtttgttcatggttcctttttctcctgcaccctacatccaatctgtcaggaaattgtcgttccattgccccagcgcatc

SEQ ID NO: 140159 - DNA, 177 bp, Homo sapiens
agcttagtataaagacaaaggaggagtctgaacgaagcgaccacggtcttaggattcaatcacacttattattaagtgtgacgtgcatgatgtggcatcaagtactggcttctcttttggaaagtccaaaatattttccctagaatggatgctcttggagtcacatggccagaatta

SEQ ID NO: 140160 - DNA, 258 bp, Homo sapiens
tatgaagtgcccgggctgtgtttgtgttactgacggcccgtgatcggctatcttctctcttgtctcggagtcaaataagcagggggattgttggatctgtccccttcacctcccttctgtcgaaggatctcacgctcacattgtcttacttttctctcgtttttcctatccttttaatctgatctttaaatgtcagtctctgttctcatcttcctttttaacgagtgtgggtttctcatgtttatcttgctctccttt

SEQ ID NO: 140161 - DNA, 427 bp, Homo sapiens
tcctcttttactatgggtggaaaacagttgaggttagacaccagccaagttcttgcttttaagtttcagtttcagaagaacatctgagaaaaaacgaccaagtgaagccttttctggtttcacacctagtaagtccttgatacttaggccagcatcccattcttgctgaatctgaaataggcaacacctaactatacaggctctcatctacttccgaaggctaatcctccaggggcaagccagcagacgtgggcaagtggtgataacatccctgagacagagggactacaagcttcactatcatttctgagtgagttttaattttcagatgatgttagtattgtttggcttcttatagtagtcttttggttcagtacctgctaattgcttattgtttattattaatattatagactatatttttata

SEQ ID NO: 140162 - DNA, 391 bp, Homo sapiens
gaggccctgccctcccctgggcttggccgtggctccaggcctggcgtccaacttctctgagcaggagcctcctgtctgtcaaaaggaactggtagtcccttcctctccctcactgtgggtgtcgcaggatcctgggaggagatggtgtgcagggcctggtggtgtgaagggtgacaggcgtggaggggactactgccacttcactggccacctgacgtgggcccagagtttgggtttcatgggagagcctatgaatctcccagaatggtttaaaccaaaaggtttttgcacgtgcacttgtcagtgggagagcatgtttttcacattctccaagggggcacgtgaccctaaggcagtgtggcacagctgatttacaacaaggttcaatagt

SEQ ID NO: 140163 - DNA, 467 bp, Homo sapiens
ttgtctctgtgggcacctggattctgcaccgcaggaggagagctggccgtggcccggccaggaggggagtaaacacccagcccagccccacctgcccccatctgtgaatagcaggagggtctctataggcaccctgggtctaatcagttgtgtgcgggccacacactgagtccgtactcagcaccagcctgggcctttttgggatcctgcagagaggaagagcaggccctgccctcacagagcactgagtgctggggaaacaggcactgcacagattgacaggcacatatgtgggtcaacaggctccataactggaggctgtggctgtgctgtgaatggaaacacacacatactaatgcacacacacatgcacacacaggcacccacacacgtgcacatacacacaggtacccatacacatgcacacacacgtgcacacacatgaatgcacccacatacgtgcccac

SEQ ID NO: 140164 - DNA, 109 bp, Homo sapiens
tcaactctcagagctcagtgaatgaatatcctctgggctctgactccatttccatcaaggcaccctgtattacaatttcccctggcctcagatttgctacagtgagaat

SEQ ID NO: 140165 - DNA, 520 bp, Homo sapiens
agaggatcctccgggggccttaaccctatgcacagggattgtgcccagagcacatacccatatctcattctctgtagcaacagccacacccatgccccaaccatttaatagcttctcagcctgtcctattctaaggcaggaaagggtcggtggcagttccagccttatcctcaaggtctgacacaatcgggcttttacgaaaggcatgttttactgccacctgggtctagcctagtgaccctgagaccctgcctcttcatgactcctaagcccatcttctgtgcaaagccccagagctaggggcttccagaggcatttcctgccttattctttgtgccttaatctgtgtcccaggatcctgcccttgcgctcaggttctctgggctcctactagtattccccaaacctggtgggtgctgctagaccacagcttgaactcccaaacacctgcaacaggcccccaagagttggacttcccattcacgtggattttagaactaagcctacttctggatttccc

SEQ ID NO: 140166 - DNA, 239 bp, Homo sapiens
ggacagggatcagccagtggagagaggcagaagaatgggccccgggatatggtgagtaaagccaagttgcccctagacctgggacttgggcaggataatacagccaggggaagcaaccatgtggacaacaaaagagggaacagatggaggtcagctgagggacagtaggctgccatagcatgggaaacgtcactcaacttgggaccaaactgtagctaaccaactcccatagggcatct

SEQ ID NO: 140167 - DNA, 424 bp, Homo sapiens
ttcacaggtccatgttagatatttaagatagtatcaattcagagagttcatttaatttggccataccaagctgacaatgctgagatgggttgttgctgacaaatggaagacaccaaaaggccataactcaaaatgtttaagttcactacaattcatgcagattacaatggaaagtcactaataaacatggcatcaatgaaaagtgaattaggacgtgtgatttttgcttgtgataacaatttcatcagctcactcagcctacatttctacataaagacgtctctccaatctagtggatgtctgaggcatggtggggatggggagcaagtggtaaagtcaacagtccttcataaattttcttacattctcatttctggtcagaattgttttcacataagaaattttaaatcaacaaaaccatcct

SEQ ID NO: 140168 - DNA, 353 bp, Homo sapiens
gtttcttgtgatactcatttagtctccttgtgcacagaagttgttaactggatctattagtttcatttatcagaaagtttggttacctcttttcttattactgtggttaagggcttccatagcaagaagacaaagaaaaatgatcaagaaggaagacatgaggaacaagtgccattttaatgaaaattaaacctagcaatatgagataataaggaagtcataaggaacaacatatttatttaaaacccagaacaaataaatatgaattgcttagttacattcatttattgtagaagcagattcagtattttctttgattggctttgtgtttttaaattatattaccagtgtcc

SEQ ID NO: 140169 - DNA, 422 bp, Homo sapiens
caggaggaagggaaggaggaagggagagagggagggagaagggaaaatgtgtgcaagcctagggagcttgctgggacacaggaagtgcctctaaatgggcccacacaaaaaacccttcctgatactacagcctgcagcttctctcatccttctcatctcagcttaaatctctctcccggctgtctttgccgctaacaaacatagaagtcagccagtgcaccagatgaccaagttgccagattgccaacagtgtttttcagcaatgtggtctctcttccactcctccatccaagtctgtccctgaacctcttgaacctgctcaggccagtcacacacctgcctagagctggatactccagcggctttactggggacctggccgtgaactctgtcatttctccagccgaagcagacagctaatc

SEQ ID NO: 140170 - DNA, 503 bp, Homo sapiens
ttgtacatgcacagaagatctcacgaccccacctcataaaagccatctagtggatgtatgtggttaacaatgccctttcaataaatccttggctggacggacgctggggcgggactctctcagaagagctgccccatggccccactcagctggaattgtctgagaagttggcttcacagcagagctcacatctgtggtcgacctggagagtagaaacccagggtgtcactgccagcactcccatcagagtcgggagtgcatcttttgccaaagcccagaaatctcagtgctgttgactccctctgaaaacgacctaagggaacaacacaggaagaaaaaaatgcggttgcacgtttctcattattggcaaagcatccctagagaggagcgggagccatcccctcctcccgttcatgcttcttctgggtgttctgagggtgtgcagggcaggagcagcaccggattcctcctctccagcctcttccgaccttccagtgacccac

SEQ ID NO: 140171 - DNA, 162 bp, Homo sapiens
gcaagtgatagagtaaggagaatgactggaacatggtcggttatccatgactcttaagaagaaggtctacagtgaaaggatactaagaaaatactaagaaaattggtctgctctggcttgttctgggaaatgatataactgtgtcagtctgcaataaaaaat

SEQ ID NO: 140172 - DNA, 312 bp, Homo sapiens
acttactgcatttgtgccaactttaaggagacttcctagacctcagaattctcatctgtaaaatactggaacttcattaaattctgtgtagagttccatctgatgctgcccaatctagtgcctgggccttccaactgaaatataagagggaatgtttttggctcaaaaaaaaatatctagataaatgactcactgctctggttcactgatcatacatacatcattgtcatctcctttgattatggaaagaatgaaaaaaaattatcttcttaagttacattccaggaaagagccagcagacctaagtatatt

SEQ ID NO: 140173 - DNA, 715 bp, Homo sapiens
tttgtacttccttatcttatggcgactagctcagtgctgagggcttggtatatgcctactgattaatagtgttcatcattcactcatcaaatatttttggttccagtatgtgcaaggcctgtactttgtgctatgggggaaaaagtgacacaaagccaaccttcaaggagctagtgagcccaaaacaaaaattagcagggatttttgtgtgttatgatgactgctatatcccatgtgctcacagagcttacattcttgtcagaggagacagacaataataagataaattgtaaaaaatagactatgttagatagtaataaatactaaggagaaataaaagtagaaaaaggatatattaattaccagagaaagaaagataaggtaaatttacataatttctcatcccagtttccacaactctagaacagaaaaaataaaagtatatgccttatatgattgtgataaggattaaatgagcttggatatccatatataaaagatggaaactagacccctatctcttgcaatatacaaaaatcaaatcaaaatggatcaaagactcagatatctaagacctcaaactatgaaactactacaagaaaacattggcaaaactctgcaggacattggagtgggcaaaaatttcttgagtaacacaagcacaggaaacaaaagcaaaaatggacaaataggaccacatcaagttgaaaagctt

SEQ ID NO: 140174 - DNA, 454 bp, Homo sapiens
acttagaggcttccccgggaagccttggttaagaaagctgtgaaatccacggtcactgtaccgcaggaagcacttccaggaccttggcttgtgcagtgctgctctgtgaccatgtgaagagtctgcgctggttggcagactggaaaatggaggtgtcttgctgcctgagacttctcagattgtgaaagagagacacaaaagtcaaggcttgcatgttctaaagtttgttgtgtccagcaaattcatcttctagatttaaaaaaatgctttgttttgagctccacaatgagagaactttttctcacgatgtagtgtgaaaggaaattccaggctaggaaaggtgcaggttgtcgtacactctgcagaaggagagctcaccatagctagaccactgcaacattcaagaactcctccattatgagattggacatgaaaatagaggagcccagcaggc

SEQ ID NO: 140175 - DNA, 241 bp, Homo sapiens
ggggttgaggctgcagtgaactgtggtcacaccactgcatgccagcctgggtaatggagtgagaccttgtctctcagacaaaacaaacaaacaaacaaacttctgaataatcttctttggctaattttgcacatggcctcaattaacactagttctcctaaacaagcctagccacaaaacgaattccttttataaagtcactaaggggcgaatgtagtctggattgggatgggagcgtggt

SEQ ID NO: 140176 - DNA, 160 bp, Homo sapiens
cagagaaagatgacagttgacatttcatacaggcagctcgagccaccagtcttactttgtgaacatatgctgtacagggagtgagatggaaaacacaaatctactgtgctctcaactgtgcgcattcccacacgcctcttccagtgtgagccccttcagt

SEQ ID NO: 140177 - DNA, 474 bp, Homo sapiens
tcagctgtagatacttacccagagtatcttttaggagtatggtgttaggaaattattggacaattcaatatccatcaccatctgcatcaagccaatgcaactccttatcttccctcctcatagcatttatcacactctattgtgatttccttggtatctgtctgtttctccccaattgtctctgagctccttggagcagagaccattttggtcttcatctttgcattattccttttacttcgcacaatactagtcatgtcggtgagggctggctaaacaatgttaaatgaacgaacagattagagatggctccaaataaggaataacataaggtgattgaatgtgagtgctgtgaagaaaaggtgctttgagaattaatagcataggccttagaaagaccaaagagtgaaggcagacacattgtgagtggcattgactgtgagatatggccctggtctctctgagctaaccagt

SEQ ID NO: 140178 - DNA, 155 bp, Homo sapiens
agcaaaggctgctcttgtacagcacaggcagcttcagggtggcaggcaccatggcctataccaggggctacagcatgcctgccaccctgcaggatatggctgacaggatgggcatgaacctgctccttaattctaagcaatggctgtgagcaaat

SEQ ID NO: 140179 - DNA, 129 bp, Homo sapiens
cctgtcttcccatttggtgcacttttctctgattgatctctacccttcaactattttacatacacctactctttcctaattggttttctaccctgctgtgcccacctctgagtggtgcctctgctttag

SEQ ID NO: 140180 - DNA, 352 bp, Homo sapiens
  misc_feature (335)..(335): n is a, c, g, or t
  misc_feature (338)..(338): n is a, c, g, or t
ttctagctcggtaccccacaccacctgagtccaggataacccttggtgaaatggctcatccttggtgttttcttttgtagaaagacttgaaagtacgggtttactttccatctcgtgcttttctgggatgtctcagctgcctgacacacactaaacttttgaagatttgagttttctcagtgttgcggcagctttgtcagctaaaaacagtttgatgctaaaggaagcttaaaagggttctgtgttggggaaaaacaggtttttgatgtctgtcaaacactggactttaaacttttctggcttcttttcaatcacttctcttttaaacaaataantancagattaacatgag

SEQ ID NO: 140181 - DNA, 412 bp, Homo sapiens
aaattgagatgaatgcagagttttagtaaagaagtcagaaatgtattgaatgaaagaaagatccaaatagaaagtctcttggagaccattgatttagttcttcacttttcagaagaagacatgaaagtccagagaggtttgctccaatgccccaaatcacataggcagagttaggagcacagagaaaaccagaattccggtttcagactcccagcctagtgttgcttccattacgccagtgttggaatccagccgccactgttagctacctggaaaacctgggctggtctcaataaccctggagcccagttttatcatcactctatctcccttagggtagcatcgctaagagcatccaataaaattgtgactgttaagtaccacgtaaatagccaagcaattttcaagtaca

SEQ ID NO: 140182 - DNA, 277 bp, Homo sapiens
gaaccaggtcctgtgggagcagctctgcccttgagaggagggcacagggaagctgaagtgaagtaggaccagcatgtagggggcagaggcagaagaacaggatggcaaggcagtgctgggcatctgcctgagtcacggccgagtggctgtgcaggccctgcaggtgggactctgcagggatacgggtagccctgtccacggaggatcgccccaggccaactggaccaacagaaccaagccccggagctggtgcctgacagttcctatttttggcaag

SEQ ID NO: 140183 - DNA, 378 bp, Homo sapiens
cacaaaaccaacagtctactcttcctgtccctaactccaaccaaaaacacacacaatgtaaaaatctaatttatttagaatgaaaactatttaggtaaatttggtggctttcaactatcatattagaatatataatcctagaaagtttaaaaccaagggtaagaaaatgcagtttgtagggacatacacttccacagatcaggatttttgagatcccctaaagagatcctactatacaagagtgcagtactccacacattttcactcaagattttatctgtcagttgcaaagactttttcatttaagtcaaagcaactgttccttaatagatcctgctcaatattccctgaagaagatcatcagccttacaaataaaa

SEQ ID NO: 140184 - DNA, 330 bp, Homo sapiens
gctgcttactccccacaggatggtgagcagggcttctcagaggaggtgggaaattctcccgcggtgggtagagtgaggaatgttttatgggcccagaaaatcaagagcagcttcacacatactctcatgtctcttatctttgagccactcagtggctcttgacccagtcaagggctgccgatgagaattacctggagagattgaaaacgtaacagattcagagatccagatttagttggtctccactggaatgtttttttaaagttctccagatggttctaatgtgcagctggagctgaggaacttactgaagcaaatgcttcttcctcc

SEQ ID NO: 140185 - DNA, 355 bp, Homo sapiens
  misc_feature (170)..(170): n is a, c, g, or t
ggaatatcggagagagggcctgagatggcaggagtaataacatccttgcccccagctcccccggctcccccagctgctatgcacttcagcctgcttcatcttccccctccacagcactgattgacgtgacataaggtacactctcttgctgatgtgttgatgacctcctnacccccaaacagtatgtaaactccatgagaactcatattctgtctactgctgtggccctgttgcctaggacaatggctagcaccaactgggagtttaagtatttgtggcagaagctttggaatgtatacgacctattagacattacctcttttgtaaagaatttagtttattctgtgctactcaa

SEQ ID NO: 140186 - DNA, 174 bp, Homo sapiens
ggttcacctttctgtgatccctcctgaaactggattcaccgggtattttcctggtgagttaggctttctcttctgtgaactgcctgtcttatctacatctttcgcctattttcctgttgtgttgatttgttttgtctgtttgtatactcttgacaccaacccattcttggtggt

SEQ ID NO: 140187 - DNA, 433 bp, Homo sapiens
aggcactcaggtgcatctctgcagtggcatgccctcgttcctggtcaggggacgttcactctcaggcatggaggtgcgtggaggcagtattcccgaaggtacccctgtacaggtactggctgaagtgtgttacctgactttgtcacctggcagaggtttcactactgtcaagttattctttttctcccctcttcgttattggaaagattttcgtctttggaagaaatccatggtgcacagccctcagggaagaagtggggagttacaatgctccagctctttcaagccacaacaacaggtgttatttggaatcctttttcatgggatatttgtctcttttcttccacttactaacttactcaaccatttattcatattagaatggactcatgcctcattatcctttaaataggtataagatccttaatgattt

SEQ ID NO: 140188 - DNA, 127 bp, Homo sapiens
catgaggaatgctcagatccatctgagaagagtctggaaacccacatcttcatttcccaccatggccctgtcaggggagaccctttgtcctgtaccttcctgtcgtgttctttctacgtttcaccca

SEQ ID NO: 140189 - DNA, 131 bp, Homo sapiens
catcactcatttcttggaaaatcagattcccaactcaaaaaattagaatatatgtcaacgtatttcccatgataactctagcctatttctgagtggggatacctttgtgtagtcagggcattgcaccctcc

SEQ ID NO: 140190 - DNA, 173 bp, Homo sapiens
gggatgggaaggttgcagtgagctgagatcgcaccactgcactccagcctgggcaacacagcaagaccctgtctcaaaaaagcaaatggtctaaggacttaaaagagatatttctctgaggaagatacaaaaatggccagtaaccacatgaaagaattctcaacatcattaga

SEQ ID NO: 140191 - DNA, 101 bp, Homo sapiens
cctcagttcatggtacagcagcagacacctctgaatacagccacattctccataaagccatgatctaagctctttaattttggctctctgggttaggataa

SEQ ID NO: 140192 - DNA, 148 bp, Homo sapiens
gttttatattcctttcatgttttcagaattcctgaacacacttacatttgtaaaattaggttgaaaacagatgtgacaacatgggtacaatctatgcatttgctgatcactgctggatatttcccaacatacttacacatggagcaca

SEQ ID NO: 140193 - DNA, 410 bp, Homo sapiens
aactcttctgctcgtctctcctgtgttaatagcatcatcgtccttcgttgtccaagctgggaacctcagcagatttgcaggcattttcttctcctttaattcccacataatttttttaaattatgtatgttatctctaagaattttctgtttccacagacatagttcagactcattttttacttggacagttgtaagagccttggataaattatgggttgagtagaatttttgcaggaaaaggggatttggcatgggactcctttatatgtatctctttgtcacaataaaattaaaaattatggatatgcttggaaaaatgttaaggagactctaatattaatgaacagagtgaggtttcaaagctattgagcaagagaagcaagaatgcccccaatccccctgtcaatc

SEQ ID NO: 140194 - DNA, 628 bp, Homo sapiens
actcttggaagaaaagatagggagaaatattcacaacattggatttggcaaggatttcttggagatgacaccaaaacacaggcagtaaaagtaaaaatagataaacgtgactacataaaaattgaaaattctgcatcaaaacacaaaatgaacagagtaaaaggcaacctataaaatgagagaaaaccatttgcaaatcatatctaaccccacaatatataaagctcctataactcaacaacaaaaaacccaaataacccaattttaaaataagcaaaggacttggataaacatctcttcaaagaagatacacaaatggccaacaagcatataaaaagatgctcaacatcacaaatcattagggaaatgcaaatcaaaactgcaatgagatattatttcacatccattaggatggctgatatttttttaaaaacagaaaataacaagtgtcagcaaagatggggagaaataggaacatttgtgcattgtcagtgggaaaataaaatggaaaacagtatacaggttcctgaaaaataaaaaaatagactatatgattactatatgatccagtaattccactctgggtatatatccaaaaaagttaaaaataggatcctggagaaatatt

SEQ ID NO: 140195 - DNA, 267 bp, Homo sapiens
tggccaccacgcccagctaatttttgtatttttttgtagagatgaggttttcgccatgtggctcaggctggtctcaaactcctgggttcaagtgatctgcccaccttggcctcccaaagtgctgcgattataggcacgagccactgcgcctggccagaactgattttcaagtccaatgcctggcaataactttttgctcaggagaaagggtgacctagtactaaagattctgatcaagataccttagttgtagtttaatttcccctg

SEQ ID NO: 140196 - DNA, 968 bp, Homo sapiens
ttttgagacagagcttcactcttgttgcccaggctggagtgcaatggtgcgatctcatcttactgcaacctcttcttcccaggttcaaacgattctcctgcctcagcctcccgagtagctgggactacaggcatgcaccaccatgcctggctaattttgtatttttagtggaaaagcggtttctccatgttggtcaggctggtctcgaactcccgacctcaggtgatctgcctgcctctgcctcccaaagtgatgggattacagatgtgagtcactgcgcctggccaactgctttggtttctgagtcctccctcctctaagcccgctcagtgtgtgtcattcctgggaggcggtggctctcccaggaccccatgccgaaatctgccttcttcttgtcttcattcccccacctgggtacccctcagtgttttcccattacacagattcacgtttacatgttctagaaacatctgtaagtctttttcctgtttgtaaattgtatatcctctgttagattaaaaaacttttaaaagtaagtgtctttctctgtggtgacctatttgtgtggcatagtataggttacaaagcccttttcatgcattgttttacttataagtaatgtttatagatgataccgaggtagaccctatggggtgcttactatgccaggtctgttctaagaatgttatacacattaccttactaacccaccccaaccatccattgtgttattgtcacccctgttacagggtggagagaagaaggcagagagaagtggaatgacactcctgaggctaggcatttgccaagtgaggtctgggatttgaacccaggcagctgaacttcagaatcctggtgtttaaccactataccatgctggccttcatgttattgagcaggataaggaattgtcactcttgacttgtttttgaaacatgaaaacccttctcttaaattcaaaagtaata

SEQ ID NO: 140197 - DNA, 285 bp, Homo sapiens
gctgagggtggagcgaggggctggaggaacaggatgtcgtagcacgggtgccaacacagctctgaggagctgggaggctggggtagggctgagggcagggcctgtggctgcaacagctgcagactcccactttgcccacaagactcctcgttgccagcaaacgggtgtggcctgtagtcctcagtcaccctgggagtcctgcttggaaagcaagctttgctacatgcaaagggcaggagactgatttgtgaactctggtgttggtgcctctggcagagagggggg

SEQ ID NO: 140198 - DNA, 475 bp, Homo sapiens
cttataaccttataacagctctgtgaggaaagctattattgccatttcatggatgaagaaattaaagtacatacagggagtaaatagctgcctaatatcacagcctttagtaagggtcagtgccagattctgtactcacttttctgatttcaaagcctgtggtgctaatttgtacaacactaccttgccctttggcaagtatttcttttgctgaatagagacgtctcccattcccttctgaaaggaagactcttgtccatggagatttgtaatttagtaggaggagcaggtgtgctgagactcaggtgcaaagatttaaaagaaaacagacatgctatttccaccctaggaagaacttggatactgaacatgtttattcttgacgagcatcagtggagagagaaataacttgttgcaaaatccctccccaggagctcattcgtatattagaaagatctaagtagtgaagtaatga

SEQ ID NO: 140199 - DNA, 356 bp, Homo sapiens
gtcctgtagtcatctaatgagactataaatcagtttacaactgatactttagaagcatattttttgagtaaggtaagggatatagaacatgcagcatgacagtcccctatctcctgctctgggttgcaatggtctctttctccgagtccgaacagtcaccttgacaatccttgatggcagtagggagcatttaatccaactgtgaaataataaattagctgtggagtcaccaccagaacagggaatcctggctttatgcacctggctagtttgcactccctgtgaaaccatcacggttccttctcattgcagctgagctttctgaatcttttaagaactgaattgatgggatgtgg

SEQ ID NO: 140200 - DNA, 299 bp, Homo sapiens
ctctgtgcaggccctcctgtgatctttgctaagtgaatagtcattatgaaatcaaacagatgaagtcagatatcttggggaaagtcacagtcaagtctgtctttaaactcagaacatttctattctacacgggtacttcttaatcttagtcacttgtgtctgggttaagcccttaaataacttataccagtttccctagcattccttcctgcaacctagagattcctaattatgataatatccctgatggaatgcagtggttcccacatctggcttgtccccagcaaagaattgaggat

SEQ ID NO: 140201 - DNA, 337 bp, Homo sapiens
ttagggtgggccttaatttaacctgactggctttcttataaaaggaaatttggacacacagagagacaccaggggtgcatgtgcacagagaaaaggccatgaggacagagagaaggtcccatctgcaagccaaagagagaggcctcaggagaagcaaaacctgccaacaccttgcttttggaattctagcttccagaactcgaaagctagaagataaatttctgttatgttattttattttagtatttaaactgtctgtggtcttttgcaatggcagccccagtggactaatacactgggtcaagaaattcagaggcccagagaatggggctgagta

SEQ ID NO: 140202 - DNA, 422 bp, Homo sapiens
attctactttgctacaactcagagagccaacaactaaaaacaattctacaggcagttaccatggttaacaaacaccaagagggccatcagggatgtagcagagagggaatggtggaaggtgcctaacaaggcaattcattcatctcttgttcatttcattgggcagtgttttcacttcctggtacccagctctcaagacattccatcaggcgtgagagctggttttctgtttccaacatcctgtagctacagatccatttccaagcttcacacccaccttgcctgtctttcctctgccaacacccacctggccactggtccttaccaacccaagaacagcctatcttttcctggctcctcacttccttctcatgtaatctaggtaatatgttcctttaggaaactgtctgccttatcccaga

SEQ ID NO: 140203 - DNA, 337 bp, Homo sapiens
ccaatgtttccctgattgacaatagttttcctgaaatgtattcttggaatggaattgtatgatacgcttagaaaattctgcataccttatacttcagaatgtgtatgtaaaagactccagtaaatgatccagggaagcaaaaatatttgtgtgttttgcgagttgtattcatatgtgtataaaattcccacagcactttgggtaacaatgctctgcacacttttcctgtgctccttttatccattcccacacttccagcatttcctttgacgtttgattttctttatttttttttactccaatattttcctgtaggtttcaaacctatattttaaaa

SEQ ID NO: 140204 - DNA, 550 bp, Homo sapiens
cttgtgatccgcccacctcggcctcccaaagtgctgggattacaggcgtgagccactgcacccggccagcagttttttaatcataaaattctctcaaattattgtatgccttttggttgatttcaagagtgttaaaatggttaattttgtcaagtttgtcaatcttcataattggtttttgtgttgaagatctgccagtctcctcattcagctatacctggaagtcctccctgttttatttactttttaatgaccgatataacttcatacaatgaagtggaaaaatcttaagtataaaacatatatatgcaaaattaatatatatatagccatataaccaatcacctcattaagatacagaatatttccagagtcccagaaggcttacttgtgtcccttcctagtcaatattctcccttaaaggtaaagactactctgaccttttataaccattgatcagtcttgtttactcttgaacttcataaatatagtgttatataatgtatgtactttaatgtctgacttcttttgatcaatattatgtgtataa

SEQ ID NO: 140205 - DNA, 414 bp, Homo sapiens
gctccggccgccgccccctcttgcagcgcgggaaccggcacatggacacggccccttgtcgctagggacgctcgtcggtcagccccgaacgacaccgctgcttcagaagtcggggcggcagtccgagccttggaggtttttttcagccctggcccgagagagctgctggccaccaccccgtccaagatagagctgtccgctctccgcctggttgttagaaagttctgatagaaagttccccctttgatgctttttgcctcattgtgacgtccacccatcctctcctctcagaactttctttccttagggatctcaacccgaacggggtgagaatgaatcttactgaagaaatctttctgttcccccttcttggtcttccccagacaaaccgtctcgttgaaagtatcttcaccc

SEQ ID NO: 140206 - DNA, 447 bp, Homo sapiens
agtcggaccgggttcctgcccatgttggcaggctggtctcaaactcctggcttcaaatgattctcccacctcagccttccagaatgctgggattataggcataagccactgctcctggcctcattggaactttttagctataggacaaaatctacccatcttggtttgtccttttaaaatcatttgaaaatatataaacccaggaaaataacctcataaccagtgttcctgtaattcccccccaccgcaaattctggacagatggtcagtccatatgtgtaagtctggcttccaatccattgaatttcatgatgtaatgctgagatataggtcccttatttcacagagttccccttcgtaagtccgttgggccatttgagctcctgcagtatggatctggttgcgaagcagctagctttggcggagttggttcttggtccttgcctt

SEQ ID NO: 140207 - DNA, 347 bp, Homo sapiens
taccaacagacacattaactgatcaggatggaccctatatgcacgactggctgagaagccagactcttaattgtttggggcagaaaagggtagaagaaaatccttctagacatgagctaacagatctttctcagtaccctctttttttttttttttccttgttttgtttttgagacaaagtctcgctctgtcacccaagctgacactgaagaagacagatgttaacctcagccacccactcttctgggttagggggaagccattagcaaccttggataaagtatcttctttgggtaaaggaagaaataggtgtgatgactatgttctttggcatttacgtatgaggg

SEQ ID NO: 140208 - DNA, 617 bp, Homo sapiens
aataagattccatctgcctcatcctaataagccatactgttcattaattcataggtttgattccctaaagcataagaaacgaaacacctaaagttcgtatacatagtaactgaaaaaatctctcatcctatatgttccacatttggggaccttaatttagtgctttcacaagcatacatagttgtcttgaagactggaagccttgagcatattactatctagcaaaagggagaaatggaaaggaaaagttgtgagtcccattttcctattctcaatgtgaatctgaagatgggtagaaggaaaggctgaaacagaagtttccacattcacgaatgatgattattaatatttttcacatggagtgagcagggatggctgcatggagctttgaagaggctgcctggtggggacgcaggctctcccaggtgctggttttgaagttaggaagcctgatggagcttggctgttaggcctgtggaagttccttaatgtatctaaggttggcttaatcctgtctaaaatcaaggtattggactagaacaatgaggtttgcagctttttagcatagattcctttctaaaatgcaatttttatggaaaccaaatataaaaaaaaaa

SEQ ID NO: 140209 - DNA, 126 bp, Homo sapiens
acaagggcatgagcttgtctgggctctcagagtaagcatgagtttgtgtaggagtaatagattgtcagcgctttgcccaagaacaggacatctgggttaggtcacaggcccactggagcatcggat

SEQ ID NO: 140210 - DNA, 236 bp, Homo sapiens
aagtgtagcagggcccctgagacagcagctgcaggaaggaccaaccattagcttggacatatctgtgactgacactgacagcctagactccatcagggcaatcacctgaaaggcagattcttcaaggctcagccctgacactgaaataaataaatcctgtacaaaagatgagcaaaagatgaaacgaatgggagaggatgtcactctactctcaaaatatacaagctatagctatg

SEQ ID NO: 140211 - DNA, 464 bp, Homo sapiens
tttgagacgctacttgaagagggtgaaacctgacccaaggaaatctccaattcctaaatccaaggtatttcatagagagtgaaagatagcccagggtgtggtgaatgagaaatggagagagcaggaaaacagaaagaaaaccacagagagaccacagaggtggactgtgctgagtatgctggaaggaggaacggaaaagatagattcttaagccaagcaaaaagccaagggatgctggtggcaatgtaggcatggccttctaagatcttgagacagtctgaggcagctcctttaagaagctgaattcttggctgggtgtagtggctcacgcctgtaatcccatcactttgggaggcagaggcaggatccctgttcacagcaccaacttggccaccgtctaatggggttggccttttgttcttggaacacctgagatcaggagtttgacaccagcctggccaaca

SEQ ID NO: 140212 - DNA, 213 bp, Homo sapiens
gggcacacctgtgccagatgaatccacgccttctctaggggagagagggtatcccggcttaagagcaggggctctcctgagttaaggaagtgtcttccccagagcccattccgtcagacgttcatatcatgtaactcagtccttttctgattatgtattcaccaagcaaacttaagagttggcttgtcaccagacctacagtgaataattgca

SEQ ID NO: 140213 - DNA, 422 bp, Homo sapiens
  misc_feature (3)..(3): n is a, c, g, or t
gtnggtgaccgcccattgcttagtggtgatgtacaataaagagcagagtaggagcagagcgatagcgtacctctactttcattatcatagtctacttagtctgactgttgtctgaaattactattaagcaaaacttgcctttacttaaagttttaggtcaagacctcaaaccaaaagcaaaaacactgccaggcccaaacactgctgcattgagatgaatgaacaactactctgctgtccacagtttaatctgactgtcccttttttgcatttggaaagtgaacttgagtcagatctaagtaaaaattatttgctcctggaatgacagctcatcgtggctttaaaatccttttttagaatgaggggcataaatacataaatatataaaagtaacccccatcaaaaaaatgtaaccagctagg

SEQ ID NO: 140214 - DNA, 523 bp, Homo sapiens
aaagtaagtcaagttcagaagttcactattaaatccagaccctcccaaatccagaccctccctggccccctgcactgtggaaaaaagtgataaactgcattggtatttaaataaaaatctgatctctgccactcgaagatgtaatcatcactggggattactttcatgcatctttaaaattctttcagattaaaagatctgtcagagtgtcaataccaatactattaagcaaaacttgcctttacttaaagttttaggtcaagacctcaaaccaaaagcaaaaacactgccaggcccaaacactgctgcattgagatgaatgaacaactactctgctgtccacagtttaatctgactgtcccttttttgcatttggaaagtgaacttgagtcagatctaagtaaaaattatttgctcctggaatgacagctcatcgtggctttaaaatccttttttagaatgaggggcataaatacataaatatataaaagtaacccccatcaaaaaaatgtaaccagctagg

SEQ ID NO: 140215 - DNA, 327 bp, Homo sapiens
gatcaagtgattctcctgccttcagcctcccaagtagctgggattacaggcatatgccaccatgtccagtgaatttttatattttcagtagagacagggttttgccatgttggccaagctagtctcgaactcctgacctgcctcggcctcccaaagtgctgggattacagccaaggctgaggactttcaacagctgcagcgtgctgccagatttcaggggcctccttactgttaggtataagacttcatgcctcagcttgctcttcctgaggagtggaagcagagagctgctggggcaaattccctcctgcttagctaccctccttc

SEQ ID NO: 140216 - DNA, 257 bp, Homo sapiens
atgtatctcctaagcatggacattctcttacatgatcatattataataagcaaattcaggaaatttatcattaatgtagtattactatctattataaagtccttattcaactttcactgattcatccaatattgtccctgtagagcttcttcccctcatgccccaacccagaatctaatctgtgattacatattgcatttagccgtcttgtctcttttaatctggaacaattcaagatgaattatttgtttttcatg

SEQ ID NO: 140217 - DNA, 490 bp, Homo sapiens
tcatatttgagaatgagattggttgatttgagaatcattcattcatatttgagaatgagaatgagattggtcttggttgctctcagtaagtcataacataagcacattcagaattcacatttaattgtctattttgacgtttagtgataaggttcgtgattgctgggggtcggggcactttttcacccgagtcaatctgctgagcccttggagcctgcggctgtgctttgcagggacaccgtgccaggacacgctggtccctgctgcagctctgcacctgccagttgagcagtcccgtcttggctgccgccaccactcttttcaggtccacactctgaccatcgccttcccttccataggagctgcactgcaggggagtgctcaggtggcagccttcctgcttcgcctgctcactgcaaaattctctcctttatagaaaaccaaaatttcaaagaacagcagatcacacagaaggaataacaaattgtct

SEQ ID NO: 140218 - DNA, 293 bp, Homo sapiens
ctgaccctggaaaaatctgtctcacccacaaagatgtgggctcagctccttctaggaatgttggccctatcaccagccattgcagaagaacttccaaactacctggtgacattaccagcccggctaaatttcccctccgttcagaaggtttgtttggacctgagccctgggtacagtgatgttaaattcacggttactctggagaccaaggacaagacccagaagttgctagaatactctggactgaagaagaggcacttacattgtatctcctttcttgtaagcacagactc

SEQ ID NO: 140219 - DNA, 118 bp, Homo sapiens
ctaggtactattaattgtagtcatgaatttaatgtaaaccctccagtctgttattttctccaggggcagtcagctatgtacagataatacaaacagctggtttcagagttggtgtttc

SEQ ID NO: 140220 - DNA, 247 bp, Homo sapiens
tgaatcggtagttactagacactgtgacaatggttaagtccattcttcatacacctgcatttggtgcgggcctatttcctcctggccctacctcctaccttactgcactgtagcttctggaaggttacaaattccctcacataagcagccactccctggaacactgtccactctgtgtgctggaactgaggcttggctttgtcctgctttgtgtcaccaccctctccaggggaagaaacgcctcact

SEQ ID NO: 140221 - DNA, 287 bp, Homo sapiens
agagagaaagaaaaaaagaaagagcgaggaaggaaaggaaagggaaggaaaggaaaggaaaggaaagggaagggaagggaagggaaggaaaggaaaaagaagagagagaaaaagaagtgggggagtgagagacgaaggaagaaaaggagggaggggaaccccgggcaattacagtaatgtatgaaaaggtaacctacgaaatcagagttaagagccttctccacgccatgcctggtgctttgccatttccacattcaatacgtttttttttttttaatttcttcctt

SEQ ID NO: 140222 - DNA, 688 bp, Homo sapiens
cagggtgcacggaatggggtctgtgggaggatgggggcatcctagcccagggcagggaccccgtgggccccccaagatgagctgcgtcaggctgttgctttgcacactctgaggggcctgcctgagtgctgcatgggaagccagcagtgtggccgccctccccagaactcatccagggcaccagggtggacccatgagtcccgtcgggtcatgggcatcagcctcgccatcctggcctccagatacaacgatttgtcagattccctgaggtcaaagggaagcttcaagggttgccatccccgcctccctggcggtcctagacgggatgtcaggaggacgcagggccatcgctgctttttaaatgtcacagtgactgcagcgtctgctcctctgtggaaggagcttgctccgctaatgagggagttcctcctcatggccttcccctcacttctcttcaaaaagttgccctttattttaacattttttaagttttatttttttgagccagggtcgtgctctgttgcccacgctggagtgcagttgcaatcatagctcgctgcagcctcaaactcctgggctcaagtgatcttcctgcctcagcctcccaaatactgggactacaggtgggcgccaccacacccagcctctgccctttgtaagtgaagtcccccaggcaggttgaacctct

SEQ ID NO: 140223 - DNA, 615 bp, Homo sapiens
gaaggagggattttctgggccttccacccaaattttactcattaagtgtctgcatacctatactgtactagactccagatgtggtctctgacactgttcagtggtcactcttgtagggagagagacaataaataagtgaaacgaatatatttattcttaacagttgtgataaatactaggcagaaaagaataggggaggtcacctctgaagaggtgatatttaaacaaactgaaaggatggagagatagctatctaaaactttttggtattaaggaatttttaaatatatacaaatgtagactagtttaatgaacaccaatatatccatcatcagcttcaattattatcagcatttttgccagttttgtttcatatattctcttccctttttccctgggaatattttaaagggaatttcagatattataagacagatagctagtttaaaaggggaaggtggaaggaactgcatttgtaaaaggcttgaagcaaagtacagatacatgctacaacataaacctcgaaaacattacactaagtgaaagaagccaatctcaagagtcacgtatttgtatgataccatttatatgaagtgtccagaatagacaaatcta

SEQ ID NO: 140224 - DNA, 301 bp, Homo sapiens
aacacagggtgcagggccatgatgacaaagttagaaaccactgagctcaacatttggctgttctgtgttccctgagttaggcagagggtaaggctttgtgagatttgtttttagtactccattaccaccattactgtcacagtaataatcaacactgctatgaactgtcacagctgccacccaccacaaccgccaccaccaccttcaccacaaacatcattatcatcaccacaaggaaaaggactggtacggtagtctgtggaaaccaggaagataaaacaacagcccaaagtgaaaagta

SEQ ID NO: 140225 - DNA, 412 bp, Homo sapiens
tatcctttcacctcaatcaggtcctgagtttatatggctaagtgtcagaccaccagttacttgaaatatagcctaattttgaaactgtgatgcaaagggattatgaaaacttcctctttgttgttttctcatggcttgagaatggcttttgctgtggatttctggatttgcactggagaaaagacaaaacaaaaagaccttcctgcctctcttcttgggctgtttctatagattcttctgcatccatagaacacctattgtggacctcctatgagactggcatacgctggttgcatctgtgtgccagaggctcttctgacagacgcttctttttagttttcaggcttagagaactagaatacttctaggattaactggtgatgaccttgcttgtcttgcagtaatgcttaca

SEQ ID NO: 140226 - DNA, 442 bp, Homo sapiens
gtaatgtatttcaagtacacactggacctgtaagtgccacgctgcctcagagtatctttcaacacacactggaccttgtgacccccacgctgtcctcagagtatctttcaacacactggaccttgtggccccccatgatgtttggagactttggacaaataacagttcacttgtaagtcacaactcttccccactgtctctccccccgcacctcacctctgtgtatttgtgctctgatgtacatttcaattttaagtgattacaaaaattccttatgctggaataaaaataacattgacaggtgctgaatttttaaatagtcaaggaatttctgtcaacttacattttaaatagtttctaaaatcaaaggttaatctatgtaagttttatggttattcatgttttattttcccaaagtttagaaaattctataaagatatat

SEQ ID NO: 140227 - DNA, 562 bp, Homo sapiens
gcacgccataggattccagttctgtgaaactcacaaacaggcaaaactaatccatgagggtgacgtcagcatacctgttacccaggggagagggaggggcatcgggaggcctcaggaatgctggaacgttctgtcttgatctggttaatggtcacctgggggcatatttgcataaaaattcaagttgactattctagatttgtgcttcttactttatagaagttatgccctcagtaaacattttgaaaacataaagaccaggcagaggcagggaagtaggcaggtgtgcggcctgtattggtagcagagtcctccctgagggctggatcattagggaggtagtgggcccagggaggaggcacgggaggttaatttagaaaggtggcccaggctgggtcatggtgggcctcagaggccccactaaagaatcagacttggccaggtgtggtggctcacacctgtaatcccagtacttttgggaggctgaggcaggcacattgtttgagcctggggattcaagaccagcccgggcaacatggaaaaacccgtctctacaaaaaaa

SEQ ID NO: 140228 - DNA, 312 bp, Homo sapiens
ggggcgctctagaggtcccagtttcccatttacctgctcacaaagcctagtttttcagatgaataggaaatagggccaggaattaaagaacaagaacagatatcctccaggtggaaggtactttagagagaaacctgacatgtcttggaaaagaggtcttgcaggcaaatagagacaaagcacctgggctctgccaagttagaatgaagacagcaaagcaaaagaaaatctgcaacaagacaaagtagctccaacttaactagatgcaggttattccaaatttaagtgaaataacagtggggcattttatca

SEQ ID NO: 140229 - DNA, 505 bp, Homo sapiens
tagatataatctcttttgataaaagggtctttgcttctgattagaggagcgctatggaacgtctgtaaacatgtttttataatcccatgtataattggtatgcactcacataataccagtccccagcagccgctcttctctgtatagggccataataggattccgaagaaaccttggggagggagggggagttggaacaaatgtctattccctggagcccagtctggcgctcagacctttagactcattataagttgccactgccaacatgacaccaaagtgtgtgagttgtcaatgcagcgcgacagcattaaagactgatgctaaacctcaaaaaaaaaaaaaaaggaaatatcaaaactattctgacctgaggacaatgggagccttggacttaaaaacaatagaacaggacgggcacagtggctcacgcctgtaatcccagcactttgggaggccaaggtgggcggatcataagatcaggaaatcgggaccatcctggcta

SEQ ID NO: 140230 - DNA, 2781 bp, Homo sapiens
  misc_feature (1)..(3): n is a, c, g, or t
  misc_feature (954)..(954): n is a, c, g, or t
nnngaatgatgagtgtatggtagtaatttttttagagaatggtgttgcttattctgacagattttttagcagtttacttaatttgctgttattttgagaaaacatttaccttttttcattttttaaatatatatttcaggtgatggctattccttgctgaactttttcagcaaccttttaatataatgactagcagttttctgcttttacaaacagaagcatgtgattttcagaaccatttaaatattaacctgattaaccacaactgctgggttttgctttggtagcagtactcactgaaatatgttttcagttaaaaaggttagttctcactgttggttgggtaaatttcaagaaggagtcaaagattataaaaatccacccaaagtacgggtattgtcttgtacataagtaagcacataatttagatgccagctttaaatagttaactatatgcttactgtggagtgcaccaatgaaacaactcattttgttcttttggcttctcaatacttctttgtgacaaagcatcactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattctttctgaaggtaagctacttcggaagcacaactattgactaaaaactaaaccttcgaaagaaatgacagcattgctagttttttgtgtgcgtggntttttttggggaggggggcgtggggtactgtattaaggttagtttccaacaagaattgatgtaattagaagaaattgacttccttacctattgcctctgatatttacttgcttaaatttttttttattggaaatccagaaaaagtggatttagagaacaacactaactcccacctaatctatgacagagatgtagaagagagtacctgtgaaaaatgtgaaagtatctgaaaaatgtaacctttggcagcctgagcatagtcaaccagaaaaactatctgaattaaaataattggtccataggtactattttatttggtccataaggattattttttcaacttttttttcaagtgtattattatgtcatttcccacgtaggttactgatacctgaagactttttccacctttaaccttactcgttgaggagctttgtagtctaataaaagagaaatataagtaaatgttagatatatgggtggataatggtaactatgtgcttaaagaggtataaaagaagggtagggagcagataagacaaaggaagggctatattataaggaagaatattccaagtagggaagagaaaaagatatgttatccatataatattttatgtgcagtagagaacatgttctatagaagagacagaagatgaaactagatgggcacccagatcataaagcaccgtatgtacttaggagttggaattatcttaaaaactatcatagatttcaagcaggggagtaacatttttaaaagaccactttatcattaggatggagggataatcattagtaagctattgccataatctaggctgaagataacatcatgaactaagatggtagtgacagtgggcataaaggagaagctaattcaagaaattttaaagatcttacttgataactatcttgattctgagataagagaggaagaagttgatgatgagatcctggtttatggctttcagttatggcttgctattaaaaaacaggaaaaaagggattgagacaagtttcagttttggacgcatgacatgagatatccaagtagagatatccaagtagaaatatcagtaggcatttgaatatatgccctggaatgaataactgaccagagatatattttgcaactcaaatttttatgggtcagcagttaagagtagaaaatcaacctataagaataccagcatttttagctgggtgtagtggcacatgcctgtaattccagcttctttggaggctgaggcccgagaatttacttgaacctgggaggtggaggttgcagtgagccgagatcacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatgaaaattgaaatgaaagcttaca

SEQ ID NO: 140231 - DNA, 2728 bp, Homo sapiens
  misc_feature (1)..(3): n is a, c, g, or t
  misc_feature (954)..(954): n is a, c, g, or t
nnngaatgatgagtgtatggtagtaatttttttagagaatggtgttgcttattctgacagattttttagcagtttacttaatttgctgttattttgagaaaacatttaccttttttcattttttaaatatatatttcaggtgatggctattccttgctgaactttttcagcaaccttttaatataatgactagcagttttctgcttttacaaacagaagcatgtgattttcagaaccatttaaatattaacctgattaaccacaactgctgggttttgctttggtagcagtactcactgaaatatgttttcagttaaaaaggttagttctcactgttggttgggtaaatttcaagaaggagtcaaagattataaaaatccacccaaagtacgggtattgtcttgtacataagtaagcacataatttagatgccagctttaaatagttaactatatgcttactgtggagtgcaccaatgaaacaactcattttgttcttttggcttctcaatacttctttgtgacaaagcatcactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattctttctgaaggtaagctacttcggaagcacaactattgactaaaaactaaaccttcgaaagaaatgacagcattgctagttttttgtgtgcgtggntttttttggggaggggggcgtggggtactgtattaaggttagtttccaacaagaattgatgtaattagaagaaattgacttccttacctattgcctctgatatttacttgcttaaatttttttttattggaaatccagaaaaagtggatttagagaacaacactaactcccacctaatctatgacagagatgtagaagagagtacctgtgaaaaatgtgaaagtatctgaaaaatgtaacctttggcagcctgagcatagtcaaccagaaaaactatctgaattaaaataattggtccataggtactattttatttggtccataaggattattttttcaacttttttttcaagtgtattattatgtcatttcccacgtaggttactgatacctgaagactttttccacctttaaccttactcgttgaggagctttgtagtctaataaaagagaaatataagtaaatgttagatatatgggtggataatggtaactatgtgcttaaagaggtataaaagaagggtagggagcagataagacaaaggaagggctatattataaggaagaatattccaagtagggaagagaaaaagatatgttatccatataatattttatgtgcagtagagaacatgttctatagaagagacagaagatgaaactagatgggcacccagatcataaagcaccgtatgtacttaggagttggaattatcttaaaaactatcatagatttcaagcaggggagtaacatttttaaaagaccactttatcattaggatggagggataatcattagtaagctattgccataatctaggctgaagataacatcatgaactaagatggtagtgacagtgggcataaaggagaagctaattcaagaaattttaaagatcttacttgataactatcttgattctgagataagagaggaagaagttgatgatgagatcctggtttatggctttcagttatggcttgctattaaaaaacaggaatagagatatccaagtagaaatatcagtaggcatttgaatatatgccctggaatgaataactgaccagagatatattttgcaactcaaatttttatgggtcagcagttaagagtagaaaatcaacctataagaataccagcatttttagctgggtgtagtggcacatgcctgtaattccagcttctttggaggctgaggcccgagaatttacttgaacctgggaggtggaggttgcagtgagccgagatcacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatgaaaattgaaatgaaagcttaca

SEQ ID NO: 140232 - DNA, 2727 bp, Homo sapiens
  misc_feature (1)..(3): n is a, c, g, or t
  misc_feature (954)..(954): n is a, c, g, or t
nnngaatgatgagtgtatggtagtaatttttttagagaatggtgttgcttattctgacagattttttagcagtttacttaatttgctgttattttgagaaaacatttaccttttttcattttttaaatatatatttcaggtgatggctattccttgctgaactttttcagcaaccttttaatataatgactagcagttttctgcttttacaaacagaagcatgtgattttcagaaccatttaaatattaacctgattaaccacaactgctgggttttgctttggtagcagtactcactgaaatatgttttcagttaaaaaggttagttctcactgttggttgggtaaatttcaagaaggagtcaaagattataaaaatccacccaaagtacgggtattgtcttgtacataagtaagcacataatttagatgccagctttaaatagttaactatatgcttactgtggagtgcaccaatgaaacaactcattttgttcttttggcttctcaatacttctttgtgacaaagcatcactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattctttctgaaggtaagctacttcggaagcacaactattgactaaaaactaaaccttcgaaagaaatgacagcattgctagttttttgtgtgcgtggntttttttggggaggggggcgtggggtactgtattaaggttagtttccaacaagaattgatgtaattagaagaaattgacttccttacctattgcctctgatatttacttgcttaaatttttttttattggaaatccagaaaaagtggatttagagaacaacactaactcccacctaatctatgacagagatgtagaagagagtacctgtgaaaaatgtgaaagtatctgaaaaatgtaacctttggcagcctgagcatagtcaaccagaaaaactatctgaattaaaataattggtccataggtactattttatttggtccataaggattattttttcaacttttttttcaagtgtattattatgtcatttcccacgtaggttactgatacctgaagactttttccacctttaaccttactcgttgaggagctttgtagtctaataaaagagaaatataagtaaatgttagatatatgggtggataatggtaactatgtgcttaaagaggtataaaagaagggtagggagcagataagacaaaggaagggctatattataaggaagaatattccaagtagggaagagaaaaagatatgttatccatataatattttatgtgcagtagagaacatgttctatagaagagacagaagatgaaactagatgggcacccagatcataaagcaccgtatgtacttaggagttggaattatcttaaaaactatcatagatttcaagcaggggagtaacattttttaatctaggctgaagataacatcatgaactaagatggtagtgacagtgggcataaaggagaagctaattcaagaaattttaaagatcttacttgataactatcttgattctgagataagagaggaagaagttgatgatgagatcctggtttatggctttcagttatggcttgctattaaaaaacaggaaaaaagggattgagacaagtttcagttttggacgcatgacatgagatatccaagtagagatatccaagtagaaatatcagtaggcatttgaatatatgccctggaatgaataactgaccagagatatattttgcaactcaaatttttatgggtcagcagttaagagtagaaaatcaacctataagaataccagcatttttagctgggtgtagtggcacatgcctgtaattccagcttctttggaggctgaggcccgagaatttacttgaacctgggaggtggaggttgcagtgagccgagatcacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatgaaaattgaaatgaaagcttaca

SEQ ID NO: 140233 - DNA, 147 bp, Homo sapiens
ttgggaagtggagtctgcagtgaactatagtcctgccactgcacttcagcttggggaacagagcaagaccttgtctccaaacaaacaaacaaaaccctcaaagactatatataggctttaccaccaagaaccatctgtggccttatg

SEQ ID NO: 140234 - DNA, 350 bp, Homo sapiens
cctgagcagaagggaactgctctgaaagaaaatcccagcttctggggttgcagggctttgctgattcattcagtcaattgacaagcagcacccacagacagccagatgttaccccgtgtttatctacccggatgttcacaccaggtctatatggcacgggggatccttccatttctctgataggggaaaactgagacttccaaaagtgaagatagtctcccaaggcccacagctttgaagaggtagcagagcctggatttgaattcaggtgaccagctctaagcctggagtttgacctaaggctgatttctcctctgagagctgacagaatcttaatggccaaagcaaca

SEQ ID NO: 140235 - DNA, 166 bp, Homo sapiens
agagcactcaggcttgaggctccagcactgccctagggaaagggactcaggcctctgggacaagtggcccatccagtccttagaaagtaggactctagagccgtgggcttttctgcttcctttctgttctgggtgggtctgtctccaatccactccttgtggccag

SEQ ID NO: 140236 - DNA, 386 bp, Homo sapiens
catctcttggagagactggttgaacctcagggaagatgtcagctccaacactgtatgtgctatttccagtcttcatctaattttcctctttttctctttttctttttttgagacagggtctcgctttgccacccaagctggagtgcagtgtttcaaacatggctcactgcagccttgacctcctgggcaacatagtgagacagacccttgtttctacaaaaaaaaatttttaattagctggttgtggtggtgtgcatctttagtcccagccactcaggaggctgaggcaggaggatcacatgagcctaggagttggaggctgcagtgagctatgatcttaccactgcactccagcttgggtgactgagtgagaacctatctctctc

SEQ ID NO: 140237 - DNA, 983 bp, Homo sapiens
accctcattataggctcacaagagtctctctgtctctctctcagacatacacaaacacacacaaccagccacaggcccacaaaggtctctctctttgtccctgtctgctctctcgcactcacaaacacacatcgataaatagaaggaagaaggggaagaagaagggaggggaaaagagaaattccaagagttgttgttttgttttgtaagacagggtctcgctctgtcctccaggctggagtacagtggtatgatcgtagctcactgcagccttgaccttctgggctcaattgatctgcccgccttagcctcctgcatagctgtaaatttgattttgaaaaaatgttgcattacattattattttttgtagagatagtgtttttaccatgttgcccaggatggtctcgatctcctgacctcatgatccgcctgcctcggcctcccaaagtgctgggattacaggcgtgagccaccgcgcccggccatttaccccatttttgaaagcttggctaatgtatgtgacactgagaattccagctgtgctcctgcagcaagcatggtcactgaccatggttcacctggaagcctcccttagtcctgtgggctcagaaactcattttcttggccccttacttagatcgtttcattctgggaccctattccaagattattaatcacactcaggtggatgtgtaaaaccaaaatgccatttttagtacctgacaactgaagaaacctgctagactggcagctgagaagctggttgtaatcactctgtcctttgggatctagcgaggctttttgggtggagtggccggctctaggagatgaggccttctccatttttttttttttcttgagacagggtttagctctgtcacccaggctggagtgcggtggcacaatcatagctcactgcagcctttacctcctgggctcaaacaatcctcttctcagcctcccaagtagctgggattacagg

SEQ ID NO: 140238 - DNA, 454 bp, Homo sapiens
gaaggaagacagggacgttgaggatgacttttaagcctgtaacttgctgggcttatgaatgtgggttgtattcactcaaaagagaaaactagaagcacaggagcaggttggatgttgtagttggttttctggagaatgcatgcagggaggggttagtaatggtggtagaggcagggtgcagaagtcataaatttaaattttggatatgttgaaatggtgatgcctttaaggtatataagtggagatgttaagtatgcagttggatctatggatcgggggctcggaagagatcgggttgaagatacatatttaggagttacctaaattcaaatgataattaaagtcacaggtgtggctgaaataatctagagagatacagcattggttctcaaagtgtggtccctggaccaccaagctcaacattacctgggaaattaacaaaaatgcttattct

SEQ ID NO: 140239 - DNA, 596 bp, Homo sapiens
atggccacagctttgttatcttgctgctgtgaggggacctgtgttgtaggtccagtggagagaggtgtttggggacccatgaccgactgcctctccaggcagcctggggggtccactctttgtatagctcttttttttttttctttgagatggagtctccctctgtcgcccaacctggagtgcagtggcgtgatctcagctcactgcaacctctgcctcccaggttcaagcaattatcttgcctcagcctcccaagtagctgggactacaggcgtgagccactgcgcctggcctgtgtagctcttgaaaccactcctcatcatggcatacctggtgacatccctgcagactctagagatggaggcacaaccaacaactctctgttctgctccaacacacacacacacacacacacacacacagcactgcagatctccagggagcccagccactggcccttgtgtgttcctctcctcccaatttcagccatttacttccctatgtgcactagccctggaggcaccaggacaactgtcatgatttaactcaggccatgggagatgggagtagatgaagaggagcaacagcagagagag

SEQ ID NO: 140240 - DNA, 417 bp, Homo sapiens
tctgccataatagcgtcagcctgcgtatcaataacatcataacagcagcaaaaccttctttggttaccccccttcaaatatttattcccccaaacaaaacaaaaacgacccagttgtccatcacaaatgaagacccctagaagggccacgaccctagcagctgtttcattattaaaataggaggtagactcaatctttcgcctggagagatgcggtgtgatgtgttttctgaatctttctggacttttcgggatctttccggaatcttcccggaatcttccccccaccctcaaaacaagtttcctggtttcaggatccacattgccttttctgataactataaataggtctttggtaatttgatttttttttttttactagctaggctaagttcttgattagttttcaacaatacca

SEQ ID NO: 140241 - DNA, 519 bp, Homo sapiens
atattgatttattgaacccacttaaaaaattatatgtagactgttctgaatccattgtatgttggatacaaagttttaacctatcttcctcctttctaagataaatgtagagataaaatggtaacaatatttcctggaattagattttatgagccaaggctaatttttttgccaactgaataccaggcattgctataggagcagggaaactggaaaccttgtttagcttatttctgtctctggtacgtacatctattagcaagatcagaaactctcgtagtggaaatcttttccatccctctccccacaactccagctcttgccaaaatctttgtattttaattacagcatctgaaacaattcagtacttcttcttttgcttttattttctcttttttttttttttttttttgagagggaggattaggaagcaaaaatgataggagaaatggagaaaataagagctcttgttaagaaagaattgactgtaagtttgctttggaacagcccagaagtgtc

SEQ ID NO: 140242 - DNA, 295 bp, Homo sapiens
cggtagtcaataggatgggactttgggtccagtcaaaatagggtttggatctcagcactgctatttaatgttggatattagccacctctgcatcattttgaacaatattaactaacatgtttagaatcacaattaaggagcagaaattacccgcaaggaatttccaaaactcaaaaagagaatatgttcagaccaatgtttttccgatatataaggaaatgtccgcaaaatatcacattcagcttttaatttttgtttttgtggtttttagtcagatctttatactttcaaaatt

SEQ ID NO: 140243 - DNA, 416 bp, Homo sapiens
tattactgcctttccctagggttttgtaaaatagtgctttatctccaagctactacccagccgccttttatttaaagtgttcagtggaccattatttgggatgaataaaaattcgatgttatgccacagaaaggtaggattttggggagaaacaaatacaggaaacaggtggaaatagatacattgagaagaatccttttgagcagggatttttgtagaaaacattaaaccaaatcgtatatcaaactctctggctggtggtcagtctaatcacaagcatttattcttaagtgtcctacagagagaaaaagctgtttatggctgtatcttgagttaaatatttggatttggactgcaagttaattttagggagaaaacatctgtctttctgaaaacagtatgcctttaaaagtgat

SEQ ID NO: 140244 - DNA, 233 bp, Homo sapiens
cgccactgcgcccggccaacccctgcctcctctttacagtcctcttccaccccgtccctggctgctgtcctccagcactggggcttctgttcgctgctgtactgcacactcctggaaagggacaggccatgtcctactcaaatttgaatattcacggaccatagacctagacaacaacttctagatgaaaacataggatatctttgtgacctcgggcaaagatttttctcaga

SEQ ID NO: 140245 - DNA, 285 bp, Homo sapiens
agcagggagtgaaggtggaggcagagaagcccgttaggaggctggtgctgtaactggagtgagaggtggtgggaaatggaccaggaggagctggggaggactggtgctctagtgagggtcctgcttgccttggtggggcgtggccagcttgatgcttggcgctgtcctaggtactgaccgtcaacctctagtcctccgtgctgatggtgaagcagagagagttgccccttctggaaagaggccagggctaccccgaggagctcactgtaggtggggagccttccc

SEQ ID NO: 140246 - DNA, 202 bp, Homo sapiens
ttaaacaagagaaactggcatgtccaaggtcacattactagaagcagggaaactgggattccaatccctcacaaaactccagagcctgcactcttttttttttttggggaaagggattcgggttgggcccccattgggggggggaggggccagattttgggcccggggaattcccgcccccgggtaccggcgatattcctct

SEQ ID NO: 140247 - DNA, 437 bp, Homo sapiens
accctaaatactctgacttgatcatcacacattctatgcatgtaacaaaataccacatgtactgcataaaagtgtacaaatagtatatattaattacaaaaaaaaatcgtgtggctaccaaaactcattatttcaggtgctagcaaatgtagtcacaaccaagactaggcttgaactcttcctttcagcttcctgacagccaagtaacggagtgaaaggtcagataatttacttagacctgagactgccattaatattgtcaacaaattgctttgatctacagctcattagctttggttggaattgctaagcaaataagccaaagtgaaattttgttctatccaatggcctatctagtaccttaaccccagacaaccttcttacatggtgatcacaactaagctggtgaatgggcataaatcttttattgctaccag

SEQ ID NO: 140248 - DNA, 362 bp, Homo sapiens
gtgatgggcccagcccttttctgaagttaactttgaaagcagtaagatatttatttacatagaattcaagagaagggatttttgagtacaacttcctcactggttttgcttttaatgtaggattctggaatgtaaatcagtaggagatttctagttactggtggaagagaagatggcttccttatcccggaatcacagggattgggggtaaattctgtacataggtcctctctggaagttcttgtaaggaatatgggaaaatgaagctggaattattatagttacaatgttggctaaagttggttcatggaaaccttgaaattaagtttgttggtttgcttattcaatattggacagcagag

SEQ ID NO: 140249 - DNA, 377 bp, Homo sapiens
agaaagatatgtttggcttttttggtttttagttagagattttaaaaaggtctgtgaaggtcaagttgatcattggttttgattgcatcccacaggtttctataaactggcttaaaaatggcatactccattttctggtgtattcattgtaactttaggaagtatttgaaatggtcacattaaagtctaggaatgtcaaattgtattttaatgcgttagttctttttctttttctttttttttggagacagtcttgctctgttgctcaggctggagtacagtggcatgatttcggctcactccaacctctgcctcccaggttcaagcgattctcctgcctcagcctccacagtagctggaactacaggcctgtgcca

SEQ ID NO: 140250 - DNA, 302 bp, Homo sapiens
tatgtcagggtgtgtatgtgtgtggggtgtgtacgtatgtggagtttgttgtgttacttcacctgcagggagatcacgaaataaaagcaatagcccttgtctccaccagtggcttgggccaaataagacagagctgttgccccagctgggacaggcaaggccactgggatgccaaggcatggtggcttgttggtgtgcacaatcagtcacatgctcccagccctcagtagaagtgccctattgatcctccaccctcacccaagcgagcccagccccctagccctacctgctgcctccctcct

SEQ ID NO: 140251 - DNA, 311 bp, Homo sapiens
ggcagtctactgatggggtcccagaaaagcccttaggtccatatgcaccgtgtataagctcttcttctaaaatgaaaattactgtgagaattttacctgaagaaaattgagtttactgcaactatctttgggtcaggtgtgtacctgtgtagtatatattacatacttagtgtttatactatgcatggtgtaaaaccaggccactttgtgctatgagtgaggactccccaaaagggcatggcagacaggtaccctgaaatatatctggtatatacctctttgagatcagtcttctgaaatcttatagatac

SEQ ID NO: 140252 - DNA, 543 bp, Homo sapiens
gtagtcgtctgtcattcttcgcggtgaacatgtctgagcattacacgtctgctcctcatagtgatgtgacggtcgcatacctcccgaagtactgggattacaggcgtgagccactgcgcccagtcatgtatagtcacattctgaagtgctagagattagggcttcaacatatgaatttgcgaggcacacaattcagcccataacactaagcaattattttcttagaaattttgttgtaaaggaaagcaaaagatcaaagtggaactagatgtgaatgggaagacagggaggttttgtctttactttgggcttttactatgggaggaattacaactactggtattgctggtaagaatgatatggcagagaagctgaaaatggctgcgggaaagagggggtgattgcggtagcaaagcctgagtacctgagaagggatgggatcaagaagtatccaatgacttactcaggtcacataacctgtgagtgatggggctggcacttgacctcaggaatcctcactctgagactctccagtccaaccaa

SEQ ID NO: 140253 - DNA, 430 bp, Homo sapiens
gcccagggttaagcaggtgtgactcctcgtggagtgcatccctatttcctgagccccactcgctgttagaaaccaaggtattgagggcttagtgagagtttttcaccatttcctgctgctttaggtcctcccatttccagttgttttcttcctactccagggatctcctcccttccccagggttgaagcaatgcacactgaagtattaatagtagtgatcagcaccttcaagacagcaggacccttctgttgccttctggctgtggtgtgatgtcctagggcctgtggtgcataagcaggtggaatctaagcactgaccctggtcattctacatataagaggaagaggactaggaaagctcgacaaatgctgttctcctcttcatggcaaagccttgctctttggaatccttatctgcatttaaaatgtg

SEQ ID NO: 140254 - DNA, 516 bp, Homo sapiens
aattataaagcactgtattttgcttgcatggtatcactgccatccttcaacaggacacagttttacattctttatgtattgcaaagtgggagacaatgtattgacagttgccaagctatgattttaaaaatgtgaagcagatcttctgtggacgatggatcttgaggctctgggccggatgacctgtcctgacacctgctaacatctcagcaggacccgtagggaagggaattctgcctccttctccttcagtcatctcagaattgaacactgcgcaggactcagtgacatcctgcaaccagagatacagatattctcccaggaacacccagacctacagctgaagccaggatgtcttagtggaagggaccaagagccaaggagacttcagcctcctggttacttcctccctgcagcctgggtgcactgcagactcaggcgcagtggccattagtgctgtctcttggacccgcacctgaccgtgtcttaactacaacaaccttcaaaggcttaggt

SEQ ID NO: 140255 - DNA, 140 bp, Homo sapiens
ggatcgagctcggcccggttgaatttatttgccaattactttagaaactaaaggtattaaaattcagaactcagagtccttgtaatattattatacaataaatatttggaatatttccatttatcaataatgccatctgt

SEQ ID NO: 140256 - DNA, 276 bp, Homo sapiens
ctgcactccagcctgggtaatagagcaagaccctgtcttcaaaaaaccactctagatttcatgttgtagggggtagggaggacaatttttaacagctttaactgacatgggtaatatataagttctgtgttctcactttatatgaaagtacttttttaaatgttaaaaatactagagctgtattaacttcgtgattttatttttcttcttagcactaacttcaaaataaccatacagtactgcttgtaatttttgtatttttagtagagacagggt

SEQ ID NO: 140257 - DNA, 305 bp, Homo sapiens
cttgcaatagagactgagaaggaacagagaggtaggagaactgggagggagtttgaacaaataattaaggagaagagagagtttcaaaatggaggaagagatcaatactgccaaatgcttcagagacatcatgaaaagagaaagactatctatctgtcggatttgtcagtgctttttggtggtctggataagagcattctgaggaggagagaagcgagagtggaggccagactacatagagggacatgaggaagcggagaaggtaactgtagcaagtcttgcatattcctggtaggggtatgggg

SEQ ID NO: 140258 - DNA, 349 bp, Homo sapiens
ctgacttggctatatttatgttggaaaaaagctctaaaaccagaaataacactagaggtaaagaagggcattatataatgctaaaaggataaatttaatggaaaaatatctaaaatttttatatatgtaatagtataggtctaaaactaaaaggaaaggttgacaactattataaaaagttaaaatagacaaaaccacaaccatagatcagtgcccctctttcagtaactagtagaacaaacaggaaaaaatcagcgaggataaagatttgaacaacacagccaccctgacctacttggcggacatagaacacttcactcaataatttcaggatatatatgcttttcaa

SEQ ID NO: 140259 - DNA, 241 bp, Homo sapiens
ttacaggcgcctataactgcgcctggctaatttttgtatttttagtatagacggggtttcaccatcttggccaggctgggttagaactcctgatctcgtgatccacccacctcagcctcccaaggtgctgggattacaggcgtgagccaccacacccggcttcaggcaggggatttagagggcattctgggcacacctccccccggggcagatggggaaactgaggctgagactggtcagt

SEQ ID NO: 140260 - DNA, 323 bp, Homo sapiens
gctgcgagaggtagggaggtcacctccacgaccttcctttgcctttcccttcacagacctgagactgggtcctgagggaagttgggccccagggaaactgtggggcttgagatggagcaggatccaggcagccactctgaggttgaggtttcaagccatgagcaggtagacctagtgcaggcaggcctggagggtggggtggggtggagtggcaggaagagccaggctgggggaagacctgtcaggtatcctaggaacaagagtgaggagcaagatgagcctgcaggaatctgaggctggcctctgggatggtgtggggagct

SEQ ID NO: 140261 - DNA, 589 bp, Homo sapiens
ttgtcctggctagtcttgaactcctgggctcaagcaatccgtccgccttggcctcccaaagtgctgggattacaggcatgaaccaccatgcctggcccacacagcatataatttaaatggaatcacatcatgagaacagtaataaaaacagtcatattggtccacttaggctgccataacaagacaccaaaggctgggtggcttaaacagcagaaatgtgttttctcacagttctagagtctgggagtttgagaccagggagccagcatggttgagatctggtgagggctgtctctcttcctagcttgtggacagctactttctggccatgttctcacatggccttttctctgagtgtgaggggcacatatgagagagtgagatgtcttccttccccttcttataaagccaccaaccctcctggattaggaccccatccttatgacctcatttaaactcagttacctcctaaaagccctgtgtccagatatagtcacaattaggggttagggcttcaacataggactttttggtggacgcagttcagaccatagaaacagagatacatagcacttacttgggaccccca

SEQ ID NO: 140262 - DNA, 231 bp, Homo sapiens
gataacctcctctgtatcagttatctttatatttgatatttgattattgaccaaagaattttaatgtcagttttttatccttagaatgggagttctataaggacagggatttttttttctgttttttaaacagtgcatggcacataatagctgctcaatgaatatttttgaataaacaagtggataaaccagtatgatgcagttttttctttaacatagaaagctatgatg

SEQ ID NO: 140263 - DNA, 552 bp, Homo sapiens
agatcagctcactcaggctctgtgggtgggtaagggcatctctaaggcaaagcaaaagcaaactcctgtccagagtagagcgcacacatgaaaaagtaatttactggttaagttcaaaagttcaactacctggctgggcaaggtggagctctcagaatattgaagacttctgattttatctatctaaaatacaagactattttcaaatacagaattttgagaggttgatagtttctaatacttccaatccatctgagagagtgacagcatatattgtacagagctatcaggtatactaatgcaggcaacaggcattggctttcctaagtttttccatccctagaaaaataatctatcataaatgctaattcatcaatggaacagacatggtccacaggagtccaagacaaggaggtgtcacctgccttgtatgcaaaaatagagaaggcacaagttagacatggtaccccctaaggcctcacagaagcatccaagactttcaacaagtgaacctgaggagaaagggagaacgaacccctaagtcttattcac

SEQ ID NO: 140264 - DNA, 500 bp, Homo sapiens
gacagtgtgatcttcaaagacgagggagtaaagaagtagtggggaatattttcctgggtaattctgcacccccgctcccacctttacagaaacactaagagccttagccacttcctctttcttggtggttatgtgggtactcaggctctggtcaagtcattggctgtttatggagcaggagacagatgacttgggaaagcaacatgaaaatgtcttgggttggttttgagcttgcatggggggagtgagtcagtagatgtttctcgggttctctctcttcctctcttgcctttcctcctttctttgagcttgtttcgctctgagagtacaggcttggcacccacttacccaagaactgattagttcctaaaagaagcagtgagttgattgcttacagagatgatgtaagctttgctctggggtacatcaacttggatttctcatgctttatcttataaagcctaaattaacagctggtttggtttgagttctctgggatc

SEQ ID NO: 140265 - DNA, 312 bp, Homo sapiens
taatgttcctccagcaggtcaggcatattcttgcccaagggcctttgcacttactgttcctgcagcctggaatatttctctccaggtcactgcatggctcaaaccctttcctcctccctgtttttacttagatgacaccttctcagggaatatatattccctgaccaggtggaatatcctctgatcaccttatcttttgagactgggtctcactctgttgcccaggctgaagtgtagtggcacaatcacagctcactgcagcctcgaccgccctggctcaggtgatcttcccatatcagcctcctgagtagc

SEQ ID NO: 140266 - DNA, 694 bp, Homo sapiens
ctacttaccagaaacttagcagcttgaaacagcacccgctcggcacacattcctgttgggagtgtgaaatggtgcagctgctgtgggaaatggtctggtgattcctcgcaaagctaaacaattgccatagcaccctgcagttccacacctggggatgcacagccagaaatgaagacgggtgtctgagcaaaaactcggacatgagtgttcacagcagcgttattcacagtagctagaaggtggaaacaacccaagtgtccgtggaccgaggaacagatcaacaggccacggcgcacgcacgacggagtattgtgcagccagaaaaagggtgaagctcccttacacattatggcgtgggtgagcctcagaaacatggtgctaagtgactgcgtttatataaaaagcttgcactgatgtaaagtgtctagagtagagaaacccaggagatgaagtggattcgtggcttccagggcctgagggcagagggaagggaccggctgctgatgggtctccgtttgggaagatgaacgagttctggagcttgcttgaggcagtgtctgcacaacagtgtgagtgcacggaatgtggctgaattggactctttaaaatagttcaggtgggcaatgttatgttatgtgtgttttactaccatacaaataagtaaataaatggacaagcctgcaaaaaaaagtag

SEQ ID NO: 140267 - DNA, 557 bp, Homo sapiens
ctacttaccagaaacttagcagcttgaaacagcacccgctcggcacacattcctgttgggagtgtgaaatggtgcagctgctgtgggaaatggtctggtgattcctcgcaaagctaaacaattgccatagcaccctgcagttccacacctggggatgcacagccagaaatgaagacgggtgtctgagcaaaaactcggacatgagtgttcacagcagcgttattcacagtagctagaaggtggaaacaacccaagtgtccgtggaccgaggaacagatcaacaggccacggcgcacgcacgacggagtattgtgcagccagaaaaagggtgaagctcccttacacattatggcgtgggtgagcctcagaaacatggtgctaagtgactgcgtttatataaaaacttgcttgaggcagtgtctgcacaacagtgtgagtgcacggaatgtggctgaattggactctttaaaatagttcaggtgggcaatgttatgttatgtgtgttttactaccatacaaataagtaaataaatggacaagcctgcaaaaaaaagtag

SEQ ID NO: 140268 - DNA, 451 bp, Homo sapiens
aaaccccactagtcttcgggagaaagaaaaaaatataaaaaagcccgggggcatcgcaagggaattttttcacacccaaaaaagggtgaagctcccttacacattatggcgtgggtgagcctcagaaacatggtgctaagtgactgcgtttatataaaaagcttgcactgatgtaaagtgtctagagtagagaaacccaggagatgaagtggattcgtggcttccagggcctgagggcagagggaagggaccggctgctgatgggtctccgtttgggaagatgaacgagttctggagcttgcttgaggcagtgtctgcacaacagtgtgagtgcacggaatgtggctgaattggactctttaaaatagttcaggtgggcaatgttatgttatgtgtgttttactaccatacaaataagtaaataaatggacaagcctgcaaaaaaaagtag

SEQ ID NO: 140269 - DNA, 597 bp, Homo sapiens
cagctgaatcctggtttagactaaagtcagctgattgaactactagtattagatcttttggatttattttaagcactattttaggacaaaatatctaacattttacttgatgaattttaactttttcttaccactcattgttttgaagaaattactttgtaaaagtttgagatgtcactaatttttcccttggcattaagcgatacatgaattcattttattcttctgactgaggatgtttctgttagtgtatacattcaagaatatgatgatgccattagtcatttaattttgttgaaacttggctttagtggctgttaataaaatgaattggttggccaggtgtggcactttgggaggctgaggcgggcagatcacctgaggtcaggagttccaagaccagcctggccaacatgctgaaaccccatctctactaaaaaaaagaaaattagccgggcgtggtgacatacacctgtaatcctagctactcgggaggctgaggcaggagaattgcttgaacccaggaggcggaggttgcagtgagccaagatcacgccactgcactccagcctgggcgacagagtgagattctgtctc

SEQ ID NO: 140270 - DNA, 313 bp, Homo sapiens
atgttattgtaggaagaaaaggaagctaatttgtgagatacccaaaatttggtgctgtagtttagcaacaagttgattgtctaaacaagcaaaagttccttgctcacagttgacctgaaaaaaagaagtagaaagaataaaagcaaaggacagtaactatgataattttggtttcttgcttgggagttaggtgatgtgatgccattgatttctatgatggtggatggacagatataaaggaaaaaataagtaatcattataataatagtaataatccacatttgttgaggtctaactatagtatatagtatgc

SEQ ID NO: 140271 - DNA, 489 bp, Homo sapiens
ggagacagtttctcttctggccaacaagagcttttctgacccttcataaaaccaaaataaatcccattttcttaaaggatagaaaaaccctattaacagaaatactgaagggactttcacaacactggtgacagaggcagaaatttttctaaaaaagaaactttcttgggaagtttggctagtggcacccttctctctctctctctttttttcaagaggaagaataccaagggaaaaaaaccctcagaactttctgaggaaaccagctaagggataaaatgtgagagggtaaagaagtcttcagaaactgtgagaacaagcttgctctgaggtgaaatgtccaatttatccagggaagaagcagctggcacgcgctgcatccccagagtaaattaaaagtagaacggtgacagccaattagaagggaacaattaattaaaagttaaaggttgacacatttaggtcgatatattagattgatacattaat

SEQ ID NO: 140272 - DNA, 297 bp, Homo sapiens
gttggtgagtaggttgtggggatgaggatggggaaaagtaatctaattatggagatgtacatgagaatggagtctttattaccatgctggccactggcaagcattgtagctgtggataacatgtggataacatgtaaagggtatgttctgcttcacaagtagtgctctgtgtggtgggatgagcactgtgctaggagtcctgaggtccagatcctagctctggctctccctctaacagagggagactccctctgtgacttttggaaagatgacctctctgaggccacatattcttta

SEQ ID NO: 140273 - DNA, 285 bp, Homo sapiens
gcaaaaaattaatctaaaataaaaagggatctggtcagttgatttaatattttggaggctggatcatcgataataggctcaattttgtcttgtttgtttttcttcttaggggaaaaatataatttagtctttcttcagtatatcccctcactccattttctaatagcatgtttgtcttctatatggcatcactaggtaatattgaaatggtagtaactcttgtattagtctttgatgtaattgaattgtcttgacatttttcaggctgttactaatttttgctaa

SEQ ID NO: 140274 - DNA, 478 bp, Homo sapiens
ggaaacatcacaccctcagagaaccttctctgggaccatcccatccacagcagccactactgacttgtcactatcagtctcttgagcaatttcagcttagtacttgcacaattcatgatttttttagttaactatctgtctcctttatggtctgcagtttctatgaagagagaggccaggcttgtctatttttagacacagtccccagctctgggctaagtccttttaaatgcatgatctttccatgatccccattttataggtaagaaaactgaggcacagtttattcatttatttgccaaatgaatggataaatagcaccccccgcccccgcctcagaagatgtgctgtattcatgctgtaccttatctgtagcttatatactggccagtttcatgttcctgggggtcatgacctaatttgagaggtttggggaaatgagcagtctacttgggacctaacgcaggcctgcaacttc

SEQ ID NO: 140275 - DNA, 301 bp, Homo sapiens
gaaggtcagtgtcactgccgtgtggacagtggatcagacaggggagacaggaggtagagagaagttccaggtagggagaaggccgtctcagcacagaatctaggatgcagcaccaagggccacaggcagcaggggagcagaggaggagtcactagggacataaggacaggcttgggagaggggccactaacacggcctctagagtagtggctgggctcctggctgggaggggctcccaccagccagacaagagacacagaatgaagaagggctttgggacatgcctcgtctgaggtgctgt

SEQ ID NO: 140276 - DNA, 301 bp, Homo sapiens
gggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactccc

SEQ ID NO: 140277 - DNA, 319 bp, Homo sapiens
gagaaagagagagagaaaagaaaaatacagaacagcaaatgaaatcctaagatctcacccaccgttccatgatttctgggactgactgcacataaactcagttcccagaaatcccgcactgaggcagaaacatagctgctttgaatttactgcaggtggtttctgggaagaaatatttagtcaatgaagggcagtaagcaacagtctttcaagtcatgactcacagcttactccaacacatgaactcagcttcttctcctccttgtagaatgtactggatccctgagaaaggtccgctcgacccatcctcctctacaca

SEQ ID NO: 140278 - DNA, 439 bp, Homo sapiens
gtgaccaatcactttgagagctggaaaattaaaggaaagaataaacatttattctgaatcttgtatatgaacggcaacatttagagtggtagatgtaagaagttcttttatagatacttcctcaacaagcagcaataacagtattaaaatatatttttgcaggccagcatggtggctcacaccaataatcccagcatgttgggaggccaaggcaagagcactgtttgagcctaggatttcaagacccgcctgggcaacatggcagaactccatctctaccaaaaatacaaaaaattagccggtgtggtggcacgtgcctgtggtcccagctactcaggaggctgaggtgggacgatggcttgagcccgggagtcagaggttgcagtgagccaagacgccactgcattccagcctgggtgatagagtgagaccccgtctc

SEQ ID NO: 140279 - DNA, 440 bp, Homo sapiens
tcccaaagtgtggagattacaggcccagcagtaatttgctttataatatgtgaatgttttatatttgaacttaggagatatatttaccctaaaatcacttttttttctattttatattcacgttctttgcaaggtttaatttgaaagaaagttttactgtttgaaaatttggaaaattgctgattcagtatatgtaacaaattggaaaaggtgaagcaggaaataaaggaaattggttattttaaattgagttaatattctgatggggagggcacagcagaaatgaaatcagttcaaatttctgttccaagttttgttttcatttctttgacaacttttagaatcccgtaggcattgatttgtttctgccttcaacttcagtagatacaacttaattatttcctgttaagtagagttactggtagctcctgaaaaggtga

SEQ ID NO: 140280 - DNA, 883 bp, Homo sapiens
cgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcaaaaaaaaaaaaaaaaaaaaaaaaaaaaaaaaaaaaaaaaaaaaaaaaaaaaaaaaaaaaaaaaaaaaaaaggggggggggggaaaaaaaatacccgggggggggcaatggggcacccgttttaggcgtacacaagggggtccccaaatagaaggacgtcgtagtattaataaacatagagcggagagaggcggggttttaaaaaacaagcgtggtgggggaggagaaaacagctggttatgtggagaataatctgtggagaaagaggaagcgcaaatctgtgggggggggaagaaatatgggggggaacaacccgcatagaagtaattataacggctaggagaaataaaaactgagggtggtataatgggtggaacacaagcgatattgttgtgcgcaagaaagtaggaccggggatagttaagaaaattcatgc

SEQ ID NO: 140281 - DNA, 1295 bp, Homo sapiens
  misc_feature (52)..(52): n is a, c, g, or t
  misc_feature (64)..(64): n is a, c, g, or t
  misc_feature (153)..(153): n is a, c, g, or t
  misc_feature (203)..(204): n is a, c, g, or t
  misc_feature (206)..(206): n is a, c, g, or t
  misc_feature (257)..(257): n is a, c, g, or t
  misc_feature (280)..(280): n is a, c, g, or t
  misc_feature (292)..(292): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (316)..(316): n is a, c, g, or t
  misc_feature (323)..(323): n is a, c, g, or t
  misc_feature (330)..(330): n is a, c, g, or t
  misc_feature (335)..(335): n is a, c, g, or t
  misc_feature (349)..(349): n is a, c, g, or t
  misc_feature (354)..(354): n is a, c, g, or t
  misc_feature (356)..(356): n is a, c, g, or t
  misc_feature (359)..(359): n is a, c, g, or t
  misc_feature (370)..(371): n is a, c, g, or t
  misc_feature (373)..(373): n is a, c, g, or t
  misc_feature (375)..(375): n is a, c, g, or t
  misc_feature (388)..(388): n is a, c, g, or t
  misc_feature (393)..(393): n is a, c, g, or t
  misc_feature (396)..(396): n is a, c, g, or t
  misc_feature (410)..(412): n is a, c, g, or t
  misc_feature (416)..(416): n is a, c, g, or t
  misc_feature (420)..(420): n is a, c, g, or t
  misc_feature (423)..(423): n is a, c, g, or t
  misc_feature (428)..(429): n is a, c, g, or t
  misc_feature (431)..(432): n is a, c, g, or t
  misc_feature (435)..(436): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (451)..(451): n is a, c, g, or t
  misc_feature (453)..(453): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (471)..(471): n is a, c, g, or t
  misc_feature (475)..(477): n is a, c, g, or t
  misc_feature (481)..(481): n is a, c, g, or t
  misc_feature (486)..(486): n is a, c, g, or t
  misc_feature (491)..(491): n is a, c, g, or t
  misc_feature (497)..(497): n is a, c, g, or t
  misc_feature (499)..(499): n is a, c, g, or t
  misc_feature (502)..(503): n is a, c, g, or t
  misc_feature (515)..(515): n is a, c, g, or t
  misc_feature (518)..(518): n is a, c, g, or t
  misc_feature (520)..(520): n is a, c, g, or t
  misc_feature (522)..(523): n is a, c, g, or t
  misc_feature (528)..(529): n is a, c, g, or t
  misc_feature (531)..(531): n is a, c, g, or t
  misc_feature (541)..(541): n is a, c, g, or t
  misc_feature (546)..(546): n is a, c, g, or t
  misc_feature (549)..(550): n is a, c, g, or t
  misc_feature (555)..(556): n is a, c, g, or t
  misc_feature (559)..(559): n is a, c, g, or t
  misc_feature (561)..(561): n is a, c, g, or t
  misc_feature (564)..(564): n is a, c, g, or t
acttaaagcctggaatgatatcaaaaaggtctatgcctctcagcgaatgagngctggcaaaggnaaaatgagaaaccgtcgccgtatccagcgcaggggcccgtgcatcatctataatgaggataatggtatcatcaaggccttcagaaacanccctggaattactctgcttaatgtaagcaagctgaacattttgaagcttnntnctggtgggcatgtgggacgtttctgcatttggattgtattttttttttccngatttttgatttatttttctttntttttctttaantcnttttccntctnttttttttanaattttncctattntcatntttattaattcttnttttntnttnttttttttatnntncnttttatccataanatccnttntttctccactcaannntttncttntcngagtnntnnatnntnaccctnttnaatnanttttgnatctnttttntntctnnncccnttttntaaantccatncnccnnatactctcattnttntncnntctcnntntttttcaatntccgnttnnataannctntnttntgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcaaaaaaaaaaaaaaaaaaaaaaaaaaaaaaaaaaaaaaaaaaaaaaaaaaaaaaaaaaaaaaaaaaaaaaagaaagaaaaaaaaaaaaaaaaaaaaaaacaaaaaaaaaaaaaaaaacaaaagaaggagaggggcgggcgaggcgagagcataacgctccacgggggagcgggggacatgcagaccccgagaccgctaagaatttattaaaaacgaaggacgacaataaaatgagagacgtagagtaagatagaaaaaagaaaggaaaggaggaggagaacaagaaaaaaaaagagatattagtatgaagaaaacttaatagcatagtagggagtaataagatgaagataagaataaatatttgatggagtaggagaaaataagtatggacagaaaaaatacaaagaaagaaatgctagaaacgacgcgtaataat

SEQ ID NO: 140282 - DNA, 883 bp, Homo sapiens
cgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcaaaaaaaaaaaaaaaaaaaaaaaaaaaaaaaaaaaaaaaaaaaaaaaaaaaaaaaaaaaaaaaaaaaaaaagaaagaaaaaaaaaaaaaaaaaaaaaaacaaaaaaaaaaaaaaaaacaaaagaaggagaggggcgggcgaggcgagagcataacgctccacgggggagcgggggacatgcagaccccgagaccgctaagaatttattaaaaacgaaggacgacaataaaatgagagacgtagagtaagatagaaaaaagaaaggaaaggaggaggagaacaagaaaaaaaaagagatattagtatgaagaaaacttaatagcatagtagggagtaataagatgaagataagaataaatatttgatggagtaggagaaaataagtatggacagaaaaaatacaaagaaagaaatgctagaaacgacgcgtaataat

SEQ ID NO: 140283 - DNA, 308 bp, Homo sapiens
aaggagccagaactgatgactccaagttcttagcccagtgaaactgatctggacttctgaactatgagagattccattcctgttgtttgaagctaccacatttttgagaacttgttacagtagcccgaggacactaacacaaatggggctccgggaaaatccagactaaaggtgttgtgttggtttgcaatctccttgcttaactttctgatactagacgtaaatagattggtgaaaaattttgtgattgaagaaatgtacatgaaacctacagtgtacagagaagcatctgttagttataagataaa

SEQ ID NO: 140284 - DNA, 447 bp, Homo sapiens
cttaaaaagctaggttcgttttgctttctcaaattaagtcaaactaaagaattttaaaataaaagtataaatttggttttgtatttgtctcatttcaaagcataggtcagacagattcatcgacctttttttttctttccccactttaaaaaaatgaaaaatttcaggcacgtaacaaaaagtatgggatattcatgtaatctttgagatgtggtcttcctatgttgccaggctggtcttgaactcctggcttcaagtgatcctcctgcctaggcctcccaaagtgctggaatcatttttaaggaccattctatttaacttttggaaatgaagcatctgccttttaatggaaaaactacttctcattgtaaagatagcacacaatgttcttggctgctttggtctccaaaaaaagggaattgagatatctccctgtgtccgcattat

SEQ ID NO: 140285 - DNA, 518 bp, Homo sapiens
gaataaaagaaagaaaaaagggagaattgctgactttggttggatggtgtgaagtttcttggggtttaacagtaggaatggggagttaaaaccataagaggctgagtggaagatgcatgtggtgacaacttttagggtggctctctccctaatcaccagtgtggtggaagggtggtggggcagtaaaaccatcaaaagtcacagtgtagctgtcaatctcatcactgaagacaagaatacccaagtgccaggccaggaaaattatttacttcacaatcaggaagaaatgctgtggaactaaagttggggtatattcttgaatttgattttattctccagagccctaaagttaaccagctggaatcatttttaaggaccattctatttaacttttggaaatgaagcatctgccttttaatggaaaaactacttctcattgtaaagatagcacacaatgttcttggctgctttggtctccaaaaaaagggaattgagatatctccctgtgtccgcattat

SEQ ID NO: 140286 - DNA, 607 bp, Homo sapiens
tgactgggttttccatgactccagacagtgtcattctatcctaaccttccaaataagaaagtctgggttcatcttcaacacatcacagcctctcatcatacacatgaaatctgcagccattctgaggtgttatcctttactgttactgcagaccttgctcacacctccacccacttcctactttgctgtgtctcctttccctccctccctcttactctttcccatgtactgttcactgccactgtcaaacatctgttcacataatttcctgcctgaaggtcaccaggttcccttctctatgacgaatcaagtctaattataaagttgcataaactcaggaggcacaacctccacagagtggagctgagcaccatgctggctctgccttggcatctgtctgaacgggttcctattcctcagcctatcccttctctccatctgcgttaagctgaacaccctctttccaattagaccatctaggtcctccccactctagtctaagttccgtgtatgaagaggcagaaggcatccttttgactgtctcagagaaggctcttagaggcatgtggaataaataccactctgacccagcgaatactgccacaag

SEQ ID NO: 140287 - DNA, 184 bp, Homo sapiens
cttgtataataggcaaaattataatgtcagtgattatttttctagttttccccctttgtgtcttcaataaaaaataatctatatcattaggcagggatgagatatggattggtcactaaaactagcacatcagctacaaacataactttcactttcttcccattcataaacaagtcattatttg

SEQ ID NO: 140288 - DNA, 224 bp, Homo sapiens
actttgggaggacgaggcaggattgtttgagcccaggagttgcagaccaggctgggcaacattgtgagcccccgcctttaaggaaaaaaaaaagaaagaaagaaattagccataggaatgcattttatttaacctaacatattgaaagtattatttcggctacatgcggtggctcacacctgtaatcccagcagtttgggatgttgaggtgggaggatcacttg

SEQ ID NO: 140289 - DNA, 575 bp, Homo sapiens
ttcacgactgctctaatgataggcatatgaagccacagttttcctccttcctgctgttcattcaacctttctagcctggcagctttgcctcagttttcctccctggatgatgaatccacaagtctggccagaaggaagatgagcattactctgaaagtcattttgtacttttaaaacttattttctttctctgagttctgtattagtgttgtaatttgctcctgataccacctaaatcagttgcgattaaagcttttctatctttctttttttgtttaaaagaaaaaaacagatttgctgcctggagttcacgtattaacaaagatgaaaaagatagtgtctgatttataatgtactgaattgcctaagtctttcatttgtaattcttgacagtgttcctctagtaaagcgaggcatcgttctgttgtcaggggctcagtaatcgccatgaaaaacgggggaaggatttgtgagacattctatatgagtaccgaaggtgatggacaagtaaaaatcaggacggcataaattactcagtatctttcttctccacaattattttcactgtggcatta

SEQ ID NO: 140290 - DNA, 671 bp, Homo sapiens
gaggcggaggttgcagtgaaccaagattgcgccattgcaccccagcctgggtgacagagtgagactcaatctcaaaaaaaaaaaaaaaaaaaaagaaattattttcagggaaaggtaagatgaatgagagccactgacgaacagttgccaagtgttttctgtttgggggcttcatgtaatttccaaagcgaaatgaactttggttcaggtggtgggagctgtggtcagtgtgttctcaatggaaggtgagtgaccttatggctccaagcacctgaccaatctctctgctcctgcctcctggacgtccagggagcaaggatgcagagggtgtgcccaacttctcttggggagagggaccacttttcagaaccctcttcctgtgctctgtggtgggaggcaggggcagaagaaaaggatggatctgcctctgagaagcccatacggagcagacagacgaaggcaccccagcggctggctgagctataaccgtttatgggattgcaaatttccagacagactcttatggtgtgtgatgcagcccacttgtcatctttgcctgtgttttggaagggttcggattcaatgctcctcagccattttttaaagggaggcaccaaatatagaaagtacctggtaggtaggtaccaaacatatgtttgatgaatgagtat

SEQ ID NO: 140291 - DNA, 152 bp, Homo sapiens
ctgatctgcacagctcattctcacctacttcaggtttctgcttaaatgttatctaagtaacctcataccctaacttatttctcgaactgatcaccagctaatgatgcaacacataagactgtgtgtgtttgtgtgtgtaaataaaattaact

SEQ ID NO: 140292 - DNA, 604 bp, Homo sapiens
aatttgacctagagagatcattaagtgatgatgcagagaggcccaaattcacaaagctaatatggctgtggctaaaatctgggaaccattgcacacattttggggttaaaaaaacctttggatgggaaaataaattcaaacttacagaaatactgcaagaagtgtacaaagaactcctgaatcctgccccctcggctttcccaggcgttaacatgcttcacctgtgctccagcactttctttcccacctctccgttttttcctgaactgtttgagaggtatttgcagactttatgcccttttacttttaaatacttcaggatgcatttcctaagagcaaggatgctctcatacacaatcacagtacatttattcaattcaagagatttcacgttgattcactactcttatctattgaatagtccacaatcaatagtccccagttacatagagtttttcagatgtttttgagagtctccgtcgaactagttcgacggagactctaaaagtctgccaaataacaaggtgtagggcatctcacagcagtgcatcacttctggaagactacccacagggtgggggctgccacgggggccaactcgggc

SEQ ID NO: 140293 - DNA, 249 bp, Homo sapiens
aataaaagccgataagatcttgcaaactcgcatttgttggaattttgttctagaaggcagcatggcgccttgtagaccccaaagcgttgttcacagtgtgcaaccagggccaggcgcggtggctcacgcctgtcatcccagcactttgagaggtcgaggccggcagatcacttgagatcaggagttcaagaccagcatgggaacatggtgaaaccccatcgctaccaaaaatacaaaaacaaaaattag

SEQ ID NO: 140294 - DNA, 551 bp, Homo sapiens
gagcaggttgcgactaagtttaagggaagtagagaggctgtgtgcaatgggtcacatctgtaatcccagcaccttggaaggcgaggcaggtggatcacagaggtcaggagttcgagaccagcctggcaagtgtggtgaacacccatctctactgaagatacaaaattagccaggtgtggtggcacgccccatatagtcccagccacttgggaggctgaggcaggagaatggggtgaacctgggtagcggagcttgcactgagccgagatagcgccactgcattccaacctcagcctgaagtagctgggactgtagatgtgagccaccttgcctggctctgttttctctagtacacccacatatatttgaagatagttgtatcttacgagtctttcttttcctgtgctaagcaatcttgattccttctaatatgtctcatgtgacatgggttctgatcctttttcagttctgtatacattcctttggacctatactagtttccttaggcattgtgcttagaatggaatgtagttgtccagttatggcctgac

SEQ ID NO: 140295 - DNA, 439 bp, Homo sapiens
ggggaagaaagaagccagtagtggctcagtaaaagcctcagaagcagagaagccaaaagtgcagccttcagtctgtggccgaaggcctaggagcccctgtagaaccactggtgtaagtacaagagtccaaaggctgaagaacctggagtctgatgtccaagggcaggaggaacgaagggagcatccagcacgggaaaaaaatgaaagccgaacacagcaagccagcttagcccaccttcttctagctgctttgttctactcgctctggcagccattggatggtgcccacccacaccgaggatgggtcttcttcgcccagtccactgagtcaaatgtcagtctcctctggcaacaccgtcacagacacagccagaaacaacactttaccagctatctaggcatccttcaatccaatccggctgacacctaatattaatca

SEQ ID NO: 140296 - DNA, 681 bp, Homo sapiens
accatgttggccaggctggtcttgaactcctgacctcatgatccacctgcctcggcctcccaaagtgttgggattacaggtgtgagccacggggcctggcccgggctcacaatcactttctaatttaacctcagggcttgagctgcggcaggggaccctcaaggggagacgcttcccctgaccagagccctgggctcacaggcagctgcacagctgcacagctacacagcccgggctctgtggaccctggcaggggaggcagcgctggctgggggaggctggcaggggggtgtccacgtcctgtcttcacctgctatgggacgagcgtttgcacaatggctacccttgttcatgaggcttcacgcacagccgttccaagagcggaccagacacagccccgcctcagggcctttgcacacaccgtttcctaactctgtgaccctccttcccgtgcttgctcctctggttccacagctcttggtcccaagggcagctcctcagagcggagcccctggtcactgcctcccagccgcctgttttgttttctcccagctcttcttgctgcctgaatcatctgcgtggctggtttctctccggtctccttggggcagacgctgctgagtcatccccaatatccattttctgtttccttttaataaaataatcggagtcctaaaaaaa

SEQ ID NO: 140297 - DNA, 594 bp, Homo sapiens
atgcaaagacctcataatagccaaaacaattttgaaaaaatgcaaagttggaagatttatactaccagacttcaagagatactataaagctacagcaataaagtattggcataaggataggcatattaatgaatggaacagaatggagagtttaaatgtagatccatagacatgtatggtcaattgattttcgaccaagctactgaggttttccacgaggaaaggttagtcttttcaacaaatgatgctgaaaaagttggatatccatttggaagaaaccccaaaaacccaaaaaaacaaaaagccttaattcttcttacttatcacaacacacagaattcaactcaaaatggatcataggccttgggacaagtaatattatgtgtcaacttgactgggtcacaggtgcccatacatttggtgaaacatcattctgggtgtttctgtgagggtgtttttggatggaattaacatttaacttggtaggctggataaagctgagtgctctccctaatgtgggtgggcctcgtctaatcagttgaaggcctgactagaacgaaaaggctgacattcctttgagtaagagaggattcc

SEQ ID NO: 140298 - DNA, 1092 bp, Homo sapiens
cgccactgcactccagcctggtgacagagctagactccgtctcaaaaagaaaaaaaaggtgtgaagtaggaattagagcctaatacccgaaaaataacctttgaggatattgacggtataatgtctgttctcttctggtatactttacttacctgtaagtttaggtgacagaatccagaaatcagaaaattaaactcccaagaagctagttttaaaatcagtacaatagtatatctctgtttctcctttctctgtctgtttctacatgtgtatttaaaatccgtaattacctattcctttgtatacccaagataaggttaactcccctgccaaaaaaagagttataaaataaaaaaaaaaaaaaaaaaaaaaaaaaaaaaaaaaaaaaaaaaaaaaaaaaaaaccaaaaaaaaaaaaaaaaaaaaaaacaaaaaaaagggggggcgcaaaaaaaatccccacgggggccccacacggcacacaaatgaacaaaggggcccaaaaaggccccaaacaaaaccacaaaacagcggccccgcttcaaacacacggcgaaagggcacaccccgcccccgcgacccactgggaagaacaccacacacacgccgaggacaacaccaacgcgggcaacacacaccaccgcgcaagcaccacaccgcccaggcgaaacacaaaacaaaaacgcagggagaatagcggagaacacccccagcggcaataatcgcggcgcgcaccaacaacgcgacaccgcggactaatacgcgacaaactacgcgaggacgaaaaacacgcccgccgccccctcacgcaccgcaggcagcccgcgcccggacgccgcacggccgggcgaccgacccgcggacgaggcgtcggcgagaagaaggagcggacaggcggcaccaagagaccgcagaaaaagcgctcacaactactgccgcgagcgacgcgaacaagccgagaccgcccccgggaccagcgaaggagccagcacgtgcgaaagccgacacgccgcggcggcggcgagagtcgggagccgcgcgcacacgcgagcccagcgagccgcaaaccacacaacgaggacgcgacagcaca

SEQ ID NO: 140299 - DNA, 535 bp, Homo sapiens
ctatactctcttgatccctactttcaagatgatgaaaatgcagtacatagagcttaagtggtatactcacagttctttagctcataaatggccttatccctcttggggtgggcataggggtgacccatatggttgtacaggttgctcactgcacaaggtgcctgcccaaagtgcaagtggagaccaaaatccagctgtggtgtgcttgccaggtgtgcagcttgtctcacttgcacagggggacacatgggctgacagcagccttgagtgagcagggttaccccccaaccccgccttatcttctaaatgcagatactggacttgtacccacaggaaatgacgctctagttaaggtttctgcaagaagtgagttccatgccttttaacaagagccaccatgcttttgtctctaaagagatgttttccttgtggcaacaaggatttggaggaggggactcatctggggaatgcttaaagggaggcctgaagggaagcttccggaagaccctggtggtgtccccatgctcctacccca

SEQ ID NO: 140300 - DNA, 582 bp, Homo sapiens
ctttccaacctcttatccatcagaatcccaagagggcaaacactagcactgaagatctaaaaagtatattcccaaatgactggaaacagtaccaggctgaaagatcagaacacctagtataaatatgtttaactgcagaggtttaacaactgtagcttttaagagcaaaaatcctgtgagctgcattcaagtaatgtttggtggaatgtacaaaacaagagggaaaatggagtactaattattgaagaacaacagcagtaagagttattcaggaataaaatgtctaatctgatgatccatatagcttatggctttaaagcattttcacacacttctccatttatttcctccaatcaccgcgacatgacgttcacaatctatgaccatcctttaagaaagcatttaaatttatgtaagttcttatcatcatggtctcaccacttgcaccattatttttccatttctctaagtaaagcctgtagcaaaggtacaggagacagaatgttcaaatgaagagtatcgtacagaatatgtatttagtaccacactgtgccaaacccaactggatactgtagtaaaaat

SEQ ID NO: 140301 - DNA, 165 bp, Homo sapiens
tgcgtgagtgtttagcctgtccatgttctcagatgtggggtggatgagtgagctgtgacagtgaccatcagttccctttccccacgtccccttattgaacccttagcatgaatccatccagatatccctgactgaagacacccagcttcccaagcaatgccaggc

SEQ ID NO: 140302 - DNA, 515 bp, Homo sapiens
ttctcagaccacataaactaattaaaatagacatgatgcagtgtgccacatggtcagaaatgtgaagaattcttagggttgacatcgtcaccacagtcaacaggactcacaggaaatgctaagtgctggtcctccttcagccctgtgttacgctgtgtgagtgcctgactctgggcccagggctcagcagcacggtcttcctgtcccaaaggcttattccacaaacacatctgtctcagctcctgcgtggagagaagacagctcctactcttcctactcagttaatgtaaagtaatgaacagtcctagaatgagttcagatagcttggtacacatgtcaataaaagtgtaaataacagactccggactgcattagcactgtggctgttactgatattttctacacactttacttggcaaaatcgaaaacctgaagacaggtttggttttgtgccagctggctcacactctaaattggcattagaaggtgtatgtcactatagaaaaatgactgtc

SEQ ID NO: 140303 - DNA, 421 bp, Homo sapiens
catgagatactgagtaagcatttattaaattgagttgaaagatttgaatatattaccagaaaatttttggaaggccaaaaatctcatatcagaatgaccagtatatacttattaatggaagctcaggaattcctgaagaatagcttttctgttggtaaatatgtactaactggttgagtaatatatgctaatgtaatttaaaaaattatgtgattgtgaaggcaggaaagcgatggattgtttcaggccaggcccactgcttgctgtactttaatgtcattgctgcttatcgccttctctgcagccttgttgacactcctgacaacaagtgtttgtctttggcttctagggcactgtttcctgttcctttacctttcttgttggttcttctggcatctgcccttaatcctttatcctacaa

SEQ ID NO: 140304 - DNA, 310 bp, Homo sapiens
gttctttttatggcaattatagttgttcatgtcttgcaagtcatagccctctgacctgcaacaaaacctattttagctcttctggctgggcacagtggctcatgcctgtaatcccagcactttgggaggctgaggtgggtggatcacctgaggtcaggagtttgagaccagcctgcccaacatggggttttggtgaaacctgtttgtactaaaaatacaaaaattagccaggcgtggtagtgcacgctatagtcccagctacttgggaggctgaagcaggaggattccttgaacctgggaggcagaggtt

SEQ ID NO: 140305 - DNA, 300 bp, Homo sapiens
taagggatcttgatttttccttgaatcaaattgtataggttattcatgaggcacatgggagaagatgggccattttatctatggggaatgtaagacatagagcagtagagatttgctcagcacaagttccttgaggacaggagacatgactgtctcttctataccctcatggtccttagtcaagtgcaggatgcccagagaatcgtaagtgcttgatgcatagttaagtagagtgaggcagtcctggaaaatggataagctgggtggctttggcctgtttttatatatttttaaaactct

SEQ ID NO: 140306 - DNA, 274 bp, Homo sapiens
accagaaaactgctagatcttttacatcttttatcaatccttagagacttagcaaaaatccctatgaatctactatacaccaagaatataaagataggccaggcacagtggctcacgcctgtaatcccagcactttgggaggccgaggcaggcagatcacgaggtcaggagttggagaccagctgaccaatgtggaaaaaccccaactctactaacaatacagaaattagctgggtgtggtggcgggcgcctgtaatcccagctactcaggagg

SEQ ID NO: 140307 - DNA, 492 bp, Homo sapiens
cttggatattgaacagtaattatgtaagatgttaacatgtggggaaacctggggaagggtgtgtagaacctctctgcactattttttttttgcagcttcctgttattctataattattttaaaagtaagagctcagtacaaaaaaggaatgaacttctattgatacatgcacaaatctgcatgaacctcaaaggcattatgctgagtaaaaaaataaaatagcctatcttaaaaggttacagactgtttgaatgcatttatatggcattctcaaaaagacaacactacagtgatggagaacagatcagtgcttgctaggtgtgggggagaaaggaagatgtgattgcaaaaggatagcacaaggagatttgaggggttatggaactcctctctgtcatgaatctatacatatgtttaaaatcagatctgcacatgcacaaatgtcaattttactgcagaataaaatttaaaataaaagtagataggcaaggc

SEQ ID NO: 140308 - DNA, 310 bp, Homo sapiens
ctaggaatgaaaaagcataaaaacaaagcagaattataagagggaagattttattcataaaatgaattaatcagcatgtagtggtatgtgcattatgtgcaagcatggcttggggagaaaaagaaatcttgtccaaacttcagctccactgcttatgccctgggtggccttgaatgaatttcttagcctctcagtgttctctgttttctaacacttaagatgaggctaataactacctagcagtgttgttgtgaagattagataaagtacgttataccattatcacataatagacaccagataaaaggtt

SEQ ID NO: 140309 - DNA, 233 bp, Homo sapiens
ctccgtggcatatcttctttccctggagagaagagcagtaaataaaaatgacaatgacaattatttttgcaagagtttcctgaacaaaaggataagagtgaaatgtttgttagtaaacttcagctccatggtgagaagatgttattagcagaagctgattaaaaaacaaaattttgataattttaaaaggtaaatcatttaagatccttcacgctgtagtataacataggcaa

SEQ ID NO: 140310 - DNA, 299 bp, Homo sapiens
agtttacatccttagggtgttttcctgcaagaggcagcacagagtaggggcccatagtgcaggattcctgagcctgatgccagcaccacctctcacgtgtggtgccgggaacccaggggataggcaggggcaaagtgtggcctttgcgttgagacacagagggccatcccaacccatgactggtgacagcaggctagacagaagctgctgggaggcagagatcaggagtagcagatatgccctacatggtgctatgagagcctataatgggggaatagtcctggagttgggatgctttt

SEQ ID NO: 140311 - DNA, 252 bp, Homo sapiens
agtctctacttttttattcactacaaaaaaggttgatgctaatgatgcagtaatgaagacaaggaacaatgagggaaatgcttccaaggttaggaggaattttcagagtatggaaatgggctcctggaaggatatacggtacacctagccagagcagatgacttagaggaaaggaagacaaaggtacagctgcattggtcagacagaaggggctgtactggaatataggaagttttaggagggcaaatacct

SEQ ID NO: 140312 - DNA, 566 bp, Homo sapiens
ggagtgaggaggtgtgatacgcctcccctgtgcccatcatcaactccagcccctgctgtctcccatctgtgcagttctgtctttgctcccaccagtacccccttgcatgatgctgaagccccaatttaaaaaacagttttcacatcagaaggatttttgtttgtttgtttgtttttgagacatggtcttgccctgttgcccaggctggagtgtagtggcatgatcagagcgcactgttgcttcgaccttccaggaccaagtgctccttccacctcagtctcccaagtagatgggaccacaggcatgtactaccatgcccagccaattttttttttttttttttttgagatggagtttcgctcttgttccccaggctggagtgcaatggcgtgatctcggctcactgcaacctccgcctcttgggttcaagcgattctcctggctcagcctcccgagtggctgggattacaggcatgtgccaccacacctggctaattttgtatttttagtagagacggggtttctccatgttggtcaggctggtctcaaactcccgacctcaggtg

SEQ ID NO: 140313 - DNA, 168 bp, Homo sapiens
ccctctgagttcaagttccccatgtcttacatataatcttgaatatcagctcctcaggatgatgataaagatctaagcggtcttgtatttggaaaagacaagagaaggaggggccactgtaaacggggaatgagaagccattatctatttatgtccaaggctaaattg

SEQ ID NO: 140314 - DNA, 498 bp, Homo sapiens
tgggagtagtaatataatcgaggaaatgatttaaaatagaccgtcagatttgagtagggcaatcgtgatatcactatgcatcgttatctactcagagcataaggcatacactaggatgatggtattatcacgggttcaggaaacaatcccccatggatactgagggatgactgtatttgttttgtcaggtaccatccatctagcttttgtgctctgcgtttttaaacatgcactccaaagtaagttgcagacattggtgtatgtcacctctgaagaattcagcattaaaatccttaattttatttattattaactctttattttaatccttttttacattttaaaatgtgtattatttttatcatcaggcctaccacagtgctgctacagatatacttaatatttgaattgaaatctcttaaaatttttaaattttactttttttttaaatttccgtagcctttttactttgtgcatttgagtctaagtttactgcac

SEQ ID NO: 140315 - DNA, 442 bp, Homo sapiens
gcctatagtcccagctacccaggaggctgaggcaggaggatcgcttgagcccagaagacggagactgaagtgagccgagatcacgccactgcactctaccctgggcaacagagcgagaccctgtctccaagaaaaaaaataaaataaaaatgtactttgcattgagagaatttaaggaaattcaatgtaaaaaagtaattcagaatttactatgggaaaaggcatttttctcaggagtttccatccagcttggaattcatctcataatgtgaatgaagtgtgaaaatacctctgattccctgaggttgcagaacactgcacacactctctcttacgttctactgaaataatcaggtgagaggatttccagaaataatttattactgaaatgctgagtttatgtggttcttaggggaagctgcttttatgctaagcaatttca

SEQ ID NO: 140316 - DNA, 549 bp, Homo sapiens
tgacttgttatgtagcaatagataagcagaacaggtggagatgaaaggcttctctggacaatctgatttcaacaggaatgcatgctaaatgctgcaaagaaagtaagttcaaccagttgcaatatgatgcaaatgaaattctgactctagtaaaggcaaaatccagctaccctgactttcctatcgcagaggatttgtttgatgcagataatcttacatacacaggtatttttcttaactttcgctgcctgcaaaaatgtacataaataagattgagttctgtgagccatttccaagtacctggaatggaggtctccatttcaggtacttggaaatggctcactgaactcatagatggtttcgtgatgatgttggctcagggacacccggaagcagggtctatagactgtgcggggatgagggcagattgagaggctggtgagagatgtgctgggaaagagagccagcagttattcccgtggggtgtggagtgtgtgccctcacagcgggtgatgaaaagaatacaggagagtgttgtccaggccccat

SEQ ID NO: 140317 - DNA, 151 bp, Homo sapiens
tatgtgtgtgtgtctgtgtgattaagtccttccctccttagctttaaaagaaaaatatcatattataaattccaatactgccaatatttgcaacaaaggtttaattttgtttgcagccattctattttataattattgataggttcatgtg

SEQ ID NO: 140318 - DNA, 754 bp, Homo sapiens
tgacagcactgtgaggcccgtgcttgttatttccgttttatagatgaggagactgaggtacaaaggcagtaacttgctgaggtcgcgtatctggtcagtggctggttcattggaccccaggctacctaccaggtatatgacctagtctgccaacttaattttctatatgtccaaaagatgtgcttttttaaaaaataaaaaattttttttagagatgggggtctttctgtgttgcccaggctggtctcgaactcctgggctgaagcagtcctcccacctcagcctcccagagtgctaagattacagacatgagccactgcacctggactgtgcttttctaacggctttactttatggctgtcagattttcctgccaattagagttcagcaaaataaaggattgtgttaaattgcaaaccatcatatggtccatgctgactaaccatgtgagtatgagtctgtattttgttggatttttctcagctgtaatcacaattttgctggttttacttagaagcatttataatgcgatcattattccagctttttttcttgagtattttcagtttggggtttggaaaataatttttttcctggaagcaagcacatgataaatgcctttagaccttgaaggtggcttttctcatctcaatttttgggtggatgttctttcttctcccttttggaacaggaaaggtctcagctagaataattagaaaggtagggttataatttataaaacctgtaagagaca

SEQ ID NO: 140319 - DNA, 324 bp, Homo sapiens
gctgggattaaagacgtgagccccacagcaccctgcccagatgtgagaaacgttgaattctaaaattgctggcaggccaggtgtggtgagagtcctggtgacagcaacctgtgaggattgttacctgtgtgtaaggataggcatgccatcatcccttcctccccttcctccacacttgtgctcagcctcccgagtagctggttctatgagcagccaccaccacacccagctaatttttgtattttttgtagagaacggttcaccatgttgctcaggctggtctcaaaaactcctgagctgaagcaatccatccacctgtgtcgg

SEQ ID NO: 140320 - DNA, 387 bp, Homo sapiens
ttttgagacagagtttcgctctgttgcccaggctggagtgcagtggcagctgacagtcaacctcagtatctgggaggcaataggaaagcgtggcgactctggtaatttgaaaagcacataacctgtatagaagcagaagccactatgaacgccaaccatctgtttttcagaagtgtggatccaagtctttgaagagaaaccagaagtccagattcctatgtgtaatctgtcaatttttaaatatggactattagcttaaaagaagtcatcgggtcaccactttgctaccccactttacgaaccagaagcaatctgactggggatagaactgttctggaagtcagggagccaagactgttaaagccagctgacaccaacctattttct

SEQ ID NO: 140321 - DNA, 346 bp, Homo sapiens
gaatttggagggaagctgattcttcaagcatctgccatttccgcagcctctctctttgaaaagacagtttcctctggggctaaagacagctggtggcaatttcaggtcacagaactctgtcctcttgcctttccttctcctccatggcctctcctctgtcccccttagccagaaacctctggagggagtgttgattacgggccacctatccacactcacggactgtggggtggagaagggaataatcctcctagaacttctagaatgaccctggatcttcatgaggccctggccttggccaggtccagccacttgcctgtggggtgttggggttctccctggactg

SEQ ID NO: 140322 - DNA, 511 bp, Homo sapiens
aaatccttatcattttctgttataaaacagacctatatttgcaaataatgcaagtgaaggtgctttaatcttgtattatatctgtttatggcttttatcctaaattaattcatgctttttaaagtaatatgtaaatgtgaaattacacaagtgcaatctaattttaatgctaattaatcttctatccaacacattcttatttactagctagttaaatttgccacaaactttggataacaaataacgggatcattaaatagtttattttggaaattttgatcttttcaagtatctctcttttctaccaatttctacaattgtgtcttgtaccacaagatacaatttttttcctgaagtagaataactgtgcttccaataaggaaaatatttgagtattaaataaatatttctaaaagatatattacgataggcaacattaatagatagacaattaaggtcaattaatattgtaatgatattggaaataaattttcagcaggtacaagacttt

SEQ ID NO: 140323 - DNA, 134 bp, Homo sapiens
gaaacacacagggaagaaaaatacctggaaaccataaccgctgcttttagtttccagagattttgaagcctctttctctttgtttttcctctaaaccagttacaattagaattgagggatataattacgttgtt

SEQ ID NO: 140324 - DNA, 418 bp, Homo sapiens
gggcttagtactgatgagaacagcacattattactgcaagtaggcaaatgtgtcacttaaaattctctgcctgtagtctgatcatatgtgctagttttacactggaaaatagtaatcaagaattgagaattaaatgccagagatctttcaagcaagggggagcccagtctatcctcacacactccccagttattgttctgtacggtctagacctataacctctccagcgcttcaactccgtctctgatattcctgcagaggagatctcaaagaggagctttttaatattgtaacttgccatttcttctgtaatcgcttcttttcttctctcttggcaccagttcctattagaatgcccttctctttgaaaatgagagatggggctgggtgcgtgtggctcacgcctgtaataccagca

SEQ ID NO: 140325 - DNA, 132 bp, Homo sapiens
gcagttgattctgatgtgcctgtatgttagatggtagtgattacaggatctgtttcctaaggcttttggtgggaatgagctagcagtcggcacttagggctcaataaaaattagttaaagcaaattgctacc

SEQ ID NO: 140326 - DNA, 314 bp, Homo sapiens
tcaaacctattgatcggaagtcagtccatcagatttgctctgggcaggtggtactgagtctaagcactggatgaagaagatagtagaaaacagtctggatgctggtgccactaatgttgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagg

SEQ ID NO: 140327 - DNA, 301 bp, Homo sapiens
tcagggagaggaaggtggtataccatgtagtcacagcaattactacacactgggcacctagtatgtgccaaatgctttgctatgccttatatacattattatgtttagttatcacaaccttgtaagataagtaccatatctatattcagatgatgaaactgaggcttagagtacataaccacttgcatctggataacaggatttgaatctgcctgtttctgacgctcatgctattaaccactaacttaggttacacaaagtaaacaagcaacttagtggcacctgacagctgaaaatgatc

SEQ ID NO: 140328 - DNA, 432 bp, Homo sapiens
ggatactcttcaattaaactgatcacaacatgagaaaagagtaataggaaattttattctgcaacagaatcacaggcacctatagcctgcagtttttattattaatataaaatgtcagcaaccagagtataataatcctcctaactatgcatgtacctttcacattttattgcaaaactattaggctataataagaacatgcatcaagcagggacaccaatatcttgcctggcatttaattatcaaaaacacctgtgctacaatagtatattcacgtgtataattctttatatgtagacatttaagtgcttgaattatttaaaaaatctactgtctggataaaacttccataaccaatgacaaatgtcaaagctgctcttaaatgagcacagcaaagtcaaatgatataaacaataactagcaaagtcaaca

SEQ ID NO: 140329 - DNA, 418 bp, Homo sapiens
ctccaaaatattgataagactttcaagaacaactgcattcctgcagagaccatctggaaagaactagagaaaagcagaagagaaagagctccgttttgacagagctcagaaactatcaaaagatatatttcttgatggtgaaaggcaaaaactaatactcattttttcaatactcactgtggaaatagatgaactaggtgacagcagaactatctggatccaggatggttcaggaaacaatgagagtgggtctccatgaagaatcatacgaaacatctatatttctggattttttaaagtttttttttttttttgtaacaactgaacacaattaaaatgggctttttgatagaaaaaaatatttgctaaaagtgtccacaggaaaaatatgtaataagggcagagtgatttccatata

SEQ ID NO: 140330 - DNA, 828 bp, Homo sapiens
tggaaaatagcaggaactggtctggattctgtgtctggaaaaaagtattaaaaacaaacaaacaacagacaaaccagtagccagaaaaggataaaggaaacggtaccttagaagagaagcatgaagacatttttaaaaaggcttttataatgaggcagaagatttaaagtgttacataaaacaagttttagggaatgaggaggaccaatgtggcataaaaggtttttatggttaggctggaggtggagcaaggtggccaaacagaagcctccaccaaccatcctcctcacaagaacaccaaatttgacaacgatctacaccaaaaaagcaccttcgtgggcactaaaaatcaggtgagcgatcacagtacctggttttaacttcatattaccgaaagaagcactgcagagggtaggaaagacagtcttgatcactgactccatccctgtggcggtggccacatggtgctcagagagaacctgtgtgacggggaaaggagagtgcagcagttgtgggactttgcattggaactcattgctgccagcagtgggtagaactcagccgatgcccacggagggagcatttagaccagcctagacagaggagaatcacccatctcagcagtcagaacttgagttccagcaagccttgttaccataggttaaagtgttctgggttctaaataaaccaggccacaaggactgcaacacccaggtgagtcctagtgctgtgctgggctcagagccagtggacttgggggttacatgacctaatgagacaccagccagggtggctcagggagcacttgcatcccctatcccccaaacc

SEQ ID NO: 140331 - DNA, 550 bp, Homo sapiens
atgagagaccagcttagagatagaaaagattgagaagactaaacattacacaataggaagtccaagaaagaatggaggagatagtgtaaaaacttaatcctgagaattttccagaattgaagaaacccatgaatttttacttcagctaataagcagggtaaataaaaataaatctagacctcaaaacatgatagtgaaactacacaacatcaaggatgaaataaccttaaaaactacagagaagacaaactacaaaagaatagtctgacagcagacactcttagctagataggtaagccaaaagatagtgggggaaatatttttcaagtgttgaaggaatataattctacctagaattttatacccaaacacaatgtcattcaagagtaaaataattttcaggcacacgaaaacagcttattgtctgtagaatttagcaaatgtattattaacagacatatatatatgttatatatatatttcagcagaaagaaaagtgaaaacagaaggaaagtgtggaatatgagaaacagtagtgaacaaaaaaata

SEQ ID NO: 140332 - DNA, 308 bp, Homo sapiens
cctgttacccatatggctgctaccactgcatcctgttaaataatgtcttcaacccaagaaacctgcttcctagggaagtttctctctctctgcatttgttcccactagagaatgaccatcaccagattcctgaactgaaaatgctgttgacactttggaaactcgggcctctattaatagggtgaccaactatcctggtttaccttgagtacaggattttcaatgctaaaaccagaaaaaccaggatggttggtcatctgcctcagacctaataaataccagtcaataattcagccatgagctttctt

SEQ ID NO: 140333 - DNA, 291 bp, Homo sapiens
tccaacttccaatctcatcttctccaatctctcatccaccactaacctaaactcagatttgatcatgttattcccttaattataactcttcattcattccaaatgcactcctttgtttcttcttccatgccctttcttggcttagcctcattttgtcagtttgccaagcttctagtactcttcctatggccagttcctagggcctctatgaagccttccctgaccactcgatgagagcccttcctgctttcatttggtgctcctgggcctggttcttctcttgcagtgctc

SEQ ID NO: 140334 - DNA, 354 bp, Homo sapiens
ctggtagcatttatttgatgaggttcattttagagattgctatgcatgggagctctacacatctcctattcatgtaggagattagttggagcattaaagtctcttatgagcaagaattaaatcaggtgtcataaaatctttccatgggccagtgaaagatcggaagttgctcaagatggaaccaattggaaatgtgctccgaacaacccaggggcagcacagctcgtggttgccaggaggagatgctggttcagtttcatggaccttctgttttcttaagacaacatggaaattcaaaactttttaaatgtgaaaattttcaatctcaaatgttagtgactaattaaaattttc

SEQ ID NO: 140335 - DNA, 278 bp, Homo sapiens
ttgcatttctcaattgcatcggagaaactcctaaattgcatcagtgatcctgaagctgttaaagtaaagaattttctgtagaagaaagaaaagagaaagagaaagaaaaggcaaaaacttaatcatgcctgggatcttttgaggtagaaaaaactgacaagaaacaaactttccttatattctagtgtgttggaaaacagtggaaggactgtttgccaaattgtcttagcggttctcaaagatggctggccaaatcataagagaatacgcttaggttc

SEQ ID NO: 140336 - DNA, 378 bp, Homo sapiens
aggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagc

SEQ ID NO: 140337 - DNA, 517 bp, Homo sapiens
agcatcctgtgaccgagagggacaccacggctggagatggtgggatggaggatcccccacagcatcctcgatgctcagaacatctcattttgcacaaaaaagctccaaattctcttgagggctgaagccattcagagttggggtttctgtctctcaggccaaaagcatcctgtcggagcagctgagagcacagcgggaggggaggggcaggagggaacagccccgccacggcgacaggggattctctgactccaagagggcctgcagacaccactacccacccccagccctgaactgtcccctgccaaggggccagaaattcctgggagggggaccacagggggcctcgctcatgagaacagtgactgtggtcaggccacagctcacaagtcagcaactctgctcagccgccgcggtggtcccctcttgatggcttccagaaaaagcgttccaccttctgtcatcagtgtcctgaaatccaagaatattctccaaacagcaactgcagcaaaagcta

SEQ ID NO: 140338 - DNA, 2865 bp, Homo sapiens
attttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacatagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaaaagaaaaaccctcacagtcttcctggttcataagatggatttggaggttatttctgcagcaaacttgggtcctgtgtgttcaaaaccatagagcacaaggtcaaggaagctagagtctgaaaaacgaacaattcacttccaggtcttcatcagggttttgtttttgttgctttaaagcaagagttaagtttatagtctgttaagctcttacaaatttggcttattagttaaatggacgtagtttagcttaaactttatgttagagtgagatgaaaccctatgaatataatcagttttagaaaaactaatcagtttattgtgcatcagagacgtcacatgaagaagaaaacttgtcgacatccaggatgatcaggagccttcattaaaacagaaattttagggaaaaccacaaaaaccttcgtaaagtgaattgcattaaacatcaattataataaaatttcatattttgaataaatg

SEQ ID NO: 140339 - DNA, 2479 bp, Homo sapiens
attttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacatagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaattcacttgccgccgattacaacgtttcgactgtgccttggcgttccccaattttggcttgagcacatccccttttgccagttggcgttgct

SEQ ID NO: 140340 - DNA, 3078 bp, Homo sapiens
attttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacatagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaaaagaaaaaccctcacagtcttcctggttcataagatggatttggaggttatttctgcagcaaacttgggtcctgtgtgttcaaaaccatagagcacaaggtcaaggaagctagagtctgaaaaacgaacaattcacttccaggtcttcatcagggttttgtttttgttgctttaaagcaagagttaagtttatagtctgttaagctcttacaaatttggcttattagttaaatggacgtagtttagcttaaactttatgttagagtgagatgaaaccctatgaatataatcagttttagaaaaactaatcagtttattgtgcatcagagacgtcacatgaagaagaaaacttgtcgacatccaggatgatcaggagccttcattaaaacagaaattttagggaaaaccacaaaaaccttcgtaaagtgaattgcattaaacatcaattataataaaatttcatattttgaataaatgacatttttcctaggtatttttttctgaggaaatatgtcagttttagaattggagataaaatattcacctagaactgatgtaccaagcttctgttttgtaatatcaaaaattttatagaacatatataagaaaatatttacctatagaaaaactcactgtagaatgtgaagttaaaaatggaataatttgaattctgtggagaatgtgaataaa

SEQ ID NO: 140341 - DNA, 275 bp, Homo sapiens
aagtatagatgtacacctaaaagtttcttgagtccttgttgaaagaagacttatagggagggtcaaatcaccaggcatctctgagtctcgagaagagccatagaactaactgtactcttttctttccagagattgcagtatgggtggaaacagcttgaaatttttaacagggtaatattgataagtgtctcattaagaagacaaaatttcaccaaagattggacaaagctaaggcagtgatccacgcagacatctgtgggaagagtactgcatac

SEQ ID NO: 140342 - DNA, 253 bp, Homo sapiens
ctagcagggggcactccaggtacacgtctggtgtctgtggtgaagaagacagtgcagactgctttctttctccccacgtctggtcttactcttaggctctcctgtaggtgaataaacagcatttcaagaaaagagcgtaactcattcaggcaatccagttacaaaattgggccagaaattccagcaacagatgcagacaagacaagatagtcattgttccgtttgcaggaattacttacagaaaatcacttga

SEQ ID NO: 140343 - DNA, 388 bp, Homo sapiens
agatccgaggtaaagtgggaccacccccagcacccagaagctacccgataacttcagatattagtatttgcttggcttgagcacagtctcaactaaaagtcaggtacacctgtcctcagaccatgggctttttgaaccttaatgcaggatttcacatcagtcatgatgggtacccaggaaatactcattgaatgaaatcaccaaagaccaagaagcagcagctaaaatgtagaggtgagaggataaagaagaaagaaaggagaaacagtggaggatgtacaaagagaagggggtaggaagaggatccctttagccttgcttgaaatcttgctagagttgggaggggagggacaaaagctgctgggaaacagctaaaaacggaacgaat

SEQ ID NO: 140344 - DNA, 539 bp, Homo sapiens
  misc_feature (25)..(25): n is a, c, g, or t
ccatcagcaaggttctctcactttngtactcattagcaatgaatgaaatagctcatttcacttgtttgctgaatgttttatattcataattattaaacttcttaattgggcatggcactactattatctccattttatagatgtggaaaattgaggctcatgttaaatcatttttccaaggtcacatgttaagtcacaaagaagagcctggaatccaagataataaggctttttccaccacagctgacttttcaggtggaggcctttctacacttcactaaggttgctgaaaagagggtgtgggtgctactagcagagagatgttgggggcagggagagcactggagcagcctgggtcactcaggtcctcacagccaacttcagtccatagatcaaaagagcggcacaggccatgtggggtggctcatgcctgtaatcccagcactttgagaggccgaggcaggtggatcacttgaggtccaggagtttgagaccagcctggccaacagggtgaaaccccatctctactaaaaatacaa

SEQ ID NO: 140345 - DNA, 282 bp, Homo sapiens
atgcttaagaaataaagtataaaaagcttatttaaaatcaaagagcaagagaacgatagtgaactctttgaacaaaactgcagaatgaaaacatcattctccaattaactcaataccttagagagtatattgtgtgcctgtgtgccatatttaaattagctttacttgtaaaatcactatatgccacaattcaaaatgcagctgagaaatcactctttttgcagtacagacgataacctaattccaactatttttatctactttgtaattcaagtgatgcat

SEQ ID NO: 140346 - DNA, 358 bp, Homo sapiens
cgatccccctggcttgctcaggtctccaagtagctggaactacaggtgtgtgccatcacacccggctaatttttgtatttttagtagagacagggtttcaccgtgttggccaggctactctcaaactcctgacctctggtgatccgcctgcctcagcctccggaagtgctgggattacaggcatgagccaccacaccaggctccctcccctttctcttgtaaaaacactagttattggatttagggcccatccttagttaaggatcatctccaggtccttaattaaataccgctgcaaagaccctatttccatcaagtgtaaggcttgctctgtcatgagaactgagtcattgattga

SEQ ID NO: 140347 - DNA, 884 bp, Homo sapiens
ctggggaggccccagggtatcactaattagcagcgctgcaggaagtttgagcaagtttaatcatatctttaagcgaagtcttctggtagtgctagactactcttttctgtacctgctgatttttttttagaaacggaggctgatgacaccttttgagtacttactgtataccattctttctgccaaaaaagtctcgtgtattgtttcttgatcctatgaaggtagacacaattatccctgttttgcatttcaggaaaccaaaagcttaaagaggccataccctcaactttttcaatttagcaccaagctaatctgagagtgcttgaaggcttctctgatgagcccagagaaagacaagaggaagctgacattaaggatgaggttgatttcatttcctatgtgatacacggagtttaagatacagttgtgggccaggcacggtggctcacgcctataatcccagcattttgggaggtcgaggcgggcagatcagttgaggtcaggagtccgagaccagcctggccaacatggtgaaactccttctcttacttaaaaataacaaaaaatttagctgggtgtggtgacaacacgcctgttatcccagctactcgggaggctggggcaggagaatcgcttgaaactgcgagcgggaggttgcagtgagccgaaattgtgccactgcaactccatctggtgacgagcgagatccctccaaacaatagaacaacaaaaaagttttcggcgctcccccaaagatttaaacactgttgcggcgcgccaaatatagaaacgggcaacgctcacaaactcggcaacacaggggtttccaacaaacgcgggcgcgtctcacacaatggtgggtgtacagcccaacacaacaccgc

SEQ ID NO: 140348 - DNA, 452 bp, Homo sapiens
cctgggaacagtgagtcacagatggaaagaatctagacctctgaaagctgccctaccccctgattggactgagacgggagcgagaagtaagcccgctcttgcatgaagctgctgagatccaggactcattcatgatggcagttagcccaggctgaccactggggcttattcaaggaaaacagagtcccactcagcccctaccacaaccctgttaaacatgaatgggaggatgaataggtgacttcttttttttttcctcacctcatgtctcagaccacaaggccactgctcacatgaacaggtgccttccatttcccagtgtcggtaaccagaggcaatgaaagacacctgaggaagacataacactgtccccaaggcagcagagcctttaataatgataactgatgctcacagagccactctcctacctttcttcaaaaagaaaaggtatc

SEQ ID NO: 140349 - DNA, 357 bp, Homo sapiens
tgaaatatttttaattacaatccacaatagaaaatatattttctgttgtgattcaggataataccctctagtgtgatctattttatcctattctatttatttcagtaaagaatgttggtcacaatccaataaattgattatataatatgctaaccaattatgactttcagtttgaaaaacactggataagaaaacctattaaagtttctcctactgcaatgtgattatgattccatgatatggtggagtgtggaatcatgaattgttcatgccatatcaaaacaagtttgaactttgaagtagagtgagggcagtgatctcttgctctttcctactctgcacccctgaatctgattt

SEQ ID NO: 140350 - DNA, 671 bp, Homo sapiens
ccagcccagccaatgcttgttgaaggctcagtggcaggcctgttagtagcttccagacgcactctgggcttgcctccatctagtgtgtaggaagggcttgtgctgactggctcgtggaggaagcctgtcaaggaggcttggtggcctgatgtttcccacaaacactgtgttaggcagataatgaagttttcgcttccatcggtgtcctctctggccacgttaggtgaggggtttgctttagctttgggtatcctcttcccttggatacccagagatggtcattagtaataattttgtgtcttggctggagatggaaacaattagccaacagaagagaccagtcttctagagttgcaatctggaggacatcttttgctttgaaaagatacaattaagaatctgcaaacgatccgcactaatatccgtggtctttctgttcattaagattaaagtcatgtttttcagggaacgaatactcacacccctcccagattggtaatcagcttttattttccttgtcgggtggggtggggggatttccggggaaatagtttccaagccaaatctgaagggaggtactttttatggtttttcttggcaagtgctgcttggtggccaccagatgggtatctaaatgaccacaatgaaagccctggaatctgttttctcaa

SEQ ID NO: 140351 - DNA, 200 bp, Homo sapiens
agagtgaacattcttaatcactattcttcccagtggaaagtcataaaagtcacaagagaccaacttaaatcagtccaaaaatcctcctacttctgtttctgcctgttacatttcatctggttcaaactttgttcaaatattcttaacattctttatctcagtctacataatattatttcctatgttgcagtgtgcttccg

SEQ ID NO: 140352 - DNA, 306 bp, Homo sapiens
tagcggccagatttctatgcaaatgggccaactaccttttcctgagggaagactctgtcttattctagctccagagtcacacatacgcatgtttcagtctccctgcacacttcattcccctcatatttctgcctctcaagttctctaggtagactaaatcttttcacttgttcaatgatcaataattgaataatttaaacctttaaaatatggtgggtcctgcagtgactacagagtgaagaatctagtgtcattgccaacagtcacagggaggactttcctttctctcatagaaaatcttgggcc

SEQ ID NO: 140353 - DNA, 469 bp, Homo sapiens
acgtcatcgatccatccacccacccacgcaataaccatgtattgaatattgtctatatgctgggactagggaggacaggcataaataggactcagccctgtctttgagctcacagtcttgagtgggagtgtgcaatggggtgtgtacagaaccgtgagggagttcaggactcaagggcacagggtactttctatgccttagggcagtggtattccaagtgtggcattagcatcccttgggaccttgttgaaaatgtagattctcaggttctactggatgtcctgaaacagagactccaaggatgggggccagcagtctgggtcttacaaagctctccagggcattctggtgcatactcaagctttaggactactgcattagggggtttgcaaaggcttcactgaagaggtgacattcaagttagccattggagaatgagaaggaatttcttaggagggagagggcttcc

SEQ ID NO: 140354 - DNA, 221 bp, Homo sapiens
gtagcctctatttaaattccagctggtccaccatttagctggtgacttaagggagctcaagctcgataacatctgtttactcctttgtaaaatggaactaatgggagtatgtactaagtttgtaggaaatatagataatttctgtaaagtgcttggtaaagagtaagtagtgaaaatatatcagcccttctttatttctcattatgatgttcaactgagat

SEQ ID NO: 140355 - DNA, 219 bp, Homo sapiens
gtcccgggaaagccagtggtgtgattcagccttgagtcccaaggctgagaaccaggggagctgaaggtgtaactctcagtctgaggccaaaagccggagaacctggagctctgatgcgcaggagaagatgagtgtcccagctccagaacaggtggattcggtcttcctccacctgtttgctctatccaggccctccgtggattggatggtgcccactca

SEQ ID NO: 140356 - DNA, 367 bp, Homo sapiens
gtcaccctgtatctccttacctggtttgttctctcactttactaattcatttttttagtctttttttagtatttatcacccttgacatattatatatcagttcatttactatctgccttccccagcagaacataaactctatgacaacagacactttgcctgttctgttcactgctgaattcccaagtactgagaattcttcagcacagagtggcaggcactcaacatttgttgaaaaaatgaaacactgtcctttcttctttctgcattaccaaacctctccttgaactggctccctccccaatgacatttaaacaagttcaagtctcttctaccttaaaaaaaagaaaaaacaaaatacttttaa

SEQ ID NO: 140357 - DNA, 452 bp, Homo sapiens
ccccacctggcccaactcacttttccatccttatctgcctccacctgctacccagctgcctgactcttccatttctttgctcaggccttagtgtccctggaatgctcaaaatgctacccatcccgccaggtactggtgccgcctctaccaggaagccttccccagtgccccaccatcacctcctctaggccacaatgccatagacctctccacagaggatgtcatgtccacttttggtaacagctccctgttcctatggggaaccagccctgcaggggtggactcacaactagcgtatatggaggaatgggtgtgagactcaggtggtcctgtgaaattcacttccaggacttttgttgggactgtgggaaagtgttctcattcacttggcagtaggtgtgagctacgagccactggggccatctttgccacagtggcagtcagcctccagt

SEQ ID NO: 140358 - DNA, 382 bp, Homo sapiens
taaaagatcagagtaacctaattgcccttatgtagtaaattggttgaagaagtgatgatacatgacttccaaaatggggaagagctcctctgaactgatagggagtaaattcttggatatattaagtgaaaagagccaagtgcaaagagtgtttttaaaagtgagaaattatgagcatatgcatatctgtttcttctttttttcttttcccacaaagtaatacagggttaataaaccagaaactaatgagattggttagctgtgaggttatatgtgggatttggctggaaggctatggaaaggagaggcatgccctttctgaatagttttgcacttttggagcatgttagtgtttaaatactcaaagaaaggaattaaatca

SEQ ID NO: 140359 - DNA, 397 bp, Homo sapiens
ctggcagatcacttgaagtcaggagtttgagaccagcctggccaatatggtgaaaccctgtctctactaaaaatacaaaagtgagccaggtgtggtggcatgcccctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatc

SEQ ID NO: 140360 - DNA, 500 bp, Homo sapiens
acagagaacatctggagttttgggctgccagcctgtgctgggctgtctgagttacagaacaggagatgtgtgctggactgggactgggagaattgctgagaaagaagaatgtgaggagagcctgggctccagtgcgtttgagttaacaaatcctatccttctccactgaactctttcaggacagtataaaaaagtttaatggcaaacttcactaagcaagaggatgggggacctggctgggaacattttccttatgctgggggagaggctgcactctatgctgttaggcagaaaaaaccaggcactgtaggctagaggggagtcaaaacatcccctacactcaacccacacctccagacaacaggcctgtgctcgactggtggtgagggcctctcttggaattcagttcttggccagaaatccctgccttagactggggaaggtttgagagaagctcagcaaacctggcggctgctctttgggtttggcaaactcgagat

SEQ ID NO: 140361 - DNA, 556 bp, Homo sapiens
ggctagctcagcaaatttatagtgtaaataagggaaaagttaacttacttaagagcaaaagccaataaacagttttaaggaccattaaaactattttatatgcaaacactgctgcaaaaacaatgaatgtgatcattacaccacttctgtgttctttgaaaagcactaacaagaatctctaagatatgctgactgaattcccaattccttattctagttagtggtgttatcccaagtccgaggctctaggaagcagactttacaggcagtggaactgacttttctacagttacataatttttaggcaggggatggtaatactattcactatgcccataaagaaacagccactatgtacgtgtgagtcatgatgtatgcgtgggtcattatgtgtgtgtgggtacaggaagcaacagcaaactagaggaaggggtaacacggatacccagggaagggcttcaggacgccatggaaggtgagaggaagattaggaggctggacagagaagtctctttttgacactgtccctagaaagatacaaaaataacacaaccca

SEQ ID NO: 140362 - DNA, 290 bp, Homo sapiens
taaacatgcgttaaaattcatagacttgttcaccaaaatgaagtcagctttactgtatgttaaaaattttaaaaaggtattttttaaaaccacaatataattacccacactaagattgctaaaatttaaaaaaccccagtgcttagtgttggtgaggacatgcaacgcatatattgctggaaggaatgtaaaatggtacaaccattttaaagaattccttggctgtttcttaaaaagttaaccacacacttaccctgtgaaccagccatttcatttctagatatttatct

SEQ ID NO: 140363 - DNA, 812 bp, Homo sapiens
gtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggaagaagttcgtgctcaaaattaatcacacagcgagtaactagcagttctgggtgttccaattcttccaagattacatgagattgggtgcatttggagtggcgtttgccacctttttttattctaaaaaaaagtttgtgcctcctcctttttgttttatcttttaaaaaattatacaagtagtgtcttattgcagaaaaaaataagaatgtacagaatagcaaacagacaaatacaaatcactgaaagtctcaccattctcagaagattctgatttatatgttcccaatttcttttctatgtgtgtaaatatatatagtcactcctcattatttgtgcattctatacatgagaattcacctgctcacta

SEQ ID NO: 140364 - DNA, 2598 bp, Homo sapiens
gtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaaactgt

SEQ ID NO: 140365 - DNA, 2831 bp, Homo sapiens
gtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaaactgt

SEQ ID NO: 140366 - DNA, 2636 bp, Homo sapiens
gtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaaactgt

SEQ ID NO: 140367 - DNA, 375 bp, Homo sapiens
tttctaaattttaaatttcgttttcaagtttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaa

SEQ ID NO: 140368 - DNA, 756 bp, Homo sapiens
cgcagagggctctcttcctccttctgcaaaatgatggtaaaacttgaagtctgcagtctgaaattcagaagcgagtcatcaccagagctcaaccgtgctgacaacctgatctcaaatttcgaacctatagaagtatgagaaattaagtcctgttgtctataagctgcttatctatggttctttggcatagcagcctgaactaatacaaaagtgatatccttttctgtatttcattggacagaagctgaatttgtacccctatgctgttaaaaaaatgacttaaaatggattttcagaatgaaagataggaaatggcttgttgaaacactaaaatgttatctgcttataagatttttaaacattggctgaaattgttggaactgatatggccaaatgaagtccatgaagaatcagattgcatatgttagagcccaaatttccattgtgtgtttcatactaactctccctgaatttgcatgtgacttgagaggaagcaagaagagatgacagtatatgtctcatgactttccatattcctactttccttccagcaatcccttacagaacccacctcttaggccttttctaatcactgccttaaagccagtataagaaaacaaatttcagctggactgctatctcctttttggccaacctacaacatgatattttcctcaaaacccaagggccatattactgtcatcaggctgtaggccattttattcaataaaaaactgagtcactaaaaaaatagta

SEQ ID NO: 140369 - DNA, 183 bp, Homo sapiens
ctccatcatgcccttgcatatggcgtgttgacaagttgggaggactgccctaggcacggctggctgatggactctgggatgaggcactgccttctctcacccagccgcagacacacagctgtcctgggccttgcagagatgatttttctcttaagttactgaggctgaagaaggtgtggtcca

SEQ ID NO: 140370 - DNA, 104 bp, Homo sapiens
caaacaaacaaacaaaaaacactgagatctccatgtgagtaaagtttagtttaggaaaccataaaaaccttgttaattgagcctctggcaatagtttttttaat

SEQ ID NO: 140371 - DNA, 240 bp, Homo sapiens
ctgcactgtgtcccttgttcctgcccatctcttcagctgcttctggtgtcctgctccccttggcccactgtgcacgtgcccagctggctttgtgttgtggctctcttcaaggtctctgtgctagttggccagtctttttaggccttcagagattggttgcttttcctccagatgtcactacttggggcctagcatcttgggtgatctaaggaagacctctccctcacttccagtcttatg

SEQ ID NO: 140372 - DNA, 356 bp, Homo sapiens
cctgtgactgggccaccacgctgcaagtacagcagtgagaatgaccgctaggaaaggacactggcggcaatagggggctctgcccagggctctctgcctgggctggggcaggccggctatcaggcagtcgcacccccagagcggcctcgtttgttacccccacaggcaggagttggataaatactcagcctcctccccgctccaggggagtcactggagggtgctcagcaggggcactaagccatcagcccttacaggtgcatccccttccctactccctgtcttcctgggtcacctcccaaagaaatgaacagcttccacatcaaccctggcctcattctgcttccagggagagt

SEQ ID NO: 140373 - DNA, 358 bp, Homo sapiens
aaatcacaaacccagtgagtgtgccaaagggatcaggccccagtaccctgcctcttaatatagccctcacccaccagcctgcccagggaaaatgagaggcaggcctctgaggtgcacagacatccatctgctatctatgtaattaaggaatatttactctgatgcatagctaagaactaaaagcagaataactagatatactgctgcttggggaatctctgctaatagttaacacatatgtagtttccaacatgactgaataaagctatactgatgttctggtgaaaaaatgtgtatccaatctatacagaatataaatagtgcgaacagtaaaattcaactagccacaattctaaac

SEQ ID NO: 140374 - DNA, 183 bp, Homo sapiens
tctgcttaaaaacctaggaagatgactctctggttcacaataaagtctaccctggaggtcccgagacctgcccatctccctcttctagcctcatttctctctacacccagcagccagcctgacaccagagccacaatggccttcccaccctctccacaatacgtgtcacatttcccatgcctt

SEQ ID NO: 140375 - DNA, 546 bp, Homo sapiens
tcctgattttctatctctgatttctcaatactttcagactcaatagatgttctgatttttgctacttcttgagaaaacgcttccataaaattctgatctgcttcaatctggactagtttcttccaggtccctgaaacttttccttctgggacctccactgaccttcttcctggagattcttgtcacctcctccttgtgccagattacctgtttccagggttcactactgagaaagtgtgcacctaaggagaattctgaggactttgtctatttagaaacatctttactcttatcttgaattaattttggctgagtgttgaattctaagtttaaaatcatttttgatcagaatcttgaggtaactgctctatttttttttttttcctggttgtcaagctcttgatgcttccaaagccattcagatttgtggtattctgtctctcccatatcagcacatatgattctgtgtgacaaacaatggaagtattaaggtttattggataaatacttatgtaagaccatcaatcaaataaatcacacattata

SEQ ID NO: 140376 - DNA, 503 bp, Homo sapiens
gccgtttcccagggactctgggtgaaagggctttcttggcatgaaggaggataggataggatgtgatgtggtgtggtctgaccttctctggaaggagacccggggctgcagtggactcccgtagtagacttctctgaacctcagtttagcatctttgagaccatctctgcccatcctacttcatggggctgcagatagacttgaaaagatttaggaacattgtagagcactgttatgatgaataaactcattcattcttcaaacatctactgggcagtcgccaggcaccatccaaggccccgtgaattcagaattgaatctggccaggcttctgaaccatcttccaaacttgtgagctcccaaaagatgaaggacgccacacaagcacgaggtctctttattaagtgacctcctgcccacccaaaactgaatactggtcactgcccacccttgtgccatgctttttgttactaactctcgaccctctgtcagcttaggctgcc

SEQ ID NO: 140377 - DNA, 402 bp, Homo sapiens
gttctggcaatagtactgtgaatctgttgttgttggcagcatcttggttcgaggtggtctttttgtgtgtggagtaggagcttagccaataagtgtagattgggagtcaggatctagcctgctagatcaggactaggtcagggctaagattcagaatagggttttagtccaagtagggaaaagaaggactgtagattagaaaatcttgctgtctaatatgcgcctcccatttcctaggtccaaaacagaatttctaatatcctttaattgtctcctaatctgtaagagacaatggcacctccattcctccaattgacttagctgaaaatcttgggagaaaattctggactcctttttctgttaccccaagtccaagttgttagcaatccccttggctttacc

SEQ ID NO: 140378 - DNA, 478 bp, Homo sapiens
agccaaaaacacttttctttttatatctgcaaactaagcaagaacaaaatcatcagagagaaaaataaacaattccattgaacaatcttgccacataaccacagaaaaagcattgttgcagaaacaggcataatgctaaaacaagtgttcagtttgtttctgactcttagcagccatttgggcaggacaggactggggtgctgttgggtggggctgctatgaactggggactagaactgggatgtagctagggtactgcactgggcagcaggaactaaggggttgaattttcactatgagggcataaaagatttccgagcttcacttactgagtaccactctactcctttgtcactctcttggtattctgaaatctcaccaggttggtgaagcttcagagattgcagttgctcccctgaatcctggagaccaccaagtgattaaattgagaaaacatgatggctcagtgggccagggt

SEQ ID NO: 140379 - DNA, 543 bp, Homo sapiens
ttatcctcaaagttaagatgaggaggccaaagaacagagaggctgagggactggcacgagttcacacattaagaaacagaactggctgggcgcaatggctcatgcctgtaatcccaggactttgtgaggccaaggcgggtgaatcacctgaggtcaggagttcgagaccagcctggccaacaaagtgaaaccccatctccactaaaaatagaaaaattagctgggcctggtggcatgtgcctgtaatgccagctacttgggaggctgaggcaggagggttgcttgaacccgggaggcggaggttgcagtgagccaagattgtgccactacactccagcctgggcaacggagagagactgggtctcaaataaataaataataaaataagaggcagaagcaaaagatggtcaactgtcttggttggctcagaacagaagagtttttcctggatgtgggactttgggtgccaaaatggggaaagctccaagcaaactggaagtgtcagttaccccacccagagttgaacccaggcagtgaggctcc

SEQ ID NO: 140380 - DNA, 305 bp, Homo sapiens
gtcattccgagccatcacagatctctgctagggacctctgaggcagctgagaaatagctgtaatgtccctagatgggaacagccatcaggaagtctttcctagtcctatctgtagtttaattgaaaagggtcaacttgagctttattaagtctctcttgctcaagaagagctccaggctgacttctactagaaagtaaaaggggaattgggtgtggttagggagatggaacgggtgcggggaactcaagcaggacaggtgtcatcttcagtatgtctttgctgctaatagaaatcaagcacattg

SEQ ID NO: 140381 - DNA, 311 bp, Homo sapiens
ctcctaccccaccctaggacagacaggacccctgcacttatccagcatgcatttaatgtgcacttcctgtatgcccaggcctgggttaggccgtttcacaggtagatactggagaaccagagggtttggggatcagaaggtagtgaatttgctttctttagaccaacttcagaaattggtttgggccaggcaaaatggctcacccctgcaatcctagcactttgggaggccgaggcaggaggactgcttgaggccaagcattcaagaccaacctggccaacataacatgacgatacccccgtctccaaaaa

SEQ ID NO: 140382 - DNA, 204 bp, Homo sapiens
taatgagtcctccctgataaatggcatggatttagaaattcacaggtcctggggagtgtggaatagaattcatgaccctggcctcattatctgagcttacttcttacaactattacctttccattgcattttccacctgaagccctcacttcacttttacagtgttcttggttcttaaagtcaataagaaaagggtagtatttt

SEQ ID NO: 140383 - DNA, 245 bp, Homo sapiens
tagtgagctgtaaacactagggctggagaagtttggtgtggggggctgggagcgggtgggggtggtgcagagggagagggtttgctctcaaactccacttcatgaagcaaagtcctagagtttcctgggtcagatggccattcggagtcagcccggataaccccagggaagaagtgctttttaatgagcagtgtttaaacactcggcaatttttgtgtgtgttcacctcttcaccccttacttct

SEQ ID NO: 140384 - DNA, 692 bp, Homo sapiens
taatggattttaccctaataagatcccacctgtatttgggattatttgcttgacttgtttctttttctcacagctgaaacacaaccgcaaagaacacaggggcttggtttgcctcctttgtctgcaagtgatttacaggggaagattttaagctctgctgttggcctgaaagtttctctgcaatcttactccagatttccccaggactgctccttccctactttcaaaactgctgggttctgtacgtcaagggataatgcttggcagcatatttaacttcatgctttcacaatgagaatgtctgtgcctttgctgtcagcttcactgctgaaacactctgcaccacattactcacaaccctgtgctttatcaaagcagctcgacataacaatcctcactatatacaagttaatcccagtatggcccaaattatcaaggaagccctctataaaacagcaggattcatttcacaaacatctcctctgagaaatgtaaattctctatttaaggtctatggtaataaactacaagaggattgagagtggttttggaaataacaaataacactgttagccttttcctatgactgcaacaccaggagtatgtaattaggttatttctaagaaaccagaagtgctcaggccattctgatgtgctttgagcatgaaatcttactacttttccaaggtacc

SEQ ID NO: 140385 - DNA, 267 bp, Homo sapiens
aactgttcgacagaaggcaattatttcaagattgaaataaatccctggtttttattaaattagttaattaagagcaaaacagctctgctgctttcaatgatgaagactgctttggtaaaaacagaaatagaagactctaagggaatgcaaatattaaaccacacagcttgccctgttttaaatccaccgtgtataattgaagaagctctctagacaacatgggccctccaggctgctgtaatgaaattgagcagaaaaattacaagg

SEQ ID NO: 140386 - DNA, 382 bp, Homo sapiens
ggaaagatccagggccaaggatctctctgtctcaaaaaaaataagacacatgaggctgggcacagtggctcatgcctgtaatcccagcactttgggccagaaaactccatccttttctaagaagagaagaccccacaaagctcacctctctggcttgggggtgccctagatagtagcagatgagttcccctagggcactaactttcctcagggatctctgatgggtatgtacaaggactaggttccctcacagttcaggaacaattccctacactctgcaccccagctgacacacagctggtttagaccagttgagccatggagctatcttcattccaccaccctacccgccccagccccaaagtccattataatattctta

SEQ ID NO: 140387 - DNA, 771 bp, Homo sapiens
atttctacgttaattgagcaaacatttgcaccatggctgctctgtccagggcttttgagaatgctaagtgctgctgaaataactttgagagtctaacttgaaagggcctccagcagaattgagtataaacccgagattagcacccgtaaaggtccataaagggcttaatttgtagtccttttatttatctttagcacagtgtgaagtgtgatggactagggtggaaggtgaaggagcaaggtaaagagagactcccgtgacaatcagcaatacgcctttaagttcattgggctttgcttatctttactaagccatcttttcttcttagagaaactgcaattattattggtcacaagaaatgaatattctcatgtaccttacaggatttgtttatcctgttagtctttaatagcattgtagataaatgccctgccattgtagagaggtaatcatacttttagtttttgataatttagattatgtggaaaaaattctgttttggtgaaaatacgacattgttaggactagtaacaaaagcatatatatgatgctcagtgctgccaattatttctttttacatttgaaataacatttacttaatttaattagtatacaggaagatctgttgtaaacatttcagaaaattcagaaagcattgaaaaaaaggtaaaaagtcatttgaaactcaacaccaaagataatctcagttaatattttgacataattccttttactactttttcctaaatgtatttgtatgtatgaatatat

SEQ ID NO: 140388 - DNA, 378 bp, Homo sapiens
tgaagcaggaagactgcttaagcccaggaattcaagtccagcctgagcaacatgccaagaccttgtcgcttagaaaaaaaattataataagatctgtgttctgaagacaacactgatacaaggcagagaaaggctgagaaggaaataagacacaaggcaaggtatcaggctattgcagtaatcgaggccaaggatgacagtggcccagaggtatgaacagactctagtgatctttaggaagcacagctgacaggacaggacaggactcacctcatgaggaaggagtaactgggcagatgaagaaggcattcatggagaggaaagcatagggcctggcttctatgacatatatacacatacctattctgcttcataaat

SEQ ID NO: 140389 - DNA, 411 bp, Homo sapiens
agagaagccggctggtgggggaggggtctgtgtggagagcagcctcctccccatgtcctgcagtccacacctacctctctcgacctgtaactgggcctcctccgtgcccagcttggcttggcagtattgctctgtgcaacagtctccaagaagtctctatgcctccccagctcctggggcacccgaaagggcagcgctggataagtctcagtaacacagagcagtcctggggagagggccgctccatggcttttgggcaggctgacctggaatgagctggcaggcctgattccagtcctgagggacaggtacccacatcaggaaaccaccatcctaactggccccatttttggcagtccgaactgagaggctaagcagggaaaggagaatgtagaattccaccccacctta

SEQ ID NO: 140390 - DNA, 408 bp, Homo sapiens
tctttgcctttaggggtctttgctttttgatatatagcagagagacaaagaaagagatagtaaaaagaagtattgaaatgagtagaatatctcattcaattgtgctagatatgacttttattggcacatttaaaagggtaatattaatgttgctgtttgtaattggaaaaatagaaatgtaattcttgaggcaccgctccagtttatccttttgggaaaactactaagtcatttgtctttactgattatatttcttttgtaaaatatgtttactgttttggtgcttccatagagaaaaggataagatgattaataaagttatttaaaagactgaaggatagtagcatgccagcccgaatactttttatttttaaatatcaaatcactagtgcagatgagcatgttgat

SEQ ID NO: 140391 - DNA, 540 bp, Homo sapiens
attctgggtgggcccagagccttccaaaggttttacgttgggcacaggggctgtctgttgatggatcgagggtgatgactgtattttggtgtgattcccttagggctgagaagtacaaaaggggaggaagtcagtttcattttttagcattatttttcatttgcatgagcagaggccatggatgcaggctttataaaccagtcctgttgatgccgtggatggtctgctttaattgtcttcaccctgcgcctcactcaaataatcacttccagggagagggcatttaaaaaccaaggagggccagagggctggaataacttgttttgatagttgttcagtatccgctgctggagtacctggaagcgtgacccctctttcaggagtcaagaacaaagaagtgatttctccagggatgcgaaggtgatctatagtaactcccgcactgacttttttttttggtcctctgcaaatgatttacatatggagtaagaggcagttccacatcatgagcagctgaaagcaaagtcaatgagctagaaa

SEQ ID NO: 140392 - DNA, 277 bp, Homo sapiens
ggtgaagtttcagagattcaacccttagcctccaaggagacacaaatggccatgctgtgaactgtctttggaggtggcagctctaggagctgagggccttcgttcaacaattgcaagaaattgaattcagtccacaaactgaataagcttggaagaggacactgagcatctgatgagaccccagctgacactctggttgcagtattgtgaccctaaatagaagacccagttaaaccctgcccagacccttggctcatggaaacagataataactgga

SEQ ID NO: 140393 - DNA, 121 bp, Homo sapiens
ccatcacttctgccacccctcccatggccaccaccagaccttctcgacacctctacctctaaaatcataaatgccagcatttcagaccaagacctgtgacccatccagctcttttcttact

SEQ ID NO: 140394 - DNA, 261 bp, Homo sapiens
ccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggcaggcatcaaaggggaaagctgctctggaggcctgggga

SEQ ID NO: 140395 - DNA, 547 bp, Homo sapiens
gtgatggaagagtagtgagagaaagcgagggatgggtctggaataagtgggcgcacagagcaggctgcgaaagccaagggagtggagactttaggagagagggatcaaaattataatgtggccagacaggcagcagatcagaactgccgagtgtcctttgggatagttcaaatgaagggtcactactgtcgtagcaaatttaagggaaaagtaaagaagaaataaaagagaagtggggaaatagacaaggcagcaagcatgaactgctctgctgaggcttagctgctgaggaacagtaggaaattagaggtcacataggattaagagatttttatggcagatattagattcacaatctttaatgtgatatatccacaaagggtaaaatatttagaaaaaatagagactggctggtaagtaaaagcagaaatattgaactaattgttgagtgcggttcttattgaggtcttttgaaatgtatagtaacttatagggcactagaacaagctaaaaaagtgtatgaatcactaagtcctcattctgaaaa

SEQ ID NO: 140396 - DNA, 477 bp, Homo sapiens
agcatttcctccctaaccccatggattaatccattttaacagggttgttaatgaagctacagatatttctatgtaatgatttggccaaactaccaagtacttattcagcatataccatgtgtgagaaagcgcagcaaagtaatgttaatagtctctgcccacaaagagcttattaccaatttagaaaaacatgtaaggttaacaacacaaggcaatataaaaatgtcaagaagttttggacgccgaggcaggcagatcacaaggtcaggagttcaagaccagcatggccaacatggcgaaaccccgtctctactaaaaatacaaaaaattagccaggtgtggtggcatgcacctgtagtcccagctactcaggaggctgaggcaagagaatcacttgaacccaggaggcggaggttgcagtgagccaagaccacaccattgcactccagcctgggcgacacagcaagactccgtctc

SEQ ID NO: 140397 - DNA, 355 bp, Homo sapiens
agtcagggtcagccttccagaaatagaactggctctgaggtggcctcgggcatgaaggagggatacagcctatcccagcaggagtgaaagatgaaggaccttggagtgacctcaagctctttgctttaaaaggaattctataggtttttttttttccaaggccttgaggaaaagtcctagggtcaaaggtcagaagattcccagttggttaaataagtgaacaaaaaggctttctgcagggaggaaagggggtctaccttgtttctaggggcaccttccttgctgcctccattttctttgcccctctcatcctttgacaaataaacatccaacacagtggctgaagaggaggctc

SEQ ID NO: 140398 - DNA, 110 bp, Homo sapiens
tgctgccccactcagtgggccaggctgttaaccacctgtggagttagttgtttggtctaacaggcctagtgattttcttaagttcttttctaatgagaaggcaattggtg

SEQ ID NO: 140399 - DNA, 275 bp, Homo sapiens
aaagccagatttcaaatctcaaacttctgatttggttcagaattctttttcatttcttggtggtaatctccaaggtaaaaaatattttaaaaggcatttaaaatgattttatcaaattttaggataacggtagtacacagccacaaaaactaagagtaatctagtgtatagttttctaaatattattttgggtggaacttatggttaattctcatttgttatggagcaaagattgaagttacttttaaatatcatacacatacttttataatcag

SEQ ID NO: 140400 - DNA, 572 bp, Homo sapiens
atattagtgatgctcccctttacagagtagcttctgccaactctagctgcagatgcaccctgcacaggaggtccttggtcagcctgaggttgaaatgcagtggggagccatgcaggccgaccactgcagagcacgaggcctgaaggattgagtaagggaagccagggaagcgtcagtaggacacagtcttgggcctggtaacagaaaggaggcaagttttattttcttattaaatatagccagatggacacctcaagtgaccccagaggagcctttgaacccagagggattgccttcttaacctttatatatggggtatgggaaataaatcttagttgcccccaagacttgtgacctccagtatggaggtctggggcagaatgatattggcccatgcatataattattaagcaattgtggatggtgttctgcaaatggagaaaggggaaaggggattttcttggtaaatccagaatcaggatacaatgtctctttgctatatgaccttgaaaatcttccggcatccatggataccgttgtgcatcaagctggcatgtagaagcgaaattgtt

SEQ ID NO: 140401 - DNA, 216 bp, Homo sapiens
atcatcatatgaacttaggatggattcttaggaagatacaagaaaaagctgaagtattgccccaaagtttcaactccttattttcaacacctatactgggcagtatctgagattctccaataaataatcaatagataaatgaatagaaagtagggttacaaagaagaaggaatttttacaattttttttaaatgttgaaacatgctggagttgggg

SEQ ID NO: 140402 - DNA, 625 bp, Homo sapiens
gaaacctccattttctattacaaaaatactacatgactcttaatacagaaaaatcgagagaaggaaaacaattcccagtgatgaatatcattgggcagctctttcctacaagacttaaaaaaaaaaaagaattaaacttagttctccttctggcttttaattacagagctttgcaaatgtgcaaaacaaagaagaggggagagtgtaaagagccccacgtgcccatcacgtaggcggcttcagcagttactaactcacggcgagtcttggctcatcgtttgtcttatctccccctgcccctctgcccactgccttattttgatgagatcgggcgcgtttagggtggtatggccgtagactgctgccttattttgatgagattgggcgcgtttagggtggtatggccgtagactgctgccttattttgatgagatcgggtgcatttagggtggtacggccgtagaccactgccttattttgatgagatcgggcgcgtttagggtggtatgggccgaaactgctgccttattttgatgagatgggcgcgtttaaggtgtatggccgaaactgctccttattttgagagaacggcgctttagggtgtaggccgaaaccgctgcttatt

SEQ ID NO: 140403 - DNA, 568 bp, Homo sapiens
gaaacctccattttctattacaaaaatactacatgactcttaatacagaaaaatcgagagaaggaaaacaattcccagtgatgaatatcattgggcagctctttcctacaagacttaaaaaaaaaaaagaattaaacttagttctccttctggcttttaattacagagctttgcaaatgtgcaaaacaaagaagaggggagagtgtaaagagccccacgtgcccatcacgtaggcggcttcagcagttactaactcacggcgagtcttggctcatcgtttgtcttatctccccctgcccctctgcccactgccttattttgatgagatcgggcgcgtttagggtggtatggccgtagactgctgccttattttgatgagattgggcgcgtttagggtggtatggccgtagactgctgccttattttgatgagatcgggtgcatttagggtggtacggccgtagaccactgccttattttgaagcatcactttttctgtaaatcctttagtgtgtcctcattttatttcaaaagatctaagtttattgtccccatattgttagatatta

SEQ ID NO: 140404 - DNA, 470 bp, Homo sapiens
  misc_feature (35)..(35): n is a, c, g, or t
ggctgggtgtctagacgatccctggctcagtgatntcattgtagccaacatttgatgatatttggttgtaagatagagaagaaggagcacactggtgttttggtcctgtaccctactggttattaaggatttttcatagtatcccctggtggttagattccccaggcagggccatgaaagatagtattttaccctgtgctatatctgaagaccagactaacagtatcacacaccctaaccacactgaagaaaatatctcttttaaaaatgtattcagtggtcgggcatggtggctcatgcctgtgatcccagcactttgggaggccaaggcaggcagatcatctgagttcgggagtttgagaccagtctggccaacatagtgaaaccccatctctactaaaaatacaaaaaaattagccgggcgtggtggcacatgcctgtaatcccagctactcgagaggccgaagcag

SEQ ID NO: 140405 - DNA, 580 bp, Homo sapiens
tctctgattcaccaatatatgcccagtgtctaaaaaattacctggcatataataaatgttcaatgaaattttaaacatgaacctactatatgcaggtgagtatgctagatctgctctgtccaatataatagccatctgtggctctttttaagttaaataaaaattcatcagtcacatcttaagtattcacacactgtaagtgctcaatagccatgtacagataatggctcctgtatgggacagtacagatatacaacatttccatcattgcagaaagttctactgaaaaccactgtgctagaccctttgcaaacttctcatttaatttcacaaaaatggcttgtggcaaggagaagtgtctttatgctggagttaagaaagtgaggctcagagaagttatatgacttcccaaagtcatacagctgggatttgaatacaggtctgtttgactccaaaacttgtggcctatttgttgcaagagtgcttaatacaaattggttcagtcaatattattatctttgaacaatggaaggagaaagtaagtttcaatccaaaataattgagtgacttatacattgac

SEQ ID NO: 140406 - DNA, 134 bp, Homo sapiens
gcctcccaccggaacatgctcctccagaggtcctccccatctcagtcgatggcaactccatccttccaactgcttggtccaaaaaccttggacctatccttggctcctcccttccactcacacctcacacctaa

SEQ ID NO: 140407 - DNA, 540 bp, Homo sapiens
cccctcacgttttcttcaacttcagcgtccagcagtgttaaaaatagttgtagttgttgttggagtattaactataacccagtgcagaagaggtatgccgcttggtattggtaatgtgctggcgttcaaccaccatttgtgtgctcttttggggcatagattttgcttacctacggaatacttattttaaacgctttgtattgaagcattgttttcggtttagaacaacccatgtgaaattgtttttgttaaatatagtacactcataaaataggttttagctcaaggttgggggaataaacgggccattttatattggaaattttgattttgtgaggacgttctatggttgcaaccagtggttggaaaaactatctagtcttttgtatttgaaattctataaataaatacagcatctagctgaaaggtgtgcagatgtacataacaggagagttagttcaatagatgaaacattttaaataagtctcattggatctatttattgtaaaatttaatattcagttacaagcttgtggcata

SEQ ID NO: 140408 - DNA, 214 bp, Homo sapiens
taatacagaaaatgtggccaacaaccaccacggctcccagagaactcctggtccagcaggggaggcacgtcacagattattcaaatatgatgcgataattgctaaaacaaaaggtatgaagaaggggctctgacaacaattcttaaagtagatttaaatacagtacacagaaaaaaataactggaaaagatgatttttaccacagacctgggat

SEQ ID NO: 140409 - DNA, 269 bp, Homo sapiens
gccacccccaccctaatcttttattttgcagatgggttctctacctggccagtgccatgttgcctgtttctttactgtaactgtggtgacaaagaaaagggaagatggagcctccatgttgaacatacctggcccccagcactaactccctctctggatatctggaacaaggaggaccttaaacttaacaataaagccaatgatggttctaccagtctccccaaagcctcaagtttaaaagccatatgaactggctgatagtggaaaat

SEQ ID NO: 140410 - DNA, 374 bp, Homo sapiens
accctcagcagtgggaacacagcaaagatgatgagggactgaagcgtgggacacgcagggtgcagggcccacagagcccagggcgcagggagtcctgagggaggatggcatgttcggggaagagagagtgcctcttggggaggcctgtggccactcatgcatccaaagccacacagatgcaggctgcggaggcagccctgggttgtttactacaggctgagtaacccctttctgaaatgcttggaaccagaagtagttcaggtttcagatttttttcagattttggaatatctgcattatacttaccggggttcagcaaccctaatctgaatatccgaaattccaaaatgcttcaaggagcatttcctttgagt

SEQ ID NO: 140411 - DNA, 570 bp, Homo sapiens
gataatcaggaatggaatagacaggtgatgatgcagctgttggtgggtaagaagtggggaggagctcggggaggctgcccctggaatgtggactcgtaggtgggaaggatatacagttaggatgtccctgagagatagtgaaaatgccaggaacgagtgggctcctggcatgacaaaagaggctctggaaaaattgcctcagagggagaggaaagggagaacaggagagagttggaaattgtagatcctagagtattatagcggtgtcccggcgtggtggctcacacctgtaatcccagcgctttgagaggctgaggcagtggatcacttgaggtcaggagttcaagaccaacctggccaatatggtgaaaccgtatctctactaaaaaaaaaaatacaaaaaaaaaaaaattagccggcatggtggtgtgcatttgtagtcccagttactcaggagcctgaggcaggataatcacttgaacctgggaggcagaggttgcagtgagccgagatcagaccagtgcactccagcctcatcatgacagtgcaagactgtcaaaaaaaaaaaaa

SEQ ID NO: 140412 - DNA, 415 bp, Homo sapiens
gtactgtaagtctacaatttataatggcatatattttggagtacaaagtaatgttgtgatttatgactgctatgtggaataattaaattgaactaattaacatattcatcacctcaaatagttatcatttttttgtggtgagtacatttgaaatttactttcttaacaatgttgaagtgtgaaatacactattattaagtagaacacttatcttaaacaccctaagttacattaaccaggttaaacttgaaaactcatgcagctaagagtaacttccgtttcttaccagcatgatcctttcttattaacagggcagaaaagtgaaatcatttccacagctgggattattacttctttgcctttggttgcttatttcagtgggttagaaaagcaatctaggttctttcaacaattc

SEQ ID NO: 140413 - DNA, 187 bp, Homo sapiens
gaatttacagctcattttaccataaaagataatgtgtaggttgtttaaaacctgttctttggccgggtgtggtggcttatgcctgtaatcccagcactttgggaggctgaggcgggcagatcactaggccaggagatcgagaccatcctggctaacacggtgaaactctgtctctactaaaaataca

SEQ ID NO: 140414 - DNA, 150 bp, Homo sapiens
tgccagccctgcctctggggcatctgtaaccacagggagcacttggcctatctccctccatctcttcttttttcacgatcccatgtatttatccgtgggaaggaaagcttcgtttctttttaaagtgattataccgtagatgcagttttg

SEQ ID NO: 140415 - DNA, 388 bp, Homo sapiens
agcctctctcctctctaccactgccaaaccagagagctctggtctctgagaaaggagcacacccttcccagtcttgcccataatcccacctctactgccccaccaggccatcgctgctgcccacgtgtgctgtcagatgagattctgctgcttcccctccatgtgagagatcacactcaatgtccccattcttaaaaaaaaaaaaaaaaaaattcaggtctgtcttcccttcaccaccaaacccattaacctcctgcctaccctggtcctccttattccccacctcccccttactctccagtcctgcctgccttcctgcaccactctactggaccacctgcagcatctgtcatgaaaatgatgctgtgttacacccaaagggtgcttt

SEQ ID NO: 140416 - DNA, 402 bp, Homo sapiens
agatccccctccatcccctcccacccctcaatagaagacaatgcaacagctctgtgtataaggatggacaagtctccaggctacctatttacgtgaaagaaagcaaggtgcaaaattgtagcatgctatcatttgtgtggaagaagcacacacacacacacacacacacacacacacacaaactgaaactaatgcaatgtgattttttatagcttctttgtaccctgcttgtttaattttaaagagctacaaacccacaggaattatcctgctacagcatctttcagacttgattcttttgttgcatcctgtcttgttctttttctaaacagagagtaaactcaccagatttgtgttttagaagggtacaactgggagcagcatagaggatggattggaatt

SEQ ID NO: 140417 - DNA, 162 bp, Homo sapiens
cactgtcagcttggccaagtcaattttctcagctacaaatgaaaagagactcagggagaaagatcttggaggatgactaagacctgaagtcatgtttgtgaccattttcaatcttgagaaaaacagaaaatgtctatattatattaatgattggcttgagag

SEQ ID NO: 140418 - DNA, 102 bp, Homo sapiens
ttcctatggctttgaaataactatattttaggaaattggctctttgcttataagatgtactgtgaatttttttatttgtcagtttatcttttattcctccaa

SEQ ID NO: 140419 - DNA, 523 bp, Homo sapiens
gccaaggcttagacaggttttataatcacacagataaatggaaatgtcaggagttgaacccagttagtctgcatccacagtctgtacttttagttattatacagatgtaggataatccgtcagagtaactcattagcactacactaagttcagggtcacagtcaggccctctgtctcacatagcttgcctcttttgttcttggattaaaccttgacaatttctttctacaaaatgtgtgaaatctgcctagaaagcctgagaaaggaagaaagacacatgagctaactacagaccaccacatgagtatagaggaagaaaaattaaaaaaaaaaaaaaaaaagatctacacaaaagcataccaccaccagaaataaaagtctccttactctgtcagctgtggaatttccaggctgcctgctctaagctgacctttcctacagggaatttggggtataggcatactttgtccacaaaaagttcacagttaatcctcccattcaaggaagacgtctgtcctataag

SEQ ID NO: 140420 - DNA, 309 bp, Homo sapiens
aacattcccaggaaaacagcagagtagccaaatgccccttgtaacatagcctgaggatccactgggcaatacaggatcttgctttgcattttctattttccaggatcctctaaatctatcagatccatggatttaggttagaaagaggctcgtgaagctgtagtgtcagctataagaagcccaagtctgggcaggttccaacaacccatgagtggtgagatggctctagccgttgccctcaaagtctttagtcattcacttaacaaagatattcttggtgcctaccataagccccatggtggtgttaca

SEQ ID NO: 140421 - DNA, 243 bp, Homo sapiens
  misc_feature (164)..(164): n is a, c, g, or t
gcgtgcaatggcaggatcatagctcactgcaacctcaaactcctggctgaagcaatctttgtgccctagcctcccaagttgttgggattacagtcgtgccccaccatgcctggctaagttgttttttttttttttttttttttttttttttctttttttttttnttttttatttttttttttttttttcatttaaaaaaaccacacaaaaataattaccacacaccaccgccgccatattttc

SEQ ID NO: 140422 - DNA, 327 bp, Homo sapiens
agaacgaataaagaattttggcaattaactatgtaactgagtcccagactctgctatcatctggggtggcagataaaaacacacagtccaaataaaaaacctgattttttattttagcctgaatcacccagatcacagcaggattttgcttgaacaacccagacagattgcatccattttctgctttactgtgcttgtggaagccaggctgttagtggtttcttctggaatgggagaatgtatcacaaaaaggttggaacctgaaaaatttctagaatttcattgttctgtgcttcttaataaacaatgtgacactaccaaggaatg

SEQ ID NO: 140423 - DNA, 165 bp, Homo sapiens
gtttgctctttgacttgtacagtacctctaaataggcactgatgaacagacattagagacttaaagtttaatgatactccacagacaaaaagggtcaattatttttatgaaaacttgcctactctttgtatgttttaccattgtaggggaaaaaaagtagtgttt

SEQ ID NO: 140424 - DNA, 519 bp, Homo sapiens
gctttaaagtctttgtcagttaattccaacattggtgttgtctcaggttgatgtgtgagttgagattttcccagtgagtatcacccactttctgtctataccagcggtcccctttctagttcctcaagccaggactagagagctcttgatgctctttctctctgctgatgctcatttccgggtttcagcctgctgtgcatccaggctggggaacatcagagggaaaaatgataaactcgccgccagtttattggtacttcaaattgtggtcttcttcatccatctgctattatttttcatagttctcagatagctgctacatgcattctgttcaggttttacagcttcattcagtgaaagagacactgaacctagaaccctgttccttacatcttttgtttctatttttaaggaccatccatgttgctttaagtacagctgtttaattttgtctgctgcatagtattctgtcatgtttttgtcaaattttgtttgtcttttttttttttttttttttgg

SEQ ID NO: 140425 - DNA, 295 bp, Homo sapiens
tttataaaattttaactgttgatttaaaattagctttctatactttaataatactaataaaaatcagccttaatcttagacatagcatatgaagtgtgttataatgtccaggtggctttgtattttgataacgtgctattattatggactcaaatctcgtggaagacttgttttcttttaactgcaccatgtgaatatacgataccatgaacgtgagtccatttcttctttaaaagtggttctgctcagtttttttaaaaatctgattttaaataaaacttgataatgttattat

SEQ ID NO: 140426 - DNA, 460 bp, Homo sapiens
gctgagtctcctgagagcagttctgaaccacagtccagagcagggcaagcctcaccttggtcaagcaatgtcaccagagcctccgctggcctttcctgccattgttccctatgcctggggaggtggtgtttaagggacaggtgtttctgctgttggggaagtcccacctgctgcctccactggagaaagtgactcctctctgctgggtgacagtgaggggagcccctaagtcccaggcaatgtgccttgcagctcattcctgtccttagagacactgcctggggcctgctcagctgaactgtgcccctcgcctgctgcagagacaaggccaggcttctttttccctctgcacccccctacccccaggaatcggggttggtctccaaggcttctccccccagtctcaaacatgcaggcctcactcagctgcccagctccaggagccctaggtcacccctgc

SEQ ID NO: 140427 - DNA, 209 bp, Homo sapiens
gttccttccttgatgctccccattcagaacaaatgccattgatgaagctgcaattctggcctttggccaaaccccagccatagcccattccctgaggctggaactagtacaagagacgggtatcagccagcacttcccgaaccatgcccatagcctaaacccgcaacccacatacttcagttacgggatgaggccattcatttggctgg

SEQ ID NO: 140428 - DNA, 137 bp, Homo sapiens
attcagtgaacatatgactaaaggaataggctttcagatgtactaaaagagcttgctaagagggtatacggaagttctgtcttattttttttgtttgtttgttttgtttgtttgttttaaataaagacttaaatgcc

SEQ ID NO: 140429 - DNA, 455 bp, Homo sapiens
caccccaccttaaccagggccctctgcactgggcaaatctctcaccctctgcttccaggggaggagggtaaaggaagagaaggcacccacactgggagctccattcctgcctcgcctttctccttgaccctagcagcccctctattgttggtgggtggggagggcagtccaatgtccccgagagcctgcggagaagccccgccagagaaccagagcctctctctccttcttgtcttctggtctttccacatcagcctccacccacactccaagcatagtctggaccatacagtggactgggtccaggggctcccttggctcccctttgtgactgggttggccatggggagaaaatctaacatgtagtggatgcttactgtggatgggggttgtgctgagctaagtctttcttcgacacctgtttgttctgccatttctgtaaccccatgaccctg

SEQ ID NO: 140430 - DNA, 317 bp, Homo sapiens
gaaactcacccagagaatccgggagctagaagggactctggagctctgaaataagtctggcagtctgggtttggattccaactatctaaccttaacatctctgcattttgggttgttagtgggccctggaaggattttgtatggattaaatgagacaacctgtgaaagaaacatctagagcttaatggagacatctcataaataattttttatacatgattcacagttcaacatcatcaaaaatgcccagaggagggagagcatttaactaaggacacacagttggcagcaaaaccagaatcagaacccaggtcttt

SEQ ID NO: 140431 - DNA, 748 bp, Homo sapiens
cacagctaaaacaatatttaacgggtgtaaatcacagtaggatccacaggaaagagaggtgttgtcactgcagtgcagggggctaacaagaggtctttctgaccctgagagctggaaggaacctgaaaaaagtcatctcatccgtcttcagttctagattagaggctcaaagaccatagagttccctacagagctccccaacagaagaactcatccattccggggcgtctgaactgactgctgcgaagtcctttcttgaatcaaactgtagctctttctgagaaggagggagacaggaaaaaggatctagggtcataattttctgaacactcctaatctaagagggaaaataccgtgggcctgttagagccataatgatctgtcaccatcaagtcaaatcactacaagtacattttaattttgtaaccttgactcccaatctgtctccttctcgtgtctgggcggcactgagggaggaaggaatatttgaggtcagacaccctgggttcagatatcgacatttaatgggtttcaagtcggtttcctgaaaactcctactggaaagggtgattcagagaagcaagttggggtcccgcacgtggcactctggttgtggtctctcaccccctccccacccagatgctccatgtttcaatagcagcaccgctttcccaccacagtccagcctctgcctaatcctcctcctcctcctccctttcctgtatcgcagccaccctgtcctttctcc

SEQ ID NO: 140432 - DNA, 419 bp, Homo sapiens
agttggcgcctttttttgggggggcaggatcggtggtaacatctgtaatcccagcaactttgggaggtcgaggcaggcgtgagccactgcgcccggccaagagaagtttttcttaaaatcctttttttgggggggccaggatcggtggctaacatctgtaatcccagcaactttgggaggtcgaggcaggcggatcatgaggtcaagcaatcgagaccatcctggccaacatggtgaaacctcatctctattaaaaatacaaaaattagctgagtgtggtagcacgtgcctgtagtcccagctacttgggaggctgaggcaggagaattgcttgaacccaggagacggaggttgcggtgagctgagaacgcaccactgcattctagcctgacgacagagggagactccgtctcaaaaat

SEQ ID NO: 140433 - DNA, 110 bp, Homo sapiens
ttacagttgttagaagctgtgtaggattgcaagcttggtgttaccagaatcgtgcttgttaaagagaaactaaaaacctgcacttttattattaaatgtcttgacttttt

SEQ ID NO: 140434 - DNA, 385 bp, Homo sapiens
ggtgtgtacatgaagagttaggggcttgtggtccagtgggagggagacacgaaaactgacaattacatttgaatatgctcagtgtggtcatgtttcctgaatccatcctgttttctctatctccattattgtcacctggtcaccttagttgctctctttaactccagggtcacctcccagcatatcctttagctttcactcctgcctcctacgcattgtcctcctcatggcaaccatggcgtcttttaaaaccatgattcaaattatgtcacctgtttgcttaccacctcccaatagtgatcaccataagtcaaggaaaatccagacgtcatacagtggctgcacatgtgtggttggcccccctcttgatagcgttgtctattat

SEQ ID NO: 140435 - DNA, 410 bp, Homo sapiens
atgcagtgagccttgatcaggtgactatatgtccatccccagccccactccccaaaggccttttcttctaatggatccagtgagcatttattccttgtctgtcatgtgctccattttaatcatcctcccccaaagaccttttcttccaatggctcccctgagcatttatggagtgtcttctgtgtgttctgtatattcacacctcctccccagaattgttttcttaacagtagatccagtgagcacatatgcaggacctgttgttttggggagtacattcttcttccttacccctaggagagcctgttccaatcacaaggcctctcccaaggtcctttcctgtgataaatccagagctgagtttataatgatcacccctttcccactcccttcagtacccctaggattcc

SEQ ID NO: 140436 - DNA, 336 bp, Homo sapiens
atttgaggagagttagaaaaggtggaacagtatattaggatggagtagcaaggaggagataagaacagaatgttaaattagcagtgtaaaaataatatatgacccggttaagagacagtgagtaccagagagcccgtttgtgcacaggagtgcaaaaatacacacagaaggcatgtgctcactcccttcctagttatcatttgttagcatgagcttaagcttcttataagtttattttttcacttaacaaattagaaagttacatttgtaataataccaaaaaggtttctaatacagttcttgaattttcccttatctgactaccttctaaccaca

SEQ ID NO: 140437 - DNA, 165 bp, Homo sapiens
gtacctggccacagcctgttttgctgtttctttaaacaatagatatttagctatatgctttgttattgtgtagttacttttaaactttagttttcttgataataaaccaaacatatattccagagtgatttttgagagcattgggatgtcttttacagttacttt

SEQ ID NO: 140438 - DNA, 390 bp, Homo sapiens
gcacgtagtgagagccccaggctgggattgtgagtgctggaatgaaacccttctctttatggctccatctggagtgtgtgggtggtggactagaatcagtggttttgctgaccttgtttttaagctgctgcagccttaaggtccaaaatggaaaacagaccaacttggagttagctggggctaattctaaacctggctgagtttgaaaactcagctcctggggtgtgtctgaatctcagggagagtgtaatgcttttcttgcccatagatggcagcatctgcactctttgccggctctgtgaatgtgtgtgtgcacgtgcacgtatgtgttacacacgtgtgcacgcatgggagtcatagtttcttactttggtaaatcttgagctgcgg

SEQ ID NO: 140439 - DNA, 411 bp, Homo sapiens
gggagctcggaacccccaccacctgagtcttctgggatgattgccttgagtcttatctttgcttttttgtctttcacactgtaaccatctccattctcagcacattaggaaccgggggaaatgtgatgaagctttataagtgaggagagactctttctttcttaattgatgttttctctcttcttcctagggtgtggatggcgtcataaaaaggtatgtgtgggaggacagagatggtccttttgtgcagtgaggagagatttatagccattagaattgtcctgggtttaattagaataaaacatctcccagggcagaaaaatgtcgatattgttttatcataaatttctggtcataaatcagcattcgaatgttctataactattaagaatagaccagggactcagtggt

SEQ ID NO: 140440 - DNA, 428 bp, Homo sapiens
aaacaataaagaattttaaaagacttaaacccacaaggagggggatgaactagagaggagacaacaatattttggaacgtggaaagcaaatgaaggaatgataactgactaagcaaacctaagaacgctatattgaataataagcatgcaacagaaaaaactttgaactataccaatcaacactacagaatcttcccctaaaagctcagtaactggcagtaccagatgatgtgaaatcaatgatttaggatgaataacactgattgaaaactatataagaagcaattatggctgggcacagtggctcatgccgtgtaatcccagtactttgggagggctgagacgggcagatggcttgagcccatgagttcgagaccagcctggacaacatgatggaaccccatctctactaaaaatacaaacattag

SEQ ID NO: 140441 - DNA, 255 bp, Homo sapiens
cgcggcgctctagaggacccttctgccacgactcagtaactggcagtaccagatgatgtgaaatcaatgatttaggatgaataacactgattgaaaactatataagaagcaattatggctgggcacagtggctcatgccgtgtaatcccagtactttgggagggctgagacgggcagatggcttgagcccatgagttcgagaccagcctggacaacatgatggaaccccatctctactaaaaatacaaacattag

SEQ ID NO: 140442 - DNA, 317 bp, Homo sapiens
catctttgtacattttcctctcgtaactatgcttttctaagcataaccgacctttgattcagcagttggacagttgcctacatcatcccgttcttttcaggaacaaatgacagtaaaacctgaatatttcaggaatgaggtatttcaggataacaggattttgtgtgtgtgtgtgtacctaaaaatataacattagaatatctgaacttaaaaaaaaataacttttttggatgacaatattttaaaaatagatatatttctttctttctaaacggaatatacataaataatttaatatattcttaatcactgaagat

SEQ ID NO: 140443 - DNA, 290 bp, Homo sapiens
ttcagatgatcctctggagaatgacaagccgggaagagagatagggagtgtcagaggcactgcattttatgcagaatgctcagagaatgtctctctagattgacatttaagcagagaactgaaggaagtaggaagcaagtcatgcctgaatctagagaaagaagagtaacaggggcataggaaaagcaagtacagaggccctgaggcagcaatgttccctgatgtgtttgaaaaaaacagggaggccagggtggctggagaatggctggactgcaattgtaataaagctt

SEQ ID NO: 140444 - DNA, 389 bp, Homo sapiens
ataccggcacgatcagctaataaaacttccgagatggagtctcactgtgttgcccaggctgtagtgcagtggcgcgatcttggctcactgcaacctcagcctcccaagttcaagcgattctcctgcctcagcctccctagtagctggaattacaggcacgtaccatcacgcccagctaatttctttatttttagtagagacagggttttgccatgttagccaggctggtcttgaactcccggcttcaagtgatccacctcccaaagtgctgggattacaggcatgagcctccacgcctggccgaagagcacttcttaataaacatccttcatgctaaactctgtcccggagtttattttctaaggaatctgacctgtgacaaatgataa

SEQ ID NO: 140445 - DNA, 515 bp, Homo sapiens
gctcttggctggcctggccttcccccggacgcatctcattcacagaggaggcccgctggctggacacgcctctcggatcatctctgacactggcagggatttcagccatctcgacatctgattcctgcataagatattccttgccaagaaaattgaccacagactgtagagagaaaaaagacaatcagactcactatgagaacctgaaagtagctctcatattccctgggtcctgccataatgctcacactttactgtaatgttcaaatctgccttcccaatgcagaatcagctctgtggacacagcaatctgtctgaattttttccttttctacataagtacataaatatgagtcctttagatgaaagggtctctaaaccaaagagaagacaaggagaaatattctgggtgaatccaactcaattggccgatggcagctcaccttgtattagaacttaggggctcatttggggacctggaggcagatccctgcatctgataccaaccactttcc

SEQ ID NO: 140446 - DNA, 239 bp, Homo sapiens
cagctctggggttggtgcattctgtaaatgatcagtttgacagtgtaggtagtagagacatgctgctttaagaaagaactttgtatctctattacagagagaagatataaagatattagttcagtcttccataacacgatataacagacttttcatttttatgcgggagggatctctaactctttagtctttatcttaaggaaaatgtaaaggtattacagggttgtaagcatgacaac

SEQ ID NO: 140447 - DNA, 137 bp, Homo sapiens
gcaagatcctgtgtcaaaaccacaacaaaactaacaaacaaaaccagaaaagaccagaagaaacagaaacacaaagtgttaaccttattataaataaatcaattgaaacaaaaaatattatctcgttccaatataca

SEQ ID NO: 140448 - DNA, 280 bp, Homo sapiens
ttctagaaatacatgtggatctttgcaaatgcagaactgactggtggaaagggcgatcatgaactgatgacggaagtctggccctcatggaccatatgtgtttggtgaatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggtgttg

SEQ ID NO: 140449 - DNA, 372 bp, Homo sapiens
cgtctagcacgcaggagcacacaggaaggcacatggctgggcagcacgtgcatgatcgtgggaccactttagcttgggtagtccagcatgagtctctgagcaggtgaccttgatgctgaggccggagcatgaacgagtagcccaagggaggccaggtgtccgggttccaacagcaggagctggccctaaggtagaaaccggcttgtgcgggaggacaggagggtccatgctgcaggacagcaagtgagtggccgtggcatgtgctgaagggctgggggtggtttgggggacaaggtgcagtccctgacaccaggcttcatgtgcatttgttcataattcgtccataaagccacgcctcctgagggacatgcc

SEQ ID NO: 140450 - DNA, 303 bp, Homo sapiens
gaagatagacagcattcaaaatacactcactgaacagcaaatatgtgacaggcattgttctacctgcagggacacattactgtataagaccaaaattcttttggaacttacattctaatagtgacagacagacaataaagaagctttaaaaagaaaatagaaagtaagagtaagtactataatgaaaataggagtgggtaacaaaagggaagactagtgaggtacttattaagctgaggtacttattaagctgggtggttagcaaagctctctctgagatgacatttaaagtgagtcctgaat

SEQ ID NO: 140451 - DNA, 462 bp, Homo sapiens
aatgtaagtgactagctgacagtttggctaaagaagtggttgcatttaaccaggctaataaacatgagcttaaaaaaaaattcactggctaagactgggtcttgcacttcattttcagtttagtgtttctccttggattaattttttctgttttatccattactagtggtatactgtaaattgatgtacagaagtatctctaaaaagactaatttataggagtccagacggactagaagggttttaagcttataatacctggatccttttgttttaattaggtttctagataagtccttacaaacttcaaaggtgttataccctatcagatactttttcccccaaataaaactgtatttttcagttgaaaataaattgatataggcaattccttttcttgacaaccttcacaagtgtggtagagaattatttagcacactaattagtctcagcttcgatttt

SEQ ID NO: 140452 - DNA, 406 bp, Homo sapiens
tgacattcttgagtttctgcagctttgctcttttgagtaaactaaagagaaagaaaattgaaggtaaagcagagaagcaagctgtgcatgtgggcgagtgcacgtgggtgcagtcacccgggcagtgtgtccaccccggcctagagaggggatttccatcccaggaacagggacaatgaggcagcataactgaggctgcaggagctgcttctctcccggctcatctaagctgctcctgcctagagctgccatgcctgcggatgtctcttataccaccatggatgatgaaagtgtgcgggccagttccctctcttcttcttactttccctggcccattcagcagtgcgtccctcccttctctgcagttatgctcctgctcttcttccaagcatcacctcaagttgca

SEQ ID NO: 140453 - DNA, 389 bp, Homo sapiens
aagaaaaaacaacagcaacaacaacaaaaaaaaacaatcactgctcttagagatcaaaagacacaaatcagacaatgagggacacagagctgaaagactggtttttcctctacttttagaaaagtgtgccctgccgggtgcaatggtgtgccactatagtcccagccactcaggaggctgaggcaaggagttcaagaccaacctgggcaacatggcaagactctgtcaccaaagaaacaaaaaaagaaagaaaaaagaaaaaaaaaaatgtggccagacagggtggctcacacctgtaattccagcactttggtaggttatggagggtagatcacctgaggccaggagttcgagaccagcctgggcaacatagggagcccctacaaaaa

SEQ ID NO: 140454 - DNA, 602 bp, Homo sapiens
ctcagcagagcagcagattcagcatctcccaggagattgttagatatgcagaattgaagacagtgcttcagacctacagaatcagaatctgtattttaacaaggttccaagtacttcatgtgcatgttaattttggagaagcattcctgtttggttatctagacgtaaatgctcaaatggtgtattgataagtgaaatttaaactctaataaaaacattgttcttttatataattttgtggttttaatctgagactaggcaataatgacactttgttttgctcaatttaattctaaaatatagagtatctattcacaggctgcattctgtctatataactctttccctgtgattagaagacaacgaaaatatactttgagttttgtcagcctaggcactggaaattgggagattgcctatcttctcttttccacatgaagtcaaagcagccacatgaaaaatggaaaaccatgccaagtgcagtgacatgcacctgttgtctcagctactcaagaggctgagcaaagatcacttgaattcaggagtttgagaccagcctgggcaacgcagaaagacccaatcttaaaaaaaaaaggaaaaga

SEQ ID NO: 140455 - DNA, 151 bp, Homo sapiens
atcacttcctggtcccccgcctccccggcgcctctcacaggcttctcctcggcacctccagttttccagttgctcaggccaaaaccttagcaccattcttgattttttttttcctattcctttcacactccacattcagttcatcagcaaa

SEQ ID NO: 140456 - DNA, 544 bp, Homo sapiens
tgggattataggcatgtgccaccacgcctggctaattttgtatttttagtagagacagcgtttcttcatgttggtcaggctggtcacgaacttccaacctcaagtaatccatccgcctcagcctcccaaagtgctgggattacaggcatgagccactgcgcccagcctgattgttttttacatgcatagattgagtttagtatacttgtgataggaatgctgtataagtgcacgtctcctcctcagcacatctcatcaggaggtgcaccatcaatttgttccattattgatatagatcacttggtaaaggtgacatgtgctagaatcatccctgtaaaggtatctttcacctttgaaagtagtatttatctgtaaggtgattctttgagaatatcctattgcccaacaacctttcacccagtagttttaggatctgttgatggttcttgcttgaatcagttacacctctgattgcaaatggtgacttctctatttctatcatttctttgttaattatctggcatttgaagacatctccctttct

SEQ ID NO: 140457 - DNA, 293 bp, Homo sapiens
actagagaggaaaactgaagtcctctcaaaatgttactataaaatttgcaagagtggcaagtgagggaactagaaattgcatagcaaataagcagtgatgtgactgagagcaacagtcagtcataatgaatgcatcacatatcattacgttaggtttgtcctccacacacttgtcatagcacaccctgcatcctataggacacttacatcccaggaagctgtgctgtgcaaggcttgcctggtttttgtttggttttgtttttgctttgctttcatgaatgcagtaacaaagg

SEQ ID NO: 140458 - DNA, 312 bp, Homo sapiens
agttcatattttcatgtgtggtgtggactttatcaataatatatcatgtgattttatttctgtgttttgacttacagtttctactgcctgaatccaattaaacttcagcaaaaacattcaagccaagtgccatgagccagtaaatccaacactctaacacagttaatgaaaattagaattgcatgaaagaggtttctgccagacatttagaaatcatgattcctcagtcattgaatatacagtatctctgtcagccttttactataagacagataaaataacaaaatgttgtttataaataatatgtaccct

SEQ ID NO: 140459 - DNA, 320 bp, Homo sapiens
gtacttttataggcacggtcttatttcatcctccacataaccatgtgggaatgctttattcaatgttttacatgaataggggcaaacgaagatcacagggattgatggcctctttaatgttatacaaccagtcccgcgggggcagggcttaagcccagatgaattccttgtactttttgtttgtttgtttgttttgagatggtgtctccctctatcgcccaggctggagtgcagtggcgcaatcttggctcactgcaacctctgccttctgggttcaagtgattctcctgcctcagcctcccaagtagctggaatcacag

SEQ ID NO: 140460 - DNA, 87 bp, Homo sapiens
aaatagtacttgtccaaccctagaaaacttgatttgtcatctaaggtagttatttctaaggtaggattgcgatgtctggaagctgaa

SEQ ID NO: 140461 - DNA, 255 bp, Homo sapiens
gacaggggcctgtctgcctctccttcagggactctgtgatgggggcaggaacccttgtgtttggggccagagggaactcacacctcagggaggaggctggtagagaactggctgggaggaaagactgccccagccctccaccaaatcccaacgtgctcgccttggtagccaagctcaacatcagacatggttgtccctcccaaggggcagggtgctcatggttcaatggggaggccgaacacagaaaaggtcagc

SEQ ID NO: 140462 - DNA, 383 bp, Homo sapiens
tatgcattctgggcactggaatttttaaatgctcccacagtgattttcatgtgcagccaaggtggcgaactctaatacagttaatcctgtcattcttagttgcttgtcctcctctctgtagtcatcatgtcctctatcctatttggtcctacacttacatgcttatatgctacattagaccgtctcccttctgataactgaaacccctccacagtctcaatttcaagcatcctgttctctaaacatatctcctgtctttctgtaccgctccgtctagtactccagcaacaatcccccaaccttactggggccaacaatctgttaatcctaccacctgacatcgtccttcactgccattgtgtcttcacgtctctctcactagg

SEQ ID NO: 140463 - DNA, 155 bp, Homo sapiens
gtgtcaagtccaagtatccaacctcaggacgctttgcgcagctctgtgcggctccccaggcttggctctagctctgtctccagggctgccctgtgtcctggggaggtggggaaggtgcgccgggtcacaactgtctcccgtgagctctgccagca

SEQ ID NO: 140464 - DNA, 426 bp, Homo sapiens
gcaaatgcagaccaagtcagtccaccctaaatctgaaaatactactatagtgtccagtcaaagaaaggtttacagggcagggacttaaaagtatattattgaagtaacagtcttcaaaaccaaagcttctcagggaaaaataaaaaagaaggaagaggaatcctttggcatttgggtggtgaagatgaaaagaagcaaaagaaaattcagggtcctgcaagaaaaatccagtcaaaaaagttgaaagagataaatattattcatccacaccaacacaaacttcctaaagaatctggactttcttacactgacagaaaaggaagccattgctagaaatcttacaaaacagcacaaaaatgaggaagaaaaggataaacagatccatacagttattaccaaaaaaaagtatcagaaaattcctcttgg

SEQ ID NO: 140465 - DNA, 138 bp, Homo sapiens
ctgtgggatgtttaacagcatccctcgcttctacccactagaagccagtagcatccctcaccccagctgtgtcaatcaaaaatgtctgcagacactgctaaacgtcccagggtgggggtggggggcacaaaattggcc

SEQ ID NO: 140466 - DNA, 132 bp, Homo sapiens
taattccacctcacataaaccttaccctactcccacctctgggaaaagagtgactcaatttaaatgattttctggaatcagccatatgtcagcccagttataaatggccttgcactatccacactctccttc

SEQ ID NO: 140467 - DNA, 463 bp, Homo sapiens
tcatgctttacgtttttgactttttttccagaaacatatatattccatcactcatttattcaacaaatttgtactgagcacccacctacgtgccagacattattctaggtcctggagatgataaagttctaaccctcatagagcatactttctagtggcaaaacgaagactatattttttattgcacacacataacacaatcttattttctgctagtaacactgttcctaatacaccttgacctctgcaaggagaatgttcaggaaaaaaaaaaagaaaaaacccagaaagaaactttcacatgcctgtactcaaaatatttgagaattattgacctaagaaaatcttccctcattgttttcactcattcatttcattgagtacctagtaaagtaccaggcacagtggtaaaaataagacaagtaaaataattccagaagtcagtcagtttataatacggagg

SEQ ID NO: 140468 - DNA, 294 bp, Homo sapiens
aacagaggccttggtttctcccttctgtcttggtgagacagcattgtacagaggcaaaacctgggcttttaagacaggtgatctggcttcaaatcaaagtggcctctaccacttactcgctctgtgatcttgagagagcctctgtttccacatctgcaaaatgggagaaatgatactcagcttacggcgtcgctgtgaagctatggataataaatgcatgcacagagtctgacgttgagtaggtgctaaatacctggtagccatgttgctgtttcagtgatatgtgttgtgagg

SEQ ID NO: 140469 - DNA, 521 bp, Homo sapiens
ttgtggaggtggtgccctgaggcttcaatagagaccctctgcccatcacaaacaaaccccatatcaggctgccaagcatagtggacttcaccccgggggcatctcagccccatgcttgaccggcccctgcctttgcctaggaaccaagtgcctttcccttggggctgggctttgcccgggttgactaccctgatgcttctgctcctctatgtcctggggtggtcttgggggtattaactgtcaccatccagtggagggtttcaccgagggtcccaggtgctaacatgaggtctgtggccagcaggcagcctggatgactggccggataggcagcagggagggcctggatgactggccggataggcccacctcacctatgggctgcacttgcagcacaaactgctgattcatggagactcatgaggccttggctatctgtacattctccatctccagctgtcggccaaaatataattgtagttgtcactttggcagagagatactatgatgtgtcctatctc

SEQ ID NO: 140470 - DNA, 789 bp, Homo sapiens
atcttcgttccctgcagaaccttgacagttgaacaagtgacctcctccagaacagatggagagtctccagaagcagaggctttagtgaacgaaattcgcaataatcagctccagatcctgaaaaggagggcgaagaatcagtggccaaagctaaccgcttcatacccacacttcatcctcctcagtttctctccaggccaccatgtctgcaggcaacggcaccccttgggatgccacctggaatatcactgttcaatggctggctgtggacatcgcatgtcggacactgatgttcctgaaactaatggccacgtattctgcagctttcctgcctgtggtcattggattggaccgccaggcagcagtactcaacccgcttggatcccgttcaggtgtaaggaaacttctgggggcagcctggggacttagtttcctgcttgccttcccccagggatctagaactagaaataccatttgacccagccatcccattactgggtatatacccaaaggactataaatcatgctgctataaagacacatgcacacatgtttattgcggcactattcacaacagcaaagacttggaaccaacccaaatgtctaataatgatagactggattaagaaaatgtggcacatatacaccatggaatactatgcagccgtaaaaaatgatgagttcatgtcctttgtagggacatggatgaaattggaaatcatcattctcagtaaactattgcaaggacaaaaaaccaaacaccgcatgttctcactcatagatgggaat

SEQ ID NO: 140471 - DNA, 901 bp, Homo sapiens
cccggcctgcgtcgtgggactggcgtttttggcgccggctgtgaggggagcgcgggggtggtggaatcgggcggtctccggttcgccaatgtggctgggtccgtaggcttgggcagccttggagttcctcagagaccccgcgctcggtcccggcacgcactcacgccgcggctcctggtggccctggagcgaggagtccgccagcaccggaagttcagggaccgcggagttcccgttggcccttttggaggcacagcttatccctgcttgcccgcgagcatggggccggaggcaccccccggctgcaggcagtctcctgagagctgttaataaaggcagtcgcgggtctgtgcgaggttttctgtgagaaatgcacgaacctcccctaccccacagaacctcaagcgggagatatttctcgacatggggaacggcctcggagaagtaactttctggcctcacagggcagggagaggggcctgggagggccgaccgcagagccgggcctttgaccgcccacaggttccctggttattatttgggtcgaatgcgccaattaaggtggtggctgcgaagtcagtgtcaccagatggccgggagcaggtcgagagccaccggcagggttccccggcggcagggcgaaggaggccgccagtgacttccacggttagctttgtgggtgggtctcactcgatggccgggttagcaaaccagagcatttccctccgtccagggcctgccggggatccatcccatccataggtccagctatggatccatccatacctcattgttcctacagaaccaggatatctgcagctacggctgtacttgttaaaaatcacctcaggccgggcgcggtggctcagatccgcaatcccagcattttgggaggccgagg

SEQ ID NO: 140472 - DNA, 485 bp, Homo sapiens
catgcacaaagttctgtggagcataggaaaagactttctacccacctctgtcttccggggaacttggggtaaggcctcatagaggaggttgcttttggattagagctcgaaggatgaataaatactgccaagtagataagttgagaaaagagtgttctagacaaagggaacactttatacaaaaaccgtagagggaggagaaaacatggcatgattggagagctagaaaggattcagttttgctattgtacaaatctgaatgtggtagatttcctatgaagctactacagccgaagctttggggaccctcacttcacttgcacaggcaccttccaaagcccctatctaactttatatctttataattttattcttagatttttttcttaggagggtcccctttactaatgttcaagttccacaaaagctggatctgcttgtgatggatcaggttgcatgataggaggggggctaggtatacaaac

SEQ ID NO: 140473 - DNA, 554 bp, Homo sapiens
agcaagaagagcaaaactccatctcaaaaaacaaacaagcaaacaacaacaagaaattagccgggcatggctgcatgtgcctggagtcctagctactcgggaggatgagataggagaatagcttgaacccaggaggcacaggctgcaatgagccaagattgcaccactgcactccaatctgggcgacagagtgagactccaaattaaaaaaaaaaaaatttttttttcattaatagactctaagaatatgtgaaagtaaattttttataggcttctccaaatgtctttcactaattaatctaaatatgtattttaaagattttccagctgggcgcagtggctcacgcctgtaattccagcactttgggaggccaaggagggtggatcacctgaggtcgggagttcgagaccagcctgaccaacatggtgaaaccctgtctctactaaaaatacaaaattagccaggagtggtggtgcgcacctgtaatcccagctactcgggagggtgaggcaggagaatcgcttgaacctgggaggtgaggttgcagtgaggc

SEQ ID NO: 140474 - DNA, 424 bp, Homo sapiens
tcctggcacaggctctctctctctctcatgtgcctgataagtcctatacctccagtgacattttaaacttccccaaggcagaatctgctattttcatgcttttacgtcttttgtctacaaaggatactttgaaaagatcaagaatttaataaactttcattaaataagtgaacacatccagaagaaaaatttatagtgagtgttttttttgtttgtttgttttgctggacaaatcttggtccctggttaaggaaattccatttgtacgagactataaatgtgtttttagtcccttaatgttttttattagatgtctttatgtcttagatactgcaaataagtatgctgtgctgtgatagatatctggccctcaacatcagacttctgattgtaccacatactccctctacatgttcatgttttt

SEQ ID NO: 140475 - DNA, 695 bp, Homo sapiens
gatctggactctggctgctgggatgtcattgtccctagaccttctaagccttatcagcagatgatcataatctcatgagtgtttagaattttaaaaggttttaaactgaacttacataagacttctgatacaatgttaagtacacacattcacatttctgattccgatttagtcacttctccccatcctttcttcttctgtttctttcagaaactatcttttctgtcttaaattcccctctctgccttatattccttcttagatacctttcccctctttccctttctttctccttctaggtcacgagggtctgacctaatcattagagggaaaataatctgcttaactacatttttcttagaggcgaatgactgatattagtctaatgaaatgaatggctctaaaaatcctatgtgcagtgaatcaatcatgagctgttgaaaatataaatactttagtcaggtgaggtggctcacgcctgtaatcccagcactctgggaggcagaggtgggcagatcacgaggtcaagagatcgagaccatcctggccaacatggtgaaaccctgtctctactaaaaatacaaaaatgagcggggcatggtggcgggcacctgtaatcccagctactcaggaggctgaagcaggagaatcacttgaacccaggaggcaagatcatgccactgcactccagcctg

SEQ ID NO: 140476 - DNA, 419 bp, Homo sapiens
gactgtcgaccaggttgggcggcagtggcgtaatcacggttcactgtggccttgacctgccaggctcaggtgatcctcccacctcagcctcctgagtagctgggcctacagaaacatgccaccacgcccggctaatttttgtattttttgtagagatagggtgttgtcgtgttgcccaggttggtctcaaactcctgggctcaagcaacctgcccaccgtggtctcccaaagtgctgggattacaggcatgagctgccatacctgaccagaccaagagagttaaaaactactggaggtaagaaagaattcaaagaattgacaattagatcacaaataatatcttatcaacattggatgccagaaaacaacagaagaatgtcttagagaagctccttgtcaacctggtcgacagtctata

SEQ ID NO: 140477 - DNA, 991 bp, Homo sapiens
gtgttggatgtgggtaggctaacaagatttatgctgtggtcccttacgtggcttaatgtgtgccctgtgctgcgggacatttgcttacgcatgcactggaacctgcagattgaggaagaaagcttgtgggaaactaccattcttcagcatgacatgcttacgtttagggatatcgacatgctacaccaagcagtgtacacagtgccactctctttctcctcacatccttgtctggtggaaggaataggaaatataataccataaacttgaataattcatacttctgtaattggggcagagttgagtcagaggatggaaaagaactcttattacttctaagaatagcacctattacagactccttcacccccccgccccaatctctatagtttgaagattaaacttgtatgtgccaatggatgttttccctcattcatgtaccattggtcttggcttttattaatcccatttctctgctcagttgaattgcagtcttactgtacaggcatgatttttgtaacttaagcagtttcccctttctattttgtaattaagagaaataagatcatgtgcgtgaaagagttctgtgaaaggtggtgctatctgtgtgtaggttgttttcatttgtaatcttcattaaaaattacttggctctgaagcactttcagttataaaaagctgccaagtaatagagttgtgtgtgtatgagactcttcatatgttttccttttgacagtaggaaaccattcagctgacagattcagctgcctggaaataataccaccttcgtgttcatctttttcaaaataatagctcagctatctgtaatcccaggaatgcagttttaaattaccagtgttagagcggtctctctattgggcccttttgagttgcgtagcatgctgcctgcagcttgcttatcctcagtctttaggcctgtctgctctggtaactgatgtcctttgcacttgtgagagctggtttacccttt

SEQ ID NO: 140478 - DNA, 407 bp, Homo sapiens
aagtcgaggtgggtggatcttattgttcatggacaaaaagaaagaacatctttagaatttattaagtagttgtttttaggctgggcatggtggctccacctgtagtcccagcactttggaaggcagaggcggatagatcacgaggtcaggagatggagaccatcccggctaacacggtgaaaccctttctctgctaaaaatactaaaaaaattagctgggcgtggtggcaggcacctgtggtcccagctactttgggaggcagaggcaggaggattgcttgagactatgagtttaaaaccagccccaggcaacatggcaagacccccatctctccaaaaactttaaaacattatccagttgtgctagtgcacacctgttgtcccagctaatcaggatgcggaggcag

SEQ ID NO: 140479 - DNA, 473 bp, Homo sapiens
tcataaactaaaggttattattctaaaggttagtttagaataattacttttctagttatttgtatctcttaaaaacttaataaattacatatatactttgttttattattgaatatttgctaaggatatacctcactgatataataatttcatgggtatgtacagtgttcagcacatttaccacaggcaacataggagagatgctggaaaaaattatgaggtcagtgagacttatttttcgtgttctcatatctttttttttttttcttttaagtgacctctcttgttggtgtccattacaaccttaaggctcggaacttccttctgtgggatctcaggcaatgattcatgcttttcccttcctcttcagtttctttctgtcaacatttacttaggcagtatcatacgcctgagctctgctttccatctcctgctacagtaaattaacctgcacttagttattggtagttgat

SEQ ID NO: 140480 - DNA, 330 bp, Homo sapiens
ttaggggtattaaatgcattctcaacttatgacattttcaatttacattgggcttatcaggatgtaaccccatcacaagttgaggagcatctatattagcaaagtctcacaattctttgggtgtgtaagctgtttcctctggaatcctgctgttcctctggaaaatgctgagattcgacacctattatgggtctggggagtgattgtagcaggccttgagcatcccctttcaaaccttatgaggttatcacagtgcttttaagcaaagaagtgtcttttcctcagacacaggagagcaagctaattccattggtaaggaagaaacagagt

SEQ ID NO: 140481 - DNA, 283 bp, Homo sapiens
gcgtgggtcgtttgtaattgaagacagtgcatcctttgtaactgaagctagtgcaaatgaggacaggagtggagggacagaaagcggagaggtgtacagctgctcttcttgcactgtacccctcatatctgcagccgggatcagtcaagatctcattcgtgatgcttgggtgccttgggggcttgggaagccagctcaggccttgtgatccactcggattagtgttgtctggggttctcactttctgactcctggaggacgaaacgccacttgtctgagaggg

SEQ ID NO: 140482 - DNA, 204 bp, Homo sapiens
ctgtgttacacgagaggtaactctgaaaaaattagcatattgtgatctaatctgtcattatcatattttctgccactgaacagctttttgaagtgtaaaatttccttcatagctgaaacttcctaatataaaaaaaattacagcagacataaatcacaaattcacttaagctgtaccaatttacacatttaagtttgatgtctt

SEQ ID NO: 140483 - DNA, 1058 bp, Homo sapiens
cctctgcctcccaggttcaagcaattctcttgcctcagcctcccaagtggccgggattagaggcacccgccaccatgcccagctaattttttgtatttttagtacaggctggtctggaactcctgacctcaggtgatccacctgcctcggcctcccaaagtgctgggattacaggcatgagccaacgcacccggccctagtctcattatttttataggcaattatatttcatgatttttatttttatgaatcggagtattaataggaagcatgaagctagaagatctagatggagccctagaaataagccagtctctgccacaacaaagccaaataggtggccggtttcagtggctctctccagctacccagagctccagggctggtgatccatgtcatcatgaccagacagccatgcccaagcatccagctccaaacaaatgccaggcaaagcctaagtctatagcccaggttcaccaaatgaggatctgggatggagttcagcaaggtcaggcaggctgtgggtaaatgaggttgggggccaggcaggcgatgcatccagcgctgcccactccagctgtcggtgctcactgacgaccctgctccaagagcatctctcagcctcttactgcccatctctctggctgcctcatgggattacttatttctaaatgtgattcctcttatctgtgttgtcaacaccgtgaccagtgcattccaactcttggagagtcacccacagagactgaaactgggaagaattagtgaaaaaggactaggttagccgtcagaggaagaagcccgccctttaagattgcttcctaatgaatctctgggaaaaccctgggacacagagaaacccaaagtcagcaggtctcccttcaggctgggaacataaccaaggaaatgtataaccggagccactgacaggcccaggctgatagaaggtgaaagcagaaaggcaggaagacatgaggtctgcaggaaacccagcaaccctggaaggcggagtcccctttctgggccaccatgctccctaagcagtctttgggttgtga

SEQ ID NO: 140484 - DNA, 241 bp, Homo sapiens
gaaaattatgtctaatgtgtgttttcctttcatataattttttatgtttgtgttaatagttattaaaatgatcagattcattaagtgctattcattgatggcaagaaaaataagtattatcagttggctaattctgaccatgaggtgttagaagtgagtgttaccatcagactattgattaaattgttaaatttttgtaatgatgatcatctatctaaagtgctagtattttaggccaggt

SEQ ID NO: 140485 - DNA, 275 bp, Homo sapiens
aatcgagctcggccccccggtaactctggggaatgcctgcgtctctggggataccggctctctgggcataaaagagtcctcaaaaaaatttaaaggaattaaaatcatataaagcatgttccttggccacaaaaaaatcagaagccaacagcagaaagatggaaaatcccccaaatatgtgaaaactcaacaacacatttctaaacaatatctgggtcaaagaggaagtcacaaaggaaattagagtatatttaaaacagaataaaaaaatgaag

SEQ ID NO: 140486 - DNA, 243 bp, Homo sapiens
catgaaaggtcacacatttcctgatttcaaaacttactacaaagctacagtctagttctgtcataaagacagacatatagaccaatggaataatatggaaagcccagaaataaacctccacatacatgatcaaatgttttttgacaatggtgccaagacattcaatgggggaaagaatagtcttttcaacaaatggtgctggggaacctggataccaacatgtgaaagaataaagctggacta

SEQ ID NO: 140487 - DNA, 512 bp, Homo sapiens
aagtatgaacatagccagtgctgcatcatgtaatagtatgcaattaaatatgtggaaaacactttttaaaagtggagttgttgaatgatgtcatgtgtgtatatagaaagaaaatgcaatatcacttgaatttctatagactccatagacagtagtagatattaacacatgaatgagatggctttgtaatttgatcagttcattcacttaacagcatttatttagtgtctctgatgtgttggacactatgctaatcactggagataagaattgaataagactgtcctgatggttctgtctcccaggggaaatagatgtatggacaattaatgatagtatgattagtgagaaaatgaagtgtgtaggcagtgcaggggagcagggaaaaggaacaatcagtgcctggggaattgaagaccttgccacagaataggatgtgttggtgaattgagtgatagtttaaaggataaaaccaatttttctaggcagaaagggcatttcacaaagaagga

SEQ ID NO: 140488 - DNA, 267 bp, Homo sapiens
cttttttttttttaaaaaaagctagaagcaataatcaattcattagcaaaaagcaccactagcaacgagattgtggtctgaaacaccaaaaggcaccagagctccttggagaagtggctgattccaagtctggagtaggaaacgtaataaaataaactaattaacttggaacatcttatacagagagcaagaaagctattgaatagtctaggattatttccaaaagaactcagaagcaagttgaagggtctcccactggctggccaa

SEQ ID NO: 140489 - DNA, 248 bp, Homo sapiens
cacaagccgataagtgttcattgctcctgcataaataaaatatacgaacattgtcctgaagaaggaaaagcttgcacagttcttggttaatagagtccatagactctgagtaggacccaggcctgttggtgactttccacatttgtacaagcttttccctctttcccttcccctcagtttcctggcaaacttcttctttagaccacctagggttggcaaactttttgagtaatgtgccagaaaggaaa

SEQ ID NO: 140490 - DNA, 464 bp, Homo sapiens
ggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagatgttattagaatgctagttaaaaggacaaagaatgtggttaatactttaattctgtaaacaggaagcaaatagattgtttaactcgtctgtgttgacttcagacctaaacctacaattttaagtgtttgtgattttcttaatgtaaagttctatattaaagttattttttaataccctcaacattctgcacatgagaagcatggaatcagcaattctgaaagtcactggatttagtaattttaacaattaggcagctttctggtcagtataatttaattt

SEQ ID NO: 140491 - DNA, 530 bp, Homo sapiens
aacaattgtaaggaaaatacagtgtgttcacatccatctccgagttttcactaaagttagtatgttaaaaaaatgggacatgggactaatatatttacattgataattttctgtttattcagctctgggatttatttgaattttgccaatttttaacagtttccttttttcctttttcttttctttttgagataaagtctcactttcctattgctttttgtttgtttctttgttcaactcaggtaaccacatcaaattcaatcaccatgtccctctaatatcttctggttaatcacagtttgggttcctgctgtcttcccattgaatattctataaatgaaactagtgaaataagttgattctggtcacttatgtatttacctattttatcacgtttgttttgtcaatcacaataagtgtcgaagtctctatctgttatagatgttagcctattttctattgcagatccattggttaaatctttggtgatgccttttagaaaactgatccctttaccctatgtaatatgc

SEQ ID NO: 140492 - DNA, 388 bp, Homo sapiens
agtacctgggccgacgttcgtactccaatatctagatcatccatgggtgtgcttggatcatttttctttctctttattgtcagtcatattttcctacctttgtacatatctagtaatggttattatatgttggaaattgtcatgaaagaaccacagaggttccatatgatgttatcttccattagagagggttgcccatttcctttgttagacaaatgtaagaaggaactgatgatcacaactaattagagactgaacagttttgggatttggtaatagttttgctaagcctctgtttacatctgattaattcctactcctcagtcatggtgtcctgggcttttgacaaatggtttttaccaagtactcttctcttcaaccctgaaag

SEQ ID NO: 140493 - DNA, 300 bp, Homo sapiens
ctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaag

SEQ ID NO: 140494 - DNA, 449 bp, Homo sapiens
agaatccaggatctctgcttctctcctcacccagaatgtacagagctgcagctcatgtagagaaaattaccttgattcacattcctcctcagaacatgctattgatgattggtggaaagtgggaaagaggatcttagcgcaggctggttgttttaatgcaacagccaagtttttgaaaaactggcaggagaacaggagtttctgtttttttctcagagagaacaaatgtgaccagactatgtgatttaattattctctgggcctactgttttgtaaacagccccatgagcctgttaaagcgaatagcatgaagaccaaaaccttccagcccttctttccatatgccacccttttagtttcatgagttgggttgcgttttccccaaatttaaataatctgcagttgtttgttgtgatgtcttttcctggtgctcctagtgtctcctagaa

SEQ ID NO: 140495 - DNA, 272 bp, Homo sapiens
gctgatgtcactgtggccggcctagggggaaagtctcaggataaaactgcttccacctggatctggagaaggggaagtgactggcaagagattcgcaggtagggctcagagaccaggaggaatccagtctgggtaagaattccctgtcatggggctctgaagccacgggccaggcaggtagtggatttcaagccagccagcggggtcacttggcccctgcagctactcctcgccccctcctgcataatttcctatttcctgcctcctcctcc

SEQ ID NO: 140496 - DNA, 516 bp, Homo sapiens
tcctaagggtgttgttgaggaaactgtaatgtcacctctatagggacacaacaaagagatttctttcaagtcaagttttatcttataatcacgtaataggtcacgcttgctttttgcattggctgttagaaaggtagggccagaggctacctgaagggctgacttctcacactgtacatggctttatttaggcttttatgttgtgtactagccctactcctgactgggtctcatggttactatcctgtttttctctttagcagatttattcatattttaaaaaaaattccattgtgcttttttcttttagttttatagtttcagatcttacatttaagactttaacccattttgagttgatttctttaaatttaatttttgtttcttattgacaaataattacatatttatggggcaaaatatgatgtcttagtacatgtataccttgtggaataaacaaattagactcattaacatgtctgtcccctcacatacttatcatttctttggggtaag

SEQ ID NO: 140497 - DNA, 433 bp, Homo sapiens
atatctggttttggtctttagtagccacgaatatattattttatatcaaaatttcttctagaagcattacttttccaacttgccatggagagtatcgtgtaaaagaactgaggcttgggaactaggatattagggtcacattcttggctttcatcataatttcctctgtgatttttctgggtctaagtgtgcataatgcatacaaaaatgaagactctgaagatgatgagctcttctagttaaaaatctgatttccctgatataggaaagagattttaaatagctaagagtacttaaccaaaacacaggattaaccatttgttaggctttataaattaaaattcactttactatatcctttagaaaagcctgggcattttttcattcagatttctgtataaattcaagaagacatgaaaactctacaaggaag

SEQ ID NO: 140498 - DNA, 148 bp, Homo sapiens
tgctgggattacaggcatgagccaccgtgcccggccagaattattttcatttcctgatctaaagagcatgccaggtgaaaggagcaaaaatttctctaagagaggaaatcaggaaatggggagaggagggggccaagaagcaggcatt

SEQ ID NO: 140499 - DNA, 171 bp, Homo sapiens
tgctgggattacaggtgtgagccacagtgctcagccccaaattcacttcttaattctgataatttatctgtagattctgttgggttttctatacacaatgttatctatatataatgagttgtcttccttttcaattcttacccaccttgggtatttttcttgccttattgc

SEQ ID NO: 140500 - DNA, 158 bp, Homo sapiens
ccgctgcagaatgctgttcaagtagaatgttctatgtcagccacccaaggacactgccacccatcacctcacactgtcatttaattctcagcctgaccctcttctagcagacaccctgcctcactgcatcctgtacaggtccaggcacgtggggctgc

SEQ ID NO: 140501 - DNA, 535 bp, Homo sapiens
tggctgttctagaggtcccctctgggatgcaagtgtcatcacgggagggggtcggggaactatcagtgactgacccgtgaggtggcccagaaggcctgccaggaggtgttggagaaagtcaagctttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacat

SEQ ID NO: 140502 - DNA, 366 bp, Homo sapiens
tgcacggtctcctgggttctcaggtgaaaggtgtcaggtggatcaagtaaatactgttaagatgaactcaagttcagctttgaggatctgtgacatcagagagaggcctggcaagtataaaagatcttgaatggcatacaaagcaggatataacatgggatctgtcagtaagacaactgttcagtgtataaccctgtggcataaaaatatcagacagttatctaaatttctgggtcatgtgactacctttaacaaccattttttggattttttcaatttcagtctaaccagagtggtgactacatttgcagcattaactaagaaacacacggccgggcgtggtggatcacgcctgtaatcccagca

SEQ ID NO: 140503 - DNA, 345 bp, Homo sapiens
acagggtctcgctctgtcacccaggctggagtgcagtggtgcaatcatagctcactgcagctttgaactcctgggctcaagcgctcctcccacttaagcctcccgagtagctaggactacaggcacatgccaccacacccagctaattctttaacctttttgtagagatggggtcttgctatgttgctcaggctggtctcgaactcccaacctcaactgatcctctcacctcaaccttctaaagtgttggggttacagacgtgagccaccaccactggcctgcttttctttaaacctccgtctaggcctttccacttgctatttcctctcctggaacagtcttcc

SEQ ID NO: 140504 - DNA, 405 bp, Homo sapiens
taaatagagaagaatgaggaaatagtattggactgtttctcctagatttcagcaaaggtgtcaaactgactgtgaggttgcaggcagctatgcaaaaatcagttaatataaagaataaatggatagtcagcgctatggcccagcccacaggtcaggtgttttgaatccaggcacttgtgaagccctggattctccacatcctcctcttccacctggacaacatggtaaaactccatctctactaaaaatacaaaaattagccaggcatggtggcacacacctgtaatcccagctacttgggaggctgagacacaagaatggcttgagtcagggaggtggaggatgcagtgagcccagatcgtgccactgcactccagcctaggtgacacagcaagatttggtcaa

SEQ ID NO: 140505 - DNA, 183 bp, Homo sapiens
ctctgctcaacaatgagacgttttcccactaccccagggaatacctttattaatgcagacaaatcccttgacaaaccccattgcaaccataacacttactatatgagaggattgtatcttttgctagagagaatttcctgagcctaaaaatcatgtgagtagactgacaggaatttctctctg

SEQ ID NO: 140506 - DNA, 439 bp, Homo sapiens
atggcccaggctctgccacccccacagctagcacaggacctcacttgaaaatgtgctccattcagcccaacgtgggccccatctcccatcattctgggagctccaggagggacttggtgtggtaccagcctcattccaactccctctaatcacgggctcctcatcctccacatctgacagctttgtggtcgcatcactcctggtagtcttacctctttcacacgctgtactcagtcggagctctcagaaaccttcctgatacctcaggaatcttcctggagcagccagcctctgcctcgctccaacactgctctcctaacagcagcctgatgccccacctcagcctgtgcctctgaagtccaaagttcacacagctgctgctcggaattcctggacgggccccatcgtttccctgtttaccagggtcagacctccatcc

SEQ ID NO: 140507 - DNA, 245 bp, Homo sapiens
tcctctacagagctctgtgttttccactcaacaaaggatagcgaggggccaggtgggggtaaactttataaaatttttgcttggggacctgaatttaaatctattccatggatgagacagcaagttaattagttttcaccctataagtagtctaatttccagggctagtttaaggaactgtaaataaatgtacactttaaatcttttatctcttaacccaatacaaactatggtcttatgctttc

SEQ ID NO: 140508 - DNA, 524 bp, Homo sapiens
ccactcgccaaacagctctaatagctgttccccatcccaaagcaaactctcaagatccaaaatagtctaacaaacaaacaaataagacccaaactttaaggactttgagctttgccaagataggcttttatctaactcctattgggaatgatattcaggctacagatgagttattttagttttgcctttctagagtcaacagaaacactgaagcttaagttttctaactgtccccttgatctgttccctcgagcaccctggattttattatctgactataatagctagaatataggggtcagataaataccgctaacaatttattttttggagtttatattgaaagtgtgaagctatctgttttatgaccttaaattatcattcgtgaggaagatggaagagagatgagggcctgagggggtaggcattagggaaatgagaatttttgacatgagagactgacatgaaaaagtaaccccaaaatattcaggtaataaaaccaatgcattattgatcagcccatc

SEQ ID NO: 140509 - DNA, 433 bp, Homo sapiens
ctctctctgtcacccaggctggagtgcagtggcatgatcttggttcactgcaacctcctgcctcagcctcccaagtagccaggattacaggtgtaggccacgatgactgggtaatttttgtatttttcatagagacggggtttccccatgttggccaggctggcctcaaactcctgaccagaaaggatccacccacctcagcctcccaaagtgctaggattacaggcatgagccactgcacctggctataactttacaatttaaaaaacactttctttcctgtctttcccctcatttgatcttcaaaatgaacttaagacttcttcaaagtgactcagccaaaaagtagtaaaacctaaacttgaactcaagtgtcttgcgacctgagaaccgtttcccttctccacctgggcacattactctccctctacgg

SEQ ID NO: 140510 - DNA, 792 bp, Homo sapiens
gaagaattccccagcatggggtagggctcaatttctcggaaccttccaagccgcctttttttcccagttatcctaaatatatagcgttttatagtgtttctaagcatggggacaaagtgttttgcaccaaagaacaggagtctcaaaataaaatatgggcttcctttggacaaggaaccatggccgcagttagcatgctgggcaggttcctggttcaagctcaatttgaactatttctagatatgcaagcagttttataatctctctccttccccctattcctttcaccattaaaaaaaaaccaggcttataactttgctgactatcaaatcctttgtccttcctgttacatgcgttaccacaggagcctgctcaaagcttttcctttagggagtttcaatagacactacagagagatgagaaggaaattaaactcggtgggggttgcccctgtaccccgaaagtaattccatgattgaaatgccaaaagcccgaacatctctttcgctgtcagacccagagaggagagtgagacaaacttgagttgacgagaatggaactttaatttctgggtggttgttcgaaatcatcagtctggttttggggaacatgactgtctcgaaagtcctttaactctttccagtcccatagctttttctttcgagggtagtggacaagttagtttaccagggaagtcatttattgtccaaaatgaatttaagttaaagctactcatttattggtggtaaggcaaatgggttcaggctttctggaggagaatagccaaatgaa

SEQ ID NO: 140511 - DNA, 404 bp, Homo sapiens
ggggcccagccacagggttgcttagtgaatatgttggggttctccatgtgttccccacattccttgggggagtcgtctctaggcaggcagagacagaggccctgattcgatgaagtgtgcccgcagtggtctggcttgtgtcaggaaggaccgagggctttgccttaggtcttccatatcagagaaacgccagtgaaaatcacaagatgtccctcgacagagtggcagatgttaggaggctggatgctactgtagtgaacactctacgctgtagagtgttgtctccctcagggcagggttctgtctgtctggttcactcctgtgtcctcagtgtggggcgctcagtagacagcttaagaaaggggtttgaatgaacgtctgcacgcatgaatgcgtggtgtgca

SEQ ID NO: 140512 - DNA, 238 bp, Homo sapiens
tgttgcccaagctggtctcaaacttctggtctaagtgatccttctgcctccacctagcaaagtgttgggattacaggcgtgacccaccatacctggcctctttcatttctcgtcaaccaagaattactttctagcagcaggtgtccagtattaccaaatggaatagcatatttgaaaagaagttgtagacttttaatttaatgggcttcattagagaattctgacaccccccatcccc

SEQ ID NO: 140513 - DNA, 321 bp, Homo sapiens
ctgctccctctcatccccactgttggtccagtgaggtggacaacaaagacgtgttaggtttgctccgatatgtagacaggagtaccaactttggggtctgccctggcaccagtacctcttttagcagagacagacagaagttcagagctaaggcaaacactctggagatcatgagtggggcaggctagtggtattttaacaaaactcttgaaaaaaatttttttttgagacagagtctcactgtgtcactcaggctggagtgtaatgccgcaatcttggcttactgcaacctccacctcacgggttcaagtgattctcctg

SEQ ID NO: 140514 - DNA, 249 bp, Homo sapiens
tttggggtattgaaagtatgttgaaaggaaggccagcagaagcagaaatggatgaaacgagaggcaaaatgtctaacagtgacgttgccttgcaatctgtgtatttagatcctgcaaatttacctcctctcttttctactgaaaatgtaaatgaaaggttacaaaaatgccagtaatgaaaaactgtgatatcataaaaatacttattaagacagtcagtagcaccacaatctaaattcagcagtcaga

SEQ ID NO: 140515 - DNA, 298 bp, Homo sapiens
gtgcagtggtgcaatctctgctcactgcaacctccgcctcctgggttcaagcgattctcatacatcagcctctcaagtagctggaaattataggtgtatatcaccatgcctagctattttttttggtagagatggtctttcttaacttccatattttctgaatgaagagaagggaaactgaaataagctaagaacttagacagctttcatgttattatcatgatatagtgggaagatcataggctttgaagttggactataaatccagattcttcaactcatagacttggattttagg

SEQ ID NO: 140516 - DNA, 423 bp, Homo sapiens
ctcctgcctcagcctcccaaagtgctgagatcacaggcatgagccactgcacccaggctcagtaaatttttatattaaatcgggcacagaaaaattttggagtaaaatacaaaattcatacaatttcctatataaaataggagcctacagaaatgttgatccctggaaatactgtgttcttcatctaacattagaagtctggtgtaaaagtgtattaagtacaccaccctcaaggaagaaagatcgggatccttgcaaaaatcctttgtaaagattaagtgacactaggactacttctctgcttaaaggccatggcaagattactggctgcaccttaggtaaggcctagttattcctcacctgggttttcacaactacctaactgcttcctcgacagcagtctttcccctccaaaccacttgg

SEQ ID NO: 140517 - DNA, 458 bp, Homo sapiens
aatataataagtaggtggtttgcagggctgtctgtatttcataatgtgataaactgccctcaggattcttgatatgattgaatttaaaaggaaacgaaaaaaagggaaaatgtactgttctcaattttaaatggatggcatttgaggctagctggacaagaagatgacagaattatagcagtataaaatgtgtaaaattaagggatttcacataccccctcgaaaaagaaatacatacagccaaatacaagctatgtgcctcttagaaatgtagatggtacaaggagacctggaaactaagtggttagggtaaacaagatacagaaggagaaataaagggactaaattaatcatctggtccaatctttaaaaagacactaattaattttggggagtggggtgcagacaaaaaaagagacatacacaagatccagacctcaaaggaaatgtaatgggat

SEQ ID NO: 140518 - DNA, 790 bp, Homo sapiens
tgtcccacctctgacgagttcctccgcgaggaacacttacagacttttcttttacaaagtcagagcttccaggaaactgtattgccaaggaggcccttaatgccaactcattccccaagccctcaattgcaggcatggagggaaaattacgggcattctcagagcccctggtaagaatcgatcccagggctggtacactgagccacgagaatgcactgttcctgtatcatgcagccaggccaggaagctctgttcttccagttcggggagaccccaggggaattcagcgatacttccaagcactgagcatcagtcttttattaccaacaaggggaaggtctgtagcttcctgagctcacaggccagctataaaatcagcgtgaggcagccaggaagcacccagaactcttctgccacagttgtagaattgtaggacccagtgggcaccacctttgtctcctgggcaagtccctttaccttccaaggcctcctttctcccaccctgctccacttttctcagcctcctgaatgaggatggaggcttaatagacatgagaggattttgttttcagttcaatgacatagagttaagtgagctgtcagggaagacgagaggcatagctgctgtgagctcctgagaccctgaaaatgctggtttgcttcacaggtgccatctagaacttaacaggcactttcggaaaaagttggctgaggaggaacctgctggggtattagaagctgccaccagcgggttggtgattgatgttctttgggaactcggtcagaggtg

SEQ ID NO: 140519 - DNA, 283 bp, Homo sapiens
ctagctgttaccaccagactgctaatgaaaatcagaaagtctgcaaacaaaactgccggcttctccagaatcgaaccagaatagcataaatttggaaaaggagccctttccactcagcacaggtttcccccgcagtgagtcccatcaaccaaaatgagatctataaatcctgacaatgtctctgcgactctgcatttttcttcttctaaatcaataaataattgattctgtgtcaatagggacctcttatatcccaaacacagataagaggtacagaccgtcg

SEQ ID NO: 140520 - DNA, 411 bp, Homo sapiens
tacaattaaatccttaataatttccttaaggcacatttttaaaaaagggccttaatgagtcaaagagcattggaatacatcattcgctgatctcattgggcgtggacagaaataaggaacgattgcttgtttggacttaattctgacaagtaataaaaaattgaaaatcatcggaatctttggagaacgactacatcatatttgagcaagtttgtatcttctaatttagggaagcagctttccagaaatttagataaaaggaaattagatgttctagcctgagtctttaaaggggaaaccaaaacatgaccacagggagcctaaggaatagtgcttaaccctgcctgggtctatgggggtaatgagaaggagggagagctaagacgactggcctagatgtatcagtttaaa

SEQ ID NO: 140521 - DNA, 761 bp, Homo sapiens
ctctccacttccttgttgataagggaaatttcctcttttttgtcctctaatcttaggccatgatagtgtcatatttgctctgtcatcacaaagcctttcttgtgtgcttgagagattgcaagatgctatttgcttctcttaggggccagagaacccctttgccacctttatgttcctgtaggctagacacccatctttaagatggttgctgattattcttcaaggaaatcctaggagtcttgctgagttggtttatttttcaggttattattagattagctttatcacatttgcataccacctgcaggcacagctattcactgattccaaaaacctcactgaggtagctacactataaagtgttgaggaactgccactgttagagattaatctgatgtctcacttaagctaaggcagtggtaaatattggattagatcattaaaggcacaatgcatgagagtccattatttaatccattattcaccgttgccttagcttaagtgagacatcagattacaacagtggcagtcccttaatatttcatagtgtagctatctcattagagtgtttggaaccagtgaatgtatcagaagatggcaaggttttctcattcttgattggtactgactcttgcccaactttccttagaataattggtctaaagtcaatttttatgacatcttgacagattgttctactgcactacagattttaagaagaattcaggagaccgaggcaggcagatcacctgaggtcagga

SEQ ID NO: 140522 - DNA, 340 bp, Homo sapiens
gtaactcatggccctgcatgaaacagaacctggaagagagaagaagaatttaaaatgctgttattgagaatctctggaagtatattattccaaggtaccttagattttaaaatttggcctcaccctacacctattttatgatttgtccccactacatcaaactcagtgtatgctcttgccatggtaagcattttttattcactttactggaaatgattgacaaggacttcttcaggatacattgggagagcagtgtttcctatttattatgtcctttcatctctgcctgacctagaatattcatgcttctgtcttaacaggtcccatgttataaaagttt

SEQ ID NO: 140523 - DNA, 455 bp, Homo sapiens
gaagcaaaacccaagataattggttgaaacaatcacttcttttaaactgagtgacccttcaaatatcccaattctgatttctcttcttgctggcctatgtgaagcatcatttattttaactacatttctctctggctgctaaagttacttctcttactttgatcttagctctgaatattaagtctctgcgctcactgtgggtatctcaggacattcccctgggttgccatctttggtgttcagaccccagggatcaactccagggaattctctgggggctggaactgtccctcttatgggagaacttctgtgttgttcttcatgtaacccagatgaggatcaattacttggtgacttgtttaatgaccctccattcaccggttccacctgatacttgtagatgaggaaatggacaaagagaggctagatagcctgcccatgataatccttgatta

SEQ ID NO: 140524 - DNA, 149 bp, Homo sapiens
ggaggagaggtgagggaggtcctgttcctggcgctgcagggcctgtaccccttcctgtccacaggccttctctggccttcccctggggcagctaggggtgtggagcagggcggctgccagtggagccaccgtcaagggaagtgtgggtg

SEQ ID NO: 140525 - DNA, 504 bp, Homo sapiens
tttttagaaatcttcttcttctcctatatgccaagagtttgtacatgctgagaaaattttaaataaatattggagaggaagattgctaaagtaaaggctggtgggtgaaaagaaagaaagaaggaaaatctgcctagggttctgatttagatttcaccactgtcttcttcaggtctcagacaacgtgccaccagcccaaagagcacagacatactaaagcagaggcagcagcttccctgaagcacgcacagagctggaagaaggagaacacattccatacatttttctagaaagtctagtattgctttcacttcccttgagtcatttaggtttctgaaagctaatcatctcccagaaaaaatctaacagatggtaagacactttcacagccataaagagatgtatacaaagggttaagaggcttagaaagaatacgttgtccagtcaattgctagtctgttccagaatgaatcctctctatccacttccttttcatgcaacatg

SEQ ID NO: 140526 - DNA, 989 bp, Homo sapiens
cctctctggcaagcctctggatgttctgacttcagaggggttctggctgcagctttaactcagccatatgttgtgacagctcttggagcagcattacacgggagcaatatccttcctgctaattggatctcagaattcattttcggaccaaagacatcaaataaacccaggaaatacgaagccgtttgcagttatgacttgagacgaattgagttgttcatcctctaaagttgtgttctgttccttatcagcctcatctgaaatctcagacacaaaagcagagatgtttctgccaggaggggcggaaagttcggtctggctttgatatgtgtctggagatgataaacttgggaagggaaatatagcagatccaatcctccctcccccatctccattaggtctttggccttgatagatttcaatatcctgtgcagctgatgtctgacccacgcatcaagaatacagccttcacacacctgccgtgagaagccctctatgaccttctgcagagggagggaactgcctaagagctgctgagtgcaggaatgcagggtgctaagaagcaggtacccagtttggggttaaaatatgtataatatatccatttgaatacccatcaataaatatcagtcatgctcaaaaaaacaaaaaggggggcgacaaataaccctcaagagcacaagaaaaaacgaacacaggatgatggaacaaagggaccccaattgtggatcgaaatttacactatgcaatcgacgacgaataaccacgcggacacgcgaaacgtgacaactgacatggagagaaccaactacgggggagaaatgaacaaccaaacataagatacgcacaaacacaggtctagggaacaccgcaacgagcaaacgacagtaacacaacaacgagcgataagcagaaacgacagcacaaaccagccagaaaaaccaaacacagccaacagaaaaaatgcagaacagaacacaacgcacaaa

SEQ ID NO: 140527 - DNA, 243 bp, Homo sapiens
gggcttttgtcttagaaatctcttttattaactgacacaatttcttgatctgttatgaatgcatgctgttctagtccttcaaaagctcaccacacattgctatggtttaaatatttgtgtcctccaaaactcatgttgaaacgtaatccccagtgtggcagttctgagaggtggggcttttaagaggtggctggatcgtgagggccatgccctcatgaatggatgagtccattcatggattaa

SEQ ID NO: 140528 - DNA, 891 bp, Homo sapiens
cttttcccggagccgcacccaggtcccccaccatcatgcaccccttacccaggcctctgaggggccaggcaccccccaccactcccctacagcaggagagcttagggaggctgagagcttggacagccgggagagggggccggatctctggatctccccagcctccagatctcagtgtggctctctctggagacaaaagctaagactcaacccacaggcaacactcaacacagagatccagctcagaaaaaaaggagctgaccagggaggaatggagaggccaagacacataatgaagactaagaaaaggaagaaagatgatgctggggctggagccaaagggagaggaagaggaaaggaaggaaagccaggggcagagacctggcagggcagcgtgagcccaacaaccacggggtgggggtggggcgcgcatcaagatttctaacaagcgcagctgaaaacacccagggccgttctctgaggccttctctctgcctaccagccctcaccagtgcttcgaagagccctgaggaacgtctctctatttgaagtcagagccgagtgcctgctctcggcacctggggctccatgcttaccaggatggtgggtacttgaccttcatttgctgtgggactgtcagggattccagggacccactggtccccgaactggctcagagatgcaagccacttttacctcctacacatctataatccccaccccatggctgacaaatattcccagtccacagctgtctccacccacccagtgacagagcacaggcagccaaaaggatcaagcaatctcttgccacctcccagcaccccaatacgcaaaattaaccccctaataaaattaattaaccactcacccatcaacaaccgctatgta

SEQ ID NO: 140529 - DNA, 1952 bp, Homo sapiens
cttttcccggagccgcacccaggtcccccaccatcatgcaccccttacccaggcctctgaggggccaggcaccccccaccactcccctacagcaggagagcttagggaggctgagagcttggacagccgggagagggggccggatctctggatctccccagcctccagatctcagtgtggctctctctggagacaaaagctaagactcaacccacaggcaacactcaacacagagatccagctcagaaaaaaaggagctgaccagggaggaatggagaggccaagacacataatgaagactaagaaaaggaagaaagatgatgctggggctggagccaaagggagaggaagaggaaaggaaggaaagccaggggcagagacctggcagggcagcgtgagcccaacaaccacggggtgggggtggggcgcgcatcaagatttctaacaagcgcagctgaaaacacccagggccgttctctgaggccttctctctgcctaccagccctcaccagtgcttcgaagagccctgaggaacgtctctctatttgaagtcagagccgagtgcctgctctcggcacctggggctccatgcttaccaggatggtgggtacttgaccttcatttgctgtgggactgtcagggattccagggacccactggtccccgaactggctcagagatgcaagccacttttacctcctacacatctataatccccaccccatggctgacaaatattcccagtccacagctgtctccacccacccagtgacagagcacaggcagccaaaaggatcaagcaatctcttgccacctcccagcaccccagaatgctaaacagaccctcacatctggactccacatccagcgaggagtgcccctgcccaccacccagatcacacagctgccagttacagaccaccctataggtcccaccacacggccatagcccaccagcatcccagagctgcctctacactaaagctctgtcccagcccagccatccttcaagccacatctggaatagcacacaccctattccactagccaaagcccccaggggtgtaattcagaaggaggcagactgggcctggggcatgtggacaagtccctgacaccacgccctggcttctccggcttgtctgaagaacctgaactgcccttaaggcctgcgcctcccatcccagggcagcccccccgccatacctacactcttggccatgggagaatgtcctcatgtgcggctaaacatcctcctcatgcagccttgaattctgttccttccacgtcacctcaccagacccaggatgaaagccgctcacctagagcaaagcttctgcttccgaggcattcaggactcccctcagggtgtgtgagcaccctggggcacatgcctgttgcttatgtctgggttacctctgtgaccctgggaccgctccacattgaaggccgttgtgtctttttgtggaaggatggaaggacagaagggaaggagagacaaagtggtaccacagccctgttcttgccctggcacttggagggcaccagatacccaggggactgtagctggctgtgaggactctaaggccaggccagcatacacagtccccaatagtgagtaggagcccagtcagtccacaccccttcccatccactcgaaatgtaacttagccctcggcttctccttacctttcaggagttctctccttacccccaaagacttcctgaggaccccctaggccagccagcctatccctctctcccctaacccagcatcctgcagtcccctggttcagattggtggtgtctgtgcctgaacccccacgagcctgaaagcccctcaaaggccacatgggtctcccgcctctctgcatctccagatggtggcacgaggcctagcacacaaggaatcccagaaaatgttggctgaaggaataaatggatggatctag

SEQ ID NO: 140530 - DNA, 353 bp, Homo sapiens
cttcctccagtatgatttggttggtaaaggcagcatgtgcaagtgttgtgggtagagatatatatcatgtgcatgacttttgaaatcattcaaaattgtctttaaattgctgctctgcccttcttagcacataacactgaataaattattcatcctgcttcagccttagtcttcacattgttaaatggggatagtaaatcctaattcccctgactgatgtaagagtgaagtaaggcaatgccaacgcctcgagtaatgcacatctgcttccctagaaacactcattatgtgtcaggtattctgattagcagaggtattgttctaaaaattactatttaatagaattttaaata

SEQ ID NO: 140531 - DNA, 320 bp, Homo sapiens
aaaaggcactgcagcttcctccttgcacacttagatcacacatgtggggaagcagctgccatgctttccgggcactcaagcagccccgtggagaggccatgaggtgaggaacagaggcctcctgcctgtagctgtgtgagggagccatcttggaagtggcttccccagactccgttgggcctttggatgatgctgcagcccctgctgacattctgaccgcaaccttgtgagggaatttgagccagaaccacccgctaggctgtgcctgcatcctgacctttggaaactaagagataataaaggtttgttgtttcagtctg

SEQ ID NO: 140532 - DNA, 528 bp, Homo sapiens
tacctagttgtatattgaataccttttttgttgattaattcatatactttctgtggctgtcagtgtcatttctgaattttcttgattgctctctctcacctaacaaataggagctcatttttgcagcatttaaagtactgtaagctttcttatacatccattgataagaggaataaaactttttcagttcattttctgaagagagagcttttaatttacttcttgttatagaacattaaaacgtacacaaaattagaaagtatactgcaatgaatctattatactcatcacctaacttcagtggttatcagtatatgaccagtcttttttcatttaaaccattgtgtgtgtgtgtgtgcgtgtgtgcatgtgtgtgcgcacctgccataaatgcacatatctatgtacaaacagtacattatgtaaccacctcccgaaatcaagaaacagtccattatcaataccccatacacacttctcatactgtcttctagttaactacctgcccccaccaaggataaccactat

SEQ ID NO: 140533 - DNA, 168 bp, Homo sapiens
agagacacacatggggaagaagtccatgtgaagacagaggcagagattagagtaatgagctacaaggcaaaagacacctagagccaccagaatcttaaagaggtaagtaagcattctcctgtaaagccttcagagggaatgtagtctttccaacaccttgatttcggg

SEQ ID NO: 140534 - DNA, 404 bp, Homo sapiens
gtcaatcttacttctactgtatttttcttatcttcctagggaaaaaaattgacaaaacttaaatgataaactatttttctgattattttctactgaagagaaagcagtgctatctaaatcatctaatactaagtatagctcataggtatcagctctatttttaagaagttaatgatcacttaataaaattaatgaatttattatttccttatatttcactccaatgcaaaaaagttttcatttaccttaaattccaacttgggtttttgttaaaaaattaaactccaaacaaaataagtttattcaaaacgtccttctgatagccttcaatccattaaaaaacctagtttagacactgtagcaattaaactctctttattttttactaatatctttaaaaatat

SEQ ID NO: 140535 - DNA, 490 bp, Homo sapiens
cagggctacaggatgtgcgggccatggtgagggctagagctgtctcttagcactggggaaccaagcgaggcctggataaatgcaggagaattttatcaacaaagttgtccttttaatgaggtcactctgattattacaaaaaacaattttacagtcgggaaaactgaggcttgagctaaggattgttccgaggtcctgtggaatcacacagctagaaggcaagtggtctcccatccgcctgaacctctctgtaatctctaagcaggtgaagggctgttatccaggtctatttgcacacctctggtgatgggaaactcacagtgttaacagttcttcctataggacccaattaacagaggcttctcaaattggacccagctcttccctctagctctgcctggacaccagctgctaccctgccagagtcctattaggaggagcccgctgtgggcggggatgaagtaggaagagatatgagctgtgacggagg

SEQ ID NO: 140536 - DNA, 1423 bp, Homo sapiens
taatgatctaaatattagattctaaagtattaaaaatgaagtgtaatattaaagtacacacaatttgaatttattttcatcaaaaatgtaaagtaaacataaaaatccaaaactaaaggttagcttttgtgctactaaaagttttcttctaaaatcttcagttttctgggaaaaaaggcaaaattcaaagtataactaatgaatataacattcaaataattatttaaatgaaacaaattatattttttgaaaatttaaatcacattaaatatttttataaaaataaaactggtagtaattctagtgttcaatggtgatccaattaccaaagaatccctagcacactagtcactactagacctgcatatatttaactttaagggccataggaattgtttaatattacaagatgttctttggccacgatatgcaacttttggggttatcaaggtaataggtgagtacttctggagcatcgaattagaacatgaaaagaagtagcaaaatggaagcttggcactcctgggaaatgatatctcattatcccttgcattcgtgctgagaggaaagacttgacaagttaattaatttgtctttttcttaactgagtgcttctgctgctcaactcctccctgctctctaaagaagtgtccttctctgatatgggcagcatcacaatccagcctcaaaagaagccaccttgggcttccaagacacaaagcaggggatatggagaggtgtctgcactagagtctggatggtgctactgacaacagtgagtgttcagggtgactgctagtgctgtgcagtgctgagcgccacattccatgggaccacgtgtcctttaataaacatattcagcgtgcgcttatggaactcatggcttctaaagcacaaggcgtatgtttcaagcatagtgctatccctgagcagcatttgtaagcctccagtctgcaacagtgggattacctaccaggctcagctgatggaccgggatgatattggaagagaggctgccagcctgaagacttacctggaaacattttctcgttggtctggttttaataaaatcaccagattccactagaaggaaaccaaagattacaaaggtccaaattaatatatgacaaagtagaaacggaaactgggaggaaatgaggtgaaacacaggggatgatgtattggaaatagggaatgaaaaccgtacagagtagaaacacctgaaagcagttctggaaactccacatgctcctgctgtaccaagacctggtcctatgtgtgctgaccttgttcttctgctcacatctgccacatctgcaaatgtggcaacattttagctgttttctattaacactgaagtactctgagagcttggaaattttcaagtgcaaaatcaggtccagagaacagtaaaaaaaaaaaa

SEQ ID NO: 140537 - DNA, 1465 bp, Homo sapiens
taatgatctaaatattagattctaaagtattaaaaatgaagtgtaatattaaagtacacacaatttgaatttattttcatcaaaaatgtaaagtaaacataaaaatccaaaactaaaggttagcttttgtgctactaaaagttttcttctaaaatcttcagttttctgggaaaaaaggcaaaattcaaagtataactaatgaatataacattcaaataattatttaaatgaaacaaattatattttttgaaaatttaaatcacattaaatatttttataaaaataaaactggtagtaattctagtgttcaatggtgatccaattaccaaagaatccctagcacactagtcactactagacctgcatatatttaactttaagggccataggaattgtttaatattacaagatgttctttggccacgatatgcaacttttggggttatcaaggtaataggtgagtacttctggagcatcgaattagaacatgaaaagaagtagcaaaatggaagcttggcactcctgggaaatgatatctcattatcccttgcattcgtgctgagaggaaagacttgacaagttaattaatttgtctttttcttaactgagtgcttctgctgctcaactcctccctgctctctaaagaagtgtccttctctgatatgggcagcatcacaatccagcctcaaaagaagccaccttgggcttccaagacacaaagcaggggatatggagaggtgtctgcactagagtctggatggtgctactgacaacagtgagtgttcagggtgactgctagtgctgtgcagtgctgagcgccacattccatgggaccacgtgtcctttaataaacatattcagcgtgcgcttatggaactcatggcttctaaagcacaaggcgtatgtttcaagcatagtgctatccctgagcagcatttgtaagcctccagtctgcaacagtgggattacctaccaggctcagctgatggaccgggatgatattggaagagaggctgccagcctgaagacttacctggaaacattttctcgttggtctggttttaataaaatcaccagattccactagaaggaaaccaaagattacaaaggtccaaattaatatatgacaaagtagaaacggaaactgggaggaaatgaggtgaaacacaggggatgatgtattggaaatagggaatgaaaaccgtacagagtagaaacacctgaaagcagttctggaaactccacatgctcctgctgtaccaagacctggtcctatgtgtgctgaccttgttcttctgctcacatctgccacatctgcaaatgtggcaacattttagctgttttctattaacactgaagtactctgtacggttttcattccctatttccaatacatcatcccctgtgttcacctcatttcctcccagtttgcgtttctactttgtcatatattaattgtctgacc

SEQ ID NO: 140538 - DNA, 663 bp, Homo sapiens
tgaacaaaagcagatagagggtcacaggatatttattaggagatgattctggggttttgttttggttttgcttttttcttttttgtgtgattcagttttaaccggcatacagagtccacgaagaggaggctgagaagtgattaggaaagtaaaatggaaccaggttatgaagagccttgcacatttcagcgggtcaaatgcaagggcttgtgttttccttggtaggtgggagaagtcacgaagggtttcaaatggcatatgataagggcatagctagactttaggaagatgcactcagcacagggagtttttgattctgactctgtaaggtgctgtagaagtttagtgagtttgtatttaaaaggacttcagaggagaggtaatttagcagcagcttctaagccctgatttgggaccaagaacacaggagcctctttaactgtggagctgctctagttgaaggtggggtaaatgttgccctcttagtctcatcagtggtctgacccccaagcactgaaatctcatttagtaaaagggttttgctggaaagagtgtttaaaaactcagcaagctagcaatatactattggttgtctttgagtggagatgggtgggagaaagctgtttagttagagctcttttgtaataatcttagcatggattg

SEQ ID NO: 140539 - DNA, 336 bp, Homo sapiens
tgatgctcaggtctggggactcacttggtgtagccagcgctggctgttgaaaaaggcaatgcgtgatttctattccaagcctttctgtgtaagagaagaaggtactcttgtgtcctggtgtccgctagatgcaggcaaccccctcccatcactaaggcgtgttctggggcactgctaccctcctgagagcaccctatctgagagatccctggggagtttccaacagctgaacctctggtggacaaaggctggccagcttctttttccatgaagtgcaggattattcctgggagggaagttagaagacctgaaagccagagacctgagcaagccagg

SEQ ID NO: 140540 - DNA, 276 bp, Homo sapiens
cagagagtccagagaaacagggagtgagacccctttgggtcctggcccttgcttttattatagtttgagcattttgtcctccttcccacagatagagcagatgtcctcaaagatgctctgtatttcagccttcagggcagctaagaagccatgagtgacttaggctgccctggccatgaacaccggagccagactggctggccagactgattcccgcatcccccatctgtgttttgaggggaaatctcaggttttgaggaatgaacatggcagcta

SEQ ID NO: 140541 - DNA, 844 bp, Homo sapiens
gcgacaaaacaccgaattgttctttttgaactgacaggcttactttgttcttttttgagaaaagtctgacagattcccaagtctgaataaccagagcttgtcactctttctttcaaataaaaatggtatttcatgaaaaatgaggctttccccccacacacacagttgcacaggtgtttttccctcaaaacaaccattgtactttggtatgcagtatgagtgctttttatgcactttccatttcatcctatagagtactacaaagatgtgtacttcacattcaagatttaatacagttaatagttttactgcttcaacgaggacattcttaagtgaaagtggctttttttactgtgagtgcatagtggtaatgacagtaatgattactagtagtttgatgctactgccatgattcaagttaaggggccagctgccttacccatcactgcttttacatcatcaatgaaaatgtcaacacagtgaaaaaagcaaataaataatattgttattacttgaaatcacagatttccttaaatggacttgggcactatcaggggtctgcggacaaacactttgagaaccattggttttatcagactttttgaagcttctctcaaacagtgaaacctatcagagataggacgttacttacatgaaaatataaatcatggaacctgaaaatgtaggatatatttaaattattattattatgattcctataattctacaaaatttcaaagattgtttttatgatgttttacagctctggtaggaacaaggtgttggatggatatacttttattttttttctttgagtgcattctttccaaatatttcagaaaag

SEQ ID NO: 140542 - DNA, 135 bp, Homo sapiens
ttctcagtgacctggcaacctaacctaacagctgtgtccagcatcaaatactcctcctcatcccctgctcttgctccccaagaccaggagcaggcgctggagtgctcctccctggggctgggccacaggccttaa

SEQ ID NO: 140543 - DNA, 272 bp, Homo sapiens
gaactgatcagcagagcccgaagcatcatgcagcaagatggcatctcctccggacacgggagcagggcagagctgaggtggctcctctgtaggctttacgcccctgaggtgccctggggcggctggcctgggactgcacccactgtgacaggcttctgatcaagttgcaccctgcagcgctctggcctggctccctccacccaaccccagccatccgttgcctttcctccggggtggggccggatgcctggcagctgagggtagttctgacg

SEQ ID NO: 140544 - DNA, 378 bp, Homo sapiens
ggatcctagaatagctgtattttccatgaagacaaaacagcatctaatgccaaaagccttatcatcagggcttgaatagcgccaacatcgagacccgacattctacacagtcttacctacatgaaactctacagtattttctcttttaaatctgtaccttttaatttataatttacaaaagctattttattacttaacacatggcataaatgtagtagaccatgaagataaaatgttttcccattttgttaactgtagcaggaaataatataaactatagccaacgtattttgcctgtttatttatttctctggcattgtttagtacttctatttgaaaaatgagagaaaaccttttcactttggaaggctgaggcag

SEQ ID NO: 140545 - DNA, 392 bp, Homo sapiens
gctttggggtctgtttctggtgtgtccatagatctgcctctccatgccacagagcggtgactgttctgatcatggtagtgactgttctgatcatggtagttttatcatgttttcatgctcaaggaggcaattccacattcacacattacttgtttgttgtttcatggacttcttttcacatttccctgggaagaactagggaacatgcgatggaggtgggaagaagttaagtgggtggcttgagggttgtatcacaaaagatagaagggaggggagaaaggaggatcttcttatctgagcccaacgctctggggaagccacccagagtgagtgagtccttaaatagacctaaatagaatccttggaattgtctgtgaggactcccttggagc

SEQ ID NO: 140546 - DNA, 311 bp, Homo sapiens
ctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtg

SEQ ID NO: 140547 - DNA, 311 bp, Homo sapiens
ggggaagctggaggaggcactttctggtaaagaaagcaaaagccagcagtgcccaggccaatttcaacagggagttaaatagcaccttaatcctgtggcaggacagctcatggggccatgtgtgctcttagaaagactcacatgcacgcatgcacggcagcaatgactccatactcacgttcccctgcagacaccaggcccccacagccggcacacacactgcagccccagttccatgttgctagcagtggcttagtgaatgagtaaagttcttaaaatgcaggggacacctgcccttcattcataaggct

SEQ ID NO: 140548 - DNA, 384 bp, Homo sapiens
gggaaaaagacccagagatcaaatgactcactcaaaatgacagtcaatgacagagcagggcctggggccttaggactgattatccaaatgccatcagaaaacgagctaaatcagaagcacctagtgagcttttaaaaaataattctacagggcacaacccctgagattctgattcagtaggttttggagtgatgcctaatattctgaaaatgccaaaagctcaaaagatggttctcttgcttggccaggtttagaaaatgctgtgtcccacattaccaccttcactcatatgacgactgtagagaaaatcataaaaatctggtgctcaagtacgtttaaatttaatataaagcaccaggcgtggtggctcacgcctgtaatccc

SEQ ID NO: 140549 - DNA, 232 bp, Homo sapiens
tgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcgggg

SEQ ID NO: 140550 - DNA, 237 bp, Homo sapiens
gagccccaagatttagtcacaagcatgttaaagctcttgggcagctctgatatgtaaaggtcagaatcttaattatgaaagaatgagatcctgtgacatgtgattggaacacctgagttgacaaacttaaaaattttgaaccctctccagattctcctaatactgcagaagtagcctacccatatctactaagatctgggtatattcccttagttgaagatgatgcaggacaaaagg

SEQ ID NO: 140551 - DNA, 390 bp, Homo sapiens
gtgagaccctgtcttttaaaaatgttgagcggattagtttaaaataatgactgcaaagtacatatgagcccaagaaatagggaggaggcgttggctgcatcggggggaggatggtgccttgagtgagcctgccagggtgtgctgaggccctccccaaggccacttgtctttttgttgtttctctggttataaaaatagcacctgctcttcattggctcacgcctataatcccagcactttgggaagccgagagaggtggatcacaaggtcaagagattgagaccatcctggccaacgtggtgacatcctgtctctactaaaaatacaaaaattagttgggcgtggtggcacgcacctgtagtcccagctactcaggaggctgaggcagga

SEQ ID NO: 140552 - DNA, 267 bp, Homo sapiens
gccaagtcattctttttttaatgagcatataatagttttgtggttcttgaaaaagttcaacagaggcttatcacatgccccagcaactgaactcctaggtttatacacaagagaaatgaaaatgtgtccacataataatttgtatgtgaacattcatacagcattattcataacagtcaaaaggtaaaaacaactgaaaggtccaccaatggataagtagataaacaaactctgttatagtcatgcaatggaatattactcagccat

SEQ ID NO: 140553 - DNA, 132 bp, Homo sapiens
acatggccacctccgatcctctggggaaccccatgtgctgctaggaaaacgagctgggaggaaaaggacagaaggaaaatggggaagcagtggtagaaagaaaaaaacgcacaaacaggcactagatagata

SEQ ID NO: 140554 - DNA, 344 bp, Homo sapiens
ctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatggatggatggatgaa

SEQ ID NO: 140555 - DNA, 366 bp, Homo sapiens
ctgacactagtccaacctgttgttatgaaatatttcttacttacttgtgacagtcctcactgattggtgacatgttaaatttgacacttctgtccagtctccaattttcccaaaagggaggtaattgtttcttttgttataagtactttgtggattcctttgttagaccttgttatattgtacttgtttgcttagagcctatctttttaaataggctatgagcccttttaaaacaaaaatcatggttatctctgtatcaatatctttctgtacaaattatttctgtacaaattaatagacaaatagaaacttttaacaaatgttccttctgttctcctttgtccatttggggtctagagaattttt

SEQ ID NO: 140556 - DNA, 443 bp, Homo sapiens
  misc_feature (44)..(44): n is a, c, g, or t
gggtttatcgatgccacttcacaggctggagtgaagtggcacantctcaggtcactgcagtctcgacctcccaggctcaagccatcctcccacctttgtgcccagccatgacgttttttcttcttttttagcctgaagctctatcccatgtcagtaaaacctgcagctagtctttcctgtcttgcggagcaaatctgcagcagtgccgtcttagctctattgtgaggatctgttataccagcacctgttaacttgcttggcatttggagaagctaggtaaatgttgtgtgaatgagtaaatgaacgaacccaaccaagtatgtcccatgagccaagtacaaggggaagagtggacttttttcctgctcacactctccttcattgttaggaaaggcacatttttctacccaaggcgtaaactccaagagtggatacaatggaca

SEQ ID NO: 140557 - DNA, 318 bp, Homo sapiens
gctgcctaaacccagctagctccgggttaaaggaaggcctggaacccaactacagtgcttcctgacagtctgaccctaccactgccagcccctcttcaggcccaaggtactactgggttgagtagcagctgcttcccctccctgggagaaagctgggaccgggactctgcctgtttcctcccattagcacttcctcccatttctgactttgacacatctggctggtcacttagtaccaaaaggtcctggtcaagcagcaggggccagatctggacggtcctaaaacccacagctgggaagggaagatggccagaggtg

SEQ ID NO: 140558 - DNA, 178 bp, Homo sapiens
tgagccctccaggacgctgggtcagacaaggtcttgaagctcctcatggggggcactcatttgagtggggatgtggctcctggagagaggggcttgcccagggcttgaggcttccctgagccctctcaagtcgggtcctggcccagtctgcccatgaggctgggcctgagccccagcc

SEQ ID NO: 140559 - DNA, 236 bp, Homo sapiens
agatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggt

SEQ ID NO: 140560 - DNA, 360 bp, Homo sapiens
cctgaaacaacaaaatatgtgtgttttttaaatgtgtttttgctaaaaatagctttccccttaaaatttgttttaaaatcaaaacatttattatcctttatctgaaagattttcagtgagctgaagcagaacaaataattccaagttcattgacccgaaaacagtgttcagctattaagctaatcctctcccagtttgaaagagacccagttaaaggtgtcacagtagtctctggcatttgtggcttccagagcctttagcaaactcgatggtaaacttttcctaccacgttcttcatttatttttggtagtgctttttcccttttttttttttttaagacagagtttcactcttattgc

SEQ ID NO: 140561 - DNA, 324 bp, Homo sapiens
agtttagttgattgcttagtattggcacattttgactctcttctcatttcatttccttttcttcttagatagtttttgtgttaccatggagattacatataacattctaaagttatagcaatctggtttgaatgataccaatttcacttcagcgacatacaaaaattctactcctatatagctctttttccatcattttatgtaattgagatcaggaattacatctttatgtgttgtgtatccatgaacagattcgtaagtatttttaatcctttagaaaataacaagtagagttataagccaaatttacaataatactctagt

SEQ ID NO: 140562 - DNA, 977 bp, Homo sapiens
agtttagttgattgcttagtattggcacattttgactctcttctcatttcatttccttttcttcttagatagtttttgtgttaccatggagattacatataacattctaaagttatagcaatctggtttgaatgataccaatttcacttcagcgacatacaaaaattctactcctatatagctctttttccatcattttatgtaattgagatcaggaattacatctttatgtgttgtgtatccatgaacagattcatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggatttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttcccccaccaagaagctggccaacaaaccagataaaaacagttcttccgagcagtgtgttctagcgcacgcttacagaatgggaaaaaaacattctggaaggacagaacgactgggaccggtgataccacggggagaatctaactccgagtcgagggatgaaccccgggatgagaaccggagagtccgaaggcttgcgaaaggaccggacctcacggaacaaggccggtgcccgatgggggagagaacgagcaattccgaagacccaccgttgaaaaaaggggggccgggaagaaacgggaacac

SEQ ID NO: 140563 - DNA, 270 bp, Homo sapiens
ctgaggtgctgcctgtaatcgctttgtgggtaggtctgcttataagaattcgcaaagaggagttcctctgaaactccctagccccgggaaacagaaagaagaacagtgctggggcttctcttcctgttcctgtcttttccttccagttcccccttcccagaatttcctgtctctcaacctccactctgttttctccgccccagtgttcccccactctctttcatttttattgtcttaaatccacttctcccacttattccagctttctgg

SEQ ID NO: 140564 - DNA, 273 bp, Homo sapiens
tgaacattttgttattagcatatagattggatgtatgtaggaacttgtaaagtgcctgaggttccttgaaaattgtttattctgtgtctaaaatgtgtacataagactgaaaataaatgtttaaaacaccatatattatccacctataaataaagtatttacaaagcaaaagtaaatgtccacccagctcatgaacaaattatcgaaagattttaaatttattgaagtcccaaattaatgagatattaccatgtgtgcataaataacttaaag

SEQ ID NO: 140565 - DNA, 515 bp, Homo sapiens
ctgggctcaagtgatcctcctgccgcggcctccgagagtgccggggtcacagctgtgatccccgtgcctcgctgttgttctctttctgttgagttggcagtcaggtccttgattcttggtggctgagggtatctcagtccaaggcaagaatcccacagaaagagactgggacaaatgaggccagaaatgggcctcgcccatcactcttttccaaaatgggctttgtcagtcactcttcctatacttgggtcaccaaacctgatcaccactatgtgcaaagtgcagttttagttttcaaagaagtgacactatacttaagaatacttaagaacgttaactgcgttaacctccacgcacacagccatagacaaattcccccgtcagacaggagcccattaggaaatgcccacccctctctgtagcctttgtaaaattaagctgataaaagacatcgctgttgttgaggtttaaaatcaatggataaccaggaaagaatataagaaatcatattaatt

SEQ ID NO: 140566 - DNA, 330 bp, Homo sapiens
agccatcctgcatagctaaattataatttaaaaagttaaaatgaggctgggcatggtggcttacatgcctgtaatcccagcactttgggaggccaaaacgagtggatcaccaggtcaggagttcaagaacagcctggcccacagagtgaaaccctgtctctactaaaaatacaaaaaaaaattagccggacatggtggcaggtgcctgtagtcccagctacttgggaggctgaggcaggagaatagcttgaacccaggaagtggggggttgcagtgagctgggattgtgccactgcactccaccctgggtgacagggtgaggctccattt

SEQ ID NO: 140567 - DNA, 340 bp, Homo sapiens
cctagggaagccgaaggagattttcttcaactgtccttagaactcacattcttactctaactatgatttttgtgctttgtcacaggtgagtcaatagggataacctgggataggtgctctcccagcacctgcttcctcagctgttaaaaaatagtctgtgattctacagagacacattgcataggttgacgcagaaccataggataatataagcttctgtgacacacagactcccaaacttcaacagtttaatcacagtagccattgctttctggctcatgtcacaagccagggttgatgtaacaatggaactgggtggggtttgggggatgcccctcct

SEQ ID NO: 140568 - DNA, 382 bp, Homo sapiens
gcccagggttcagtttgtatgtctgcaagatggggatagtaatgtctgtcataactatttcaaagagtctattgaagaagaaaaaaagtgacacaatgtgtagctcctccacacaccctgtcgggcagaaaggttgctactaatataattccgaagagttttagttttgcttgcacggagggcaaatcttcctttctctcatatgtctccaacctcctagagaagttaagaggggcaaagaaagttctggccattacatcaataggaaaactgagaaacagacaaatacagatgctgctagttgaggaggaaaatgatgaggccaagctcatagagccgctcctgataggttctagagatgtagctgactcaggatagtccc

SEQ ID NO: 140569 - DNA, 366 bp, Homo sapiens
gtttttatttcgtggtgaggctagagagtatgaagcacctgttacatagcttgcagttgtatcaaggatagagttactgggctgggcacagtggctcatgactgtaatcccagcactttgggaagctgaggtgggcagatcatgaggtaaggagttcaagaccagcttgatcaacatggtgaaaccgtgtctctactaaaaaaatacaaaaaaattagccgggcatgatggcacattgcctgtaatcccggcctacttgggaggctgaggcagaagaatcgcttgaacctgggaagcggaggttgcagtgagccaagattgcgctattgcactccatcctgggcaacaagagcgaaaactccatca

SEQ ID NO: 140570 - DNA, 164 bp, Homo sapiens
gccagctgtgtgcattcataggtgacagccatgttcggcacattccttgcttcacttctctgtccttctgagtcactggggattgagctagaaaactctggccataccagaggtctgatccttgccattttgcgcaacctcagcctaggtcaaagactggacag

SEQ ID NO: 140571 - DNA, 480 bp, Homo sapiens
tcttgtctgcctcgtgtccacactattcttcgaatcataattagatcacatcgcattctgcagaaagccttctagtgggcacccctgcaggtaccttggcttattaggcccctttacactctgacctcttcccctgagacatcatatccaactaggctgtcttgttcttcctgccccaaccctcacctctcagcccactggcttcattttggctctaaacacaccaactgagaaagtgaagggacttcaagtagatgtcccggagggctctgaaatgtgccctctactttgggaagcctgataaatctaacagaatgcactgaatctgattggggccaggaactgggaagaacaatgaaagggctaagtgttcctgaggtagagccctgagagcatggtctaagggctgcgccagtgtttccctggaccagatgtgtgccgggggaagagattttacctggggaccaacagggaggaaaa

SEQ ID NO: 140572 - DNA, 454 bp, Homo sapiens
atagtatacatcataatcatattgcgtgacgaacgactgctagtgtagcaactcagatatcggcgctggagtcttataaagtcgatctgcacggcttgcctcttcccctgagacatcatatccaactaggctgtcttgttcttcctgccccaaccctcacctctcagcccactggcttcattttggctctaaacacaccaactgagaaagtgaagggacttcaagtagatgtcccggagggctctgaaatgtgccctctactttgggaagcctgataaatctaacagaatgcactgaatctgattggggccaggaactgggaagaacaatgaaagggctaagtgttcctgaggtagagccctgagagcatggtctaagggctgcgccagtgtttccctggaccagatgtgtgccgggggaagagattttacctggggaccaacagggaggaaaa

SEQ ID NO: 140573 - DNA, 519 bp, Homo sapiens
tgaaaaaattacagacaccacagaattgcaaagttctctaagtattaattaaaatcctttaaagtaagtaaatattctttaaaaaaaaatctggggacagtcccttaaattagcatgggtccttgaatgagtaggatgtgatttaccttccagtaactgtgttttttcaaattagatagcttggattgttacctggtttactgaatggctatgcagctttctttgcctgataattattttgaaaagccggtgctttgcatatgataggcacttggtatttgaatgaattgaaacatctaataaattctaaaattcagagagctttcttaaagtgattgacagaacctattgatgtattcagtctaatcagattgtcatttggctctaagattaagccaatgatttaagtacatggttggccactgacctacttatattgatagatacaaaaattaagaaatcttcataaaaatagttttgctgtgctatatatttaattgtctttgtcttaaaattcaa

SEQ ID NO: 140574 - DNA, 230 bp, Homo sapiens
tgaatacaataggcatttgcagcacaatggtaagtatttgcatatctaaacaaacatatctaaacgtacaaaagatacaataaaaatatagcattataatcttatggggaccactattgcaaatatgtttcatcattaaaacatcactatgcagtacatgactgtatattgaaaaatgactctcaattcatacaaaaccacatccaggccatcatcaatcattctatacg

SEQ ID NO: 140575 - DNA, 496 bp, Homo sapiens
tccttccttccctttcaagttaggggtaccatttgacttgcattggccagcaaaatgtggccatacatggcaattctgggcagaagcagttgccagtatgggacagttcagtgctctcttttcttgccttggtgatggtgaaagtttgtgagcaggtggaacctctgtcaatctgagctcttgaactacaatgatggaaagattgcccctccctgacccttgttggacacacagcataaaaaataaatgagcttttgtgaggttaagccactgaaattttgggggttagttgttcatgcagcagaacccagcccattcttactgccttaatagtcatttaatacatatgtattgagtatttaactttgtgctgggcactgttaggttggggatataacagtgaacaacacagaagtctcttctctaatggagattacatctatgagggagacataataaataaactaagataattaaatattgagataagtgctat

SEQ ID NO: 140576 - DNA, 584 bp, Homo sapiens
atttttctggccacgactcgcagttcataaaccctgtgcttctgtaagtcagtggcaggtatgagtgaataatggtctgtctgtcctcaaacctcagtataaaaggaaattgaatcctgcctctttatctactgtttatcctcgacacaccacctgcaagtgcttgttttgggtagtaaaacttcctgcgtggtcacgttgttcattttgatttttgatgcatttactaatggaattactgggtttggagacataaccataggtaatttatctctgagggtgcctgcttggaaaaataactcttgactgtgtgtatgtttaatgtaaagaccattaacacttttatctctaggttatttaattcagatatttctctgcacacagaagagtcatacaagaaagccccctagtactgtacaagaaaactggaagaacaggtcagaaggaaaaacgtttctttcacatattccacattaaattatattctctaaacacatgtcaatgtgttaaatttaatggaagaatagtagtagttagattttgagaacagtgtcataatagtcataaagctgtctatttcagga

SEQ ID NO: 140577 - DNA, 778 bp, Homo sapiens
tctcagcctcccatacagctgagactacaggtgcttggcaccatacctggctaatttttaaatttttttgtagagacggggtctccctatgttgcccaggctggcctcaagtgatcctcctactttggcttcccaaagtgttgggattacttgtgtgagccacagcatccagccatgttaatgatttctaatttcatttccttgtgtttggagaatatccttttaagaatctaatcttcttaaattgcctgaggcatgttttacagtctagcatatgactatgtttcatgtttacttgagaggaaagtattctgctgttgttgggtgttgttttacagacatgaggtatacagtcagtttacagtgttgctcaagtcttctcctgccttcatctcctgcctagttgttctatccaagagaaacagtttctgttgcttagttttttcctgtgtagaggtcacacttccttgttctttccatgtcttataatctgtggttgaaaaattggacattatagataacatattgcagtagctctggaattcatgtccttggggactgatcttgtctttttggtggtttattatttttgtttagtgacttagctgaactaactgtaaagtctacttcccccatagtgtgcagcccctgtggccctgctcggatgtttttactttttttttttttttttgagtttcacttttgttgcccaggctggactgcaatggcgtgatcgccgccgcctcccaggttcaagcgattctcctgcctcagcctc

SEQ ID NO: 140578 - DNA, 535 bp, Homo sapiens
ctgccaacgagtcccaactacatgcctcaaaacaaactcatcatcttaccccaaaacctgctcctagctcagcagatggcaagacaatccaacaagtaacccagaccagaagcttgggtgccatccttgactcctctttccctcatcactccagttactgagaccttttccactctacccatcccctccataccctagcagagagtcctgtcggctctccccagcctggggacggttcctccactggccatgctgtctcccatcagtccccgcactgcagacaaaaagcacttttaaaaatgccaatctgggccgggtgcagtggctcatgcctgtaatcccagcactttggggggccgaggtgggtggatcacttgaggtcaggattcgagaccagcttgggcaacgtggtgaaatcctgtctctactagaatacaacaaatcactaggcgtggttgcacatccctgtaatcccagctactaaggaggctgaggcaggagaatcgcttgaaccaggaggtggagtttgcagtga

SEQ ID NO: 140579 - DNA, 105 bp, Homo sapiens
agatccttaacttaatcacatctgaaagaccccattttcaataacgtcactcacaggtacaggaggttaggaatgcattattgaactcactactcaataattttg

SEQ ID NO: 140580 - DNA, 177 bp, Homo sapiens
tgagtgctacaaggggacatgcaatttcagataacctccttccaccatctcatggtaactcacaagcgcaagccttcccatacccttgattcagggctcttttcttatatcttattaaacattttactaatcttttataatccaaacaactggctgatgagaaatctcaccttcaag

SEQ ID NO: 140581 - DNA, 261 bp, Homo sapiens
ccgccttggccaccgaaagtgctgggattacaggtgttgagccactgcacctggtcattatgttttaaaattacatacaagttgttaaaaaaatatgaacagcagaaatagattttagaaaaacagaatgaaattatccatctcttcccccatttagtgaatatttggagtatttcttttcacactgtaggtattataattcctgatttattagaagcagggagtggctgggcgtggtggctcatacctgtaatcccagca

SEQ ID NO: 140582 - DNA, 401 bp, Homo sapiens
aagatcttcacctcatgaccttcaacactgtgaatcaacaatttgggggatttcaaagacaaagggcaaaaattaccatcctgtttgtcacacacacaacaagaaaccagaccaggatgacagaggtatgactggaattcctccctggacccagtgatattttggaaaatcccatcgatggcatgatttataaattatgattttccaaaatgttgaatatttgaatattctttttcttttcttttctttttttttttttttttgagacagagtcctgcttgttcctcaatctggagtgcaatggcgcaatctcggctcactgcaaccttcgcctcctgggttcaagcaattctcctgtctctgcctcccaagtagctggaattacaggcatgcaccaccat

SEQ ID NO: 140583 - DNA, 157 bp, Homo sapiens
gctgccttcacctccctgttcttcaggctgtaaatgaggagattcagcatgggagtgatcacgctgtactgcaaggagaagatcagctcttgaatggatcctgaatttggcatgagatagcggagtaatccggagccataaaagaaaatcactgcag

SEQ ID NO: 140584 - DNA, 541 bp, Homo sapiens
ctcagacagccctgatagccttctatgtatatttgtacaaataacaaattcaagatttgttttcctcttctctaaaaaactttgtttactcttttgacatgatacatttcctttttgttatagaaatggttcatagtgctgtaccttaccctactaaaactgcaaatcacctggctagctcttgtcatacagcaaacacatattattgttactattagttagtcttctcattctttgataaggacccaacccaagaaaaggctaaatatagtccattatcagtaagaggcaaacaggaatcaaggttcaagaacttctgactcttagttctatgaatacgcatctcacaaaattaaaagcatttttcaatattgttaccatgttgacaccgttaagtttgtgacaacacatttacttcacacagtccactctaagttaattccaatattacttaagaaactttaaaaaatgctttgtttcacaaaagtcttcaacaggggccaggtgcagtggttcacctctgtaatctcagcactttggg

SEQ ID NO: 140585 - DNA, 766 bp, Homo sapiens
tcattttacccctagtacttcatgcatggtaggtcctcaacagatacttactgaacaaatgagtaaatacttgggtgtcacagaatagtgtaatggagatagtctttcatgtgatgtgcctttttgctcagtttcactacacttatttaaagttatatttagtaaaaactctaagtaaaacatatcaattccaacagtgtattaaataataaatacatctatgaataattaggatttgtactttgaatactagcttataagtcaagatgcttttgggtgcaaaaataaataaaaccaaaaccagctccaacttcagctggcttaaacaccacaggtataatttgatctaggctctgatggtgtttttttggtaactactcagctctgatcttgtctatgttacctttctccttagctggttacaaagtagctaccagcagaaactggtaggtaagggaaggtgacctgtttgtgcctggtggcaaagagaaagtcttcattcttttactgatttttaaaatttctttggtgacacgatctcattctgtcatccaggctgaagtgcagtgatgctgttcagccttctgagtagctgggtgtgtaccaccatgcctagctaattttttttttttttttgtagtgatggggttttgccatgttgaccaggccggtcttgaattcctggcttcaggtgatctgcccacctcagcctcccaaagtgtcgggtttaccagtgcaagccattgcacccatccctggcctgttt

SEQ ID NO: 140586 - DNA, 150 bp, Homo sapiens
ttgattagataaagggggaaaagagaggcgggggtggtgggaggaggaggatggatggcagggccaagggagggggaaaggcggtgaagaaagaggaagaaatgaatgatgataatgcaatgaaaagaataagccagaggagggaaaagc

SEQ ID NO: 140587 - DNA, 603 bp, Homo sapiens
aatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggatttttta

SEQ ID NO: 140588 - DNA, 325 bp, Homo sapiens
aggatgtaagaagagcatctgggctcctggggaggtagaagcaggcacagacaagaaaggagggctgaggctgacatctgtctctgctttggctatgcagaagggggactgggctgctcagtgatctgatggaggaggagaaactgaggccagaagactcatgctctagcaccacctctctttagatgtgtttctagtctcttcactctccctttggatttatttacattttggggttagaaggagcatttagagatgcagtccttttctggcacagatggcaagagtaggatccaaggaggccaatttcaatggccagggccag

SEQ ID NO: 140589 - DNA, 437 bp, Homo sapiens
gcccactggcaaggagaactgctaagatcctccaagagcgggtgttcagggtcccttcagactcctgaccctccactttgcctggagcagccacatccctctctgcctggagagggggaaggaagagattccagaagccaggtcagagcatggagagtaagcagcaagggcccagagaactctgccatggaaatcagccatgaaaccagactccagccacagagctccaagggcctggtgccatcaaagataggttatctcaaaagactgttgcctaaaagttggatgtgattgtgagggttggggaaacacttggaggctgtgctgcagtggccaggccaagccaggttttacaagttcacagcagctgcggttgctctgcggccagcctaagggatgtttaataaaaagctgtgctcaatttcacccccttcaca

SEQ ID NO: 140590 - DNA, 542 bp, Homo sapiens
attcttggcagttgcctttgacatcatttgtcacttcctcctcctagatattgttttcatccatttcatttgtagggcattttccttcctcctcatgggttgctcctcttcttccagacattgtaatgatgtagtcatgcaatcttcggtcaccctctctactacattcactcccatggtgatctcatttgccttgaggttttaaataccattggtatgccaatgacgcttacatttttgtctccaaccaagacttcttctcaactccagactcctatatccaactccctatttcacttcactccctggattctctattactgagctattgccacaaaacttctgcataacagaccacctccaaactcattggcttacaacagtagctattaattctcttgattctgtagggtctggtaatctaaagcaggctccatgggcagccctccttccaaatgtgggatgagctgggcttagctggggtggctctgtgtcacttgcattcacttggggtccaggctaagagggcaacgtctgcccca

SEQ ID NO: 140591 - DNA, 297 bp, Homo sapiens
gtgatcatcgagctcgtaccgatggccaaggttcacaatttcagcctggaggaaagtaaattaaagaggtaagggcagctcccaccttggaaagacaatctccgcaggcctgcagaaacagacctgcagaataccagaggccccttgtctactcccagatcactgagagagtttccctaacttgaggctcagcaacatttggtatcctacatttaggcagagggttgcaaacagtaggggcaaatgcttgaactctgcttagcactgagtggtctttgctgcttttggtcctgaaat

SEQ ID NO: 140592 - DNA, 223 bp, Homo sapiens
tagcctgggcaacacactgagaatccatgtctacaaaaaactaaataacttagcggagcagggtggtgcacacctgcagtcccagctacttggttgggaggctgaagtgggcagatcacttgagccagagaggttgaggctacagtgagtcatgtttgtacaactgcacttcaacctgggctacagagcgaaatcttgccttaaaaaagaaagaaaagaaaaa

SEQ ID NO: 140593 - DNA, 559 bp, Homo sapiens
gtctctgcacctttttaaaagtcttcacttaaatattgaagcaggaaaggcctctcgaaggggatttatctgtgaaagctctgaaagtaccatggccacttctgacagtcactttatttgagcaacaggttcagaagggaactgggttgttcccacagtaaccagggtcttaatcaatttcaatttttgataacgaattgaacatttaaaaatatatacaggccgggtgcgttggctcacacctgtaatcccagcactgtgggaggccgagtgggcagatcacctgaggtcaggagttcgagactagcctggctaaaatggcgaaacccaatctctactaaaaatacaaaaaaagcagccaggcagtaatggtgcacggctgtagtcccagctactcgggaattctcctgcctcagcttgaacccaggagaacccaggaggcggaggttgcagtgagccacgttcgtgccattgcactccagcctgggtgacaagagcaaaactctgtctcaaaaaaaaaaaaaaagtatacacacacacacacacacacaaatagaat

SEQ ID NO: 140594 - DNA, 517 bp, Homo sapiens
gcaaaaaccccaaataaactgctgaagtacacagacgagctgctcttctgttatcagcctgactgcgtaccagctctgtgtgaggcgtctggtgaattcccgacccacaaatagtctcatagtctcatttttttttttttttttttgagacggagtctcactctatcgcccaggctggagtgcagtggcgcgatctcagcttactgcaacttccacctctcgggttcaagtgattctcctgtctcagtttcccgagtagctgggattacaggaacccgccaccacacccaactcatttttgtatttttagtagatacagggtttcaccatgttagctaggctggtctcgaactcctgacctcaagtgatccgcccgccttggcctcccaaagtgctgggattaaaggcatgagccatcgcacccggccaatttttgtattttttagtatagaaggggtttcaccatgttggccaggctggtcttgaattcctgacctcaggtgatccgcccaccttg

SEQ ID NO: 140595 - DNA, 340 bp, Homo sapiens
tactgggcacttctcaggctgtttttagatcttactttcttgggggtcagccactggaactttattttgttcctttggtagtgccatatttccttcattcattgtgttttttgaagccttggtgccggaagcacactgcaacgggggcaagtgggggcttagagggtggtagtgtggaacacagtttaaaagtcctgtctcctgtttctctccctcctccccatccccccaccgtttccccctgttgcagggttttgtttatataactcaagttgtttggctaaattcttcaggtgaataccttttttcttccttttatttgttgctgtttttgattgag

SEQ ID NO: 140596 - DNA, 287 bp, Homo sapiens
  misc_feature (283)..(283): n is a, c, g, or t
taccaagcaacaaaattttaatgtgctatacaagaaagaaaataaaataacagtatcctgcatagctcagctgtgaaaaatatttacagtgaaaacaaactgagatataactatcttagagagtacaagcgcaggtatttaagggaggaagaataaaagaaagataaacccctctcttcctcaatggaattcatgtttaatgactaaaatggaaaaaaaaaaagaagtcaataactggaaaggatggctggggttctggatacgggttttggacggggatccntcta

SEQ ID NO: 140597 - DNA, 477 bp, Homo sapiens
cttgccaaagtgctgggattacaggcttgagccaccgcgcccagccaagtatgttttttaataccaaattatagcttcatcctaactggagagagacgaccaaggcttcaaatggtcagtgctaaacccagcagccagggaaggttacttgtgtgacttggggagccaggcccttcattcagaggagaacggtttatgagagacaactcattgtctattaaaaacctggtctcagttgtctgtgaatgtgagaatagcattttgtgagatgcactttcttctcccggttccctcatgaagcagatggtgtagtcctagttaaaatgaaaaggaacaaaaaaaatacaacaggcttggggaaaggctttatttgacatctaagtgaatttccttattacctcaagtttgcttctctgccaaataggggcctgttgaaaggaacagatcagagtggattgtgctgcaaacggagatgtt

SEQ ID NO: 140598 - DNA, 492 bp, Homo sapiens
acaatgtgccaactccaagcctacactgtaaaagtcaacatgtttgcctatgtccttcttgtgctccagccatccatcacaaagagaagatcatgcctcacatagctgccagttcaagaaggaagagggacctgtggacgaggcattgggcccaacctgcagcttggagcccagactagccacatttagtttaggtcagctgaatctcagcaatgcacagtgaaatcattggtaataaggctggaaagatagtgtctagaaaactaagaataccagattaagttattcacagttactctattttaggtgagtgagagttattacaagtctttgagcataaattttgccaagattattctggcaacaatgtgtagggcatagggccaagacttcaaatggagtttacttctatagctcccagagaagaaataaaccatgcctttagtttgatgctaggactttgagaatgcatgaggcaatatgaagaataaa

SEQ ID NO: 140599 - DNA, 714 bp, Homo sapiens
cagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatatggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcagtgtacttctaattgcatttctctcttttcatgtggttaagagccatttgtatttgctgtgaactatttaacctatttttctatagaatttttggtctttttcaaccattttcagctctttgtatactaggaatattaaccctttgta

SEQ ID NO: 140600 - DNA, 193 bp, Homo sapiens
ggccatggctgggggatgggcagcctccatgcctgctggcttctccccgcctccccagagcccttcagcagggagaggggcccaggcttggggtgtcctgggctggaccccctgatgctcagggcctagaggtcctggcatccatgcagctggcccggtccagcttccttcctggaaaggctgcacagagggg

SEQ ID NO: 140601 - DNA, 530 bp, Homo sapiens
agttcgacggagactctcttgcttctctctcacatggcaaattaaacaggagagagcaagagagatggaagccacaatcccttggactcagatcacagaatgtctgaattttgctgatccctgtttcaaatcaaccacaaaatatttatttctgaactcatgaaaggtaagtgcattgtacttctaaaaacaattttttttccatgaaagaggatagacccaagctgtgtatggctgagttgactctactgaatgtcgatgctatctagttacaaaaggaacaagaagatttaagccttacactttgattgacacaccaatctttttagacttccctgggaaaaagtgaggttgaccttaaatgagagcgaattgcttcctatctatgttgtgtgtgtttcagagcaaaacctggcattgtccaacttgaagcttcactgggaatgttttggaagtgtttggtgtaagagtgcaggactgactctgagactcttgccgctacagtgcacttgtttttctgaagttgattc

SEQ ID NO: 140602 - DNA, 473 bp, Homo sapiens
atttgacattggttacccaagtttcatatagcgagccagattcgtaaatgctaaggattttttttaaaagtggaaatccaagggacaggttgagtatcccaatcagaaaatctgaaatccaaaatgcttccaaatcgaatattttctgatcatcaacgtgatgccacaagtggaaaattccacagttaagtgctcaacacagcctttgtttcatgtacacaattatttaaaatattgtataaaattacctttaggctatgtgtataaggtgtatatgaaatagataaatttcgtgtttagacttgggtcccatccccaagatatctcattatctttgcaaatattctgaaatctgaaaaaatctgaaatacgactggctgcaggcatttcaaataaaggatgctcagcatatactgacttaagtcccttcaaatctagtcctaatctgccctcaatttaagatctgaatttat

SEQ ID NO: 140603 - DNA, 502 bp, Homo sapiens
aagatgcgggaagcaaagcatttcttagatggcttgagacatcttcatccctggccttctcttgcagaagagaagaggcaaggatatatttgggctgctccttcccttaggggtgggccttaaggagaggttggaggctgggactgagtgtgctctgtgaacaaatacatctgtgggaccttgaatgaagctcttctgcaggagtgctgaggacagcaaagctcatatgagtgttcttctaatcactttttaagaggattgagattcctgcctgtgccccatacagacatgggtaagtgatcacattggcccaggtgaggagtgtctgtgggacatgggtctggcctctcccaccaggctgaaggcatctctagagcaagaccggcgtcactgagtgtgatgctgggtgagcatcctcagagcacgaacgagggtcaaagaaagctctgggtggttctatggttctataaagggttctataaagacaaagctcttggaagag

SEQ ID NO: 140604 - DNA, 520 bp, Homo sapiens
ccccccacacagggcacccccgaccttcaacagcctctcctcacccacacaccaattccgtggcgagtctctcggctcttcccagccacccctacaaagcaccattccctttgcattcggatgggtcctgttttgaggcttacccccgccagtttgacatctctgcttcagtggcctactaatttttctttttctttttcttttttgagatggagtctcgctgtgtcgcccaggctacatctaagaagaaaaaaaatacatacacgcacacatacacacacacacctggagagtcaaagagtacgtgcatactaaaggtttaacacgaacattcaactctgagacatggtctggttaggcagaagaactatgagacaaaaagaaagaattcctcagaaatgcatgaagggacggacacgcctccacatggggcactatcagctgacctcaggcttccctacagcacgtgtgagccaggcgatggtggaatgacagctgcaaagtgttggggaagaagatc

SEQ ID NO: 140605 - DNA, 446 bp, Homo sapiens
aggctcaagcaatcctcccgcctcagcctcctgagtagccaggacttcagacataagccactgtgaccggccaagagacccaccttttacagggcaagtggtttgtttgccaattttcactgccccaccacatgagggtgtttcgagtgggaagcaggtgcaccctgtgtgaacagcaaagcccagcgcatgcctgctgcctcccacctgctgccacgtagagctgggaaggggaaaggctgagccccacctccgaccttccctacatatcaggaaatcttgtcgttctccaaggtcagctcagacgcctctggccactgccgcccatggcaacttggtgccagggatgacagcaaccaacactcattgatgccgtgacatgccaggctgtcaccagcttttcacaacagccctgccagggagatgctgtgtggctttcattttgc

SEQ ID NO: 140606 - DNA, 375 bp, Homo sapiens
atttgcagtgatacatgtagattgtttagtagtgcttggcacattttgagtgctcagtgagtgatggttgttgtcttcatcatcatcatcatcattatcagtagtagtactagtagtattgtaagggcagcatcatcataatcagatagtagttaaaaatcagcatctagagtcagtgaacctgttaagttctaaccctggctataccatctcttcctgtgtaaccttagaggagctctttaacttctttcagcctcagttttctcatctggaaatgtggataatagtatagtggttgagaggaattaaacaagataatatatggtaagtgcttaaaacagtgcctggcgcatattaagctcagttattcgttgc

SEQ ID NO: 140607 - DNA, 481 bp, Homo sapiens
caaatccagtaccagaactggctgactcagaatttaccttagatggaagatagggtaggaattttggaagaaggatgaccttacagatcaagacagacaattgcaggaaatgaaaattggacatttgacatttgaacctctctcctgtgtttggaaaactctccatcaatgtgatacaatggtggaaagcggggtctaggctcaatggaacagatggagtctcgctctgttgcccaagctggagtgcagtggcgggatctcgggtcactgcaacctttgcctcctggattccagcgattcttgtgcctcagcctcacaagtagtgatgagccctcctcttccagctaggaaaatgacggtgttcagaaagttaaaacttcttcgctggaaggatttcatcttaaagttgggagactggaagaaattaaagtgttctaaatggaagagcattcaccacatgtgttctgatacgttgtgaggt

SEQ ID NO: 140608 - DNA, 440 bp, Homo sapiens
ggaggaaaaaacttgtgttccattttagacatgtaaggtttgagataactgcatgacatccaagtggagttataagacagacagttctgtacctgtgtctgaagctcagagaggggagtgctctgatctgaagaaataactgggaattgtcagcctaaattcaatattgttattgaatccatgggaatggatgtgatttcccaggaagcatgtatctaggactgaggcctggtttgagtgaatgtaaagaagcctctatatatggtactcatctttgatggttctctccattcccaaaagctcagctgaataattagtatttagggagaatcctctggaccctctaaaatttttctctggactaagccaggccactgactgtattttgatgctgtacctgaacacagaatggcttttattagatcatgctatcagcctat

SEQ ID NO: 140609 - DNA, 466 bp, Homo sapiens
ccacctcagcctcccaagtagctgggactccacatctggctaattttttatagagattgggtggcggggggtggtgtctcattgtgttttccaagctggtctcaaactcctggctttaagtaatcctcctgccctggcctcccaaagtgctgggattacaggcatgggtcactgtgcccagcctagcccacactcttaatcgctctgctaggttgcttctgtttgtctgttagttcagcacatggtttgagtgctcaccatgtgcccggtattgggtatatgctatgaatagggaagccttctacagtctagctccctgagacgggcccacgtgtattctcttcaccatggtattccctgtgcctatcacactacctggcatagtcaggtagactgacccatggacattccctcttgtctgcctctatgtgcttttcatttcatcgggaggggaacagactacaca

SEQ ID NO: 140610 - DNA, 398 bp, Homo sapiens
aactgattgccagctttataactcgatctgggcacactccccatcggggcctgcatttcctgtggatgatgcattggtttccaaggtgacggtgggaaggaatagacctgttagcttgtggcttctgactcactcactgcaatggacgtcatagaattgtagctgaacaaatggatgctgataataagtatgtgcctaaggtagcagcggggcaccaatggttaaaacaatcccattgtaccagctctctctccctcccactaagcaagccgacaggccaacagaaataccggaactgaaaaaagatacaacagatttccccagtcatatataagttcacagtgaagtcctatttacatccccgagattttgctcctacgcctggagaatttcctttt

SEQ ID NO: 140611 - DNA, 658 bp, Homo sapiens
aaagcagtggattagaggtagctttgcccacagatattttaacctcccaaaagtatttaattccaaattttaatagtgtcaaagctaacaggatattgcagatacataagttacttagggaggaaatcttaatttcttgatattttatgtagaataaatagtcaagtttatactataacatcctggcaaaattgtaacaagtaagagaagactgcttacataaattctgtgtccatgaatactatattagatgtttgtaaagagttattgtaactgtaattctctaagcatgcagaaggaaatgaaatcttgattagatggtcagttattaaagatctaacagggcacagagatatagatgataataaattagcaaaattatccaagaaaaaagatggtgtccaaaaaattgacaaagggaagatcctgtagtaagaaaacattgaatttagaaactagagaagcatagtctcattttacagatgaacacactagaacccagaaaagtttttcaagtcatgtcccccaggttaccggcagaggcagtctaatactcttttccactctgtcctgctgcctcccagtaatcactgattatttgcactacttacagagcctattgctgctggcaaagctctttctcaaaacaaataaaaaa

SEQ ID NO: 140612 - DNA, 375 bp, Homo sapiens
tgagactctgtctcaaaacaaaaaaagcaaaacaaaaaaaaaaagaagatgcagggcaacaatgccagggtcatgggtgtacatgccgaggctatcgagcccctcgtaaagcccaaggacgttaagcccacttgcctacactgcccaccccaagcttgagaagcatgcttgtgcccacaatgccaaggggctcagactgtaccagccaaaggccaaggatcaaatgaaggcccaggctgcagctccagcttcagttccagctcaggctcccaaaggtgcccaggcctgtacaaaggcttcagagtagagatctctgtctgccaacgtgaggacagaaggactggtgtcctcctgcactatttgtacaaataaacc

SEQ ID NO: 140613 - DNA, 215 bp, Homo sapiens
gccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttct

SEQ ID NO: 140614 - DNA, 311 bp, Homo sapiens
aagtagctgggattataggcgcctgccatcatgcccggctaatttttatatttttagtagagatagggtttcaccatatgggccaggctggtcttgaactcctgacctcaagtgatccgcccacctctgcctcccaaagtgctaggattacaggcgtgagcaaccgttgccttcctgtgcctggcctcattgcttattttcacagttagatctgccaccagcctagaataggttccagagctctattattattttttttttttagaagagggagtctcattctggtcacccaggctgggcgtgcaatggcg

SEQ ID NO: 140615 - DNA, 298 bp, Homo sapiens
tccttcctctgcatgcatccagttatatatttataacatttaatggaatttgctccattcatccctatatttctacagctaatgtattacattattgagtagactccaggaagggtccacggaggagacaggctttaacggtgttgatcagtgtaaatgctatcaaaatggctaaaaatccacatggtgaacaatggatgatgctgtactcaaagctcaactttgattcggttttcaacaaatttggctgtggtataataatttggctctgggactgcataatcaaaagaaattaaat

SEQ ID NO: 140616 - DNA, 186 bp, Homo sapiens
acagtgtcaaatatttaaggaataatcaagccatacaattaagccacttgtaaatgagatcatttaaacatagtgctcaccaattgccaggcacagattaagcactagataaatattggtccctcttccccttcctctcctaactgagttccccatctgcttcccccattccaacatactttcacg

SEQ ID NO: 140617 - DNA, 497 bp, Homo sapiens
cacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaac

SEQ ID NO: 140618 - DNA, 439 bp, Homo sapiens
gtacccctcgcgaacgtgttatcccctcaagtagttcatgggcgagtggaataaagggattttcagtaaaaatttaagatccaagcttgaaagcttctttcccaagacatcttgtggatctgagaaccacaacaccttgtcagagagcaatttctagcctgattctggaactttgcccttctagaaacttctatcattgtttctctcctctgagcggaaccaacagtaaagcactatatattaaaaaacagtatataaaattctccttttgttttgtgaactctacaaatgcctagattatctgtttttaacagtcttcttgcctactaaacatagacttagagaacacagtctgttttggggctccagaactcaaaagggaagtgaagacatggagagtgttcggatatacggcgcgaggggtcctctagtcagccac

SEQ ID NO: 140619 - DNA, 763 bp, Homo sapiens
aaaaaaaaaaattcttccctttcaatctgcaccctctccccaatgagtataagaaatcctacccttggattatccatctggcagcaagacaggcagtgaccagtggtggtagttcttctaactttaaaagatgagaggctcaccctaaaacatcttcattcctctaccagtgagactatcaaccatggatctatctatctattttttaagcctgcatcacttcttgagataatgaggtttctacctccaaagcctgctgggtgagcaccttgctcattatactggttctgaatttacctctttgaagtttctagatgcaccacttcctgctcacagcctggaattcggttaacaagtcagtgtcaacctacctttcccttcatgatttatagacttttgggagtaccttctggtagcttttgtcttcccataggaaagaggcccaatcccagtttgtcctcacaaagcggccagctccgtgatatctcttttgcgggcagagttaagattgtacacagatccccacaagtaccacgatttttgcctcaggaaggataaagcacatgtttgtttctgctttcgttttcttttttctttttttcacgaagccttatggagaagtatgtttctgctttctttcctgaggaagcctagcttctgggccacgggactgatcctgtctacatcctctttccctccattctccatcgtgtctctgcccccgtctcaccccaccccgtgcccctctctgcctcagcttccc

SEQ ID NO: 140620 - DNA, 261 bp, Homo sapiens
ccttttatcttttctaggcacacacaccttagtaaatctttgggttgaagctttgctttggagaaattacagagccctttacagcagccctccagtctttttttggtcatgagtttcagaatggtctgggataatccaagatacccacagtggccatatctcttggagtgtctaatgaatatcatcccctgggtcatctcttggagaacagcctgaggagtaagagtgtagcctctcagaagagcagctggatggcctagg

SEQ ID NO: 140621 - DNA, 882 bp, Homo sapiens
gaaatttacagtgatacctcttggaatgagtgtctccctggcattattttgttttgttttgttttattttattttgttttagacagggctgcctaggcgggagtgcagtggcacagtcatggctcactgccatctcgactctctgagctcaggtgatcctcctgcctcagcctcccaagtagctgggactacaggcacctgccaccacactgtccagctagtttttttgtattttttgtagcgatgggattttgccatgttgcccagactggtcttgaactcctgagctcaagcaatctgcccgccctggcctcccaaagtgctgggattacagacatgagccactgcacccaagcctcctttctcttttgccactattaaacctctggctccttaaacccttaaaaaaaaaaaaaacaaaaaacaaaaacaaacaaaacaacacaaccagacacccacagaaaaaacaacaacaccacagaaagaaacacacacatcgacaagagccaaacacaaagacaaaaagacgagcacacaacagacaaacaaacactaccaccaccagccagaggggggccgcccgtataaaaaacccccccgcgggggccgcccatagtcaacgcccccaatctttgaagacaacaaccgacccccaaactcagcagcgcaatcataatacagaccgcgccgccgcccaccaaacaagctcggtgcgagagaacacaccaacgctcgccgcatacactgcgagaacaccccacccggcggggggcgcataaggacacccccaccagaagaaagtcagcccggacaaaaacgcacggggacccggaacaccccgacctgtgcgggcaaaacacctcagcaataaaaaatcacgga

SEQ ID NO: 140622 - DNA, 389 bp, Homo sapiens
ctctcaaatccccacctggtgtgtgtgcctcaatttctctcttcttataaggacacaagtcatattggactgggggccgctctaatccaatatgacctcactacaattgattcatctgcaaagactctatctccaaataaggttaaattcacagggtccaggtagataagaattttgaggtgacactatttaacctggtatatcatccctgtggaaatggatccttacaacttgagaactagtcttgaaatgctccaatatcccactaaactcaagaagaaacaaacacaattcatcaaagtatcttcttctttccatttgctatacaaaaccattcttgagttgtggatggaccttgcactgcttcctcatttggaccctgtttaacc

SEQ ID NO: 140623 - DNA, 185 bp, Homo sapiens
tgggctgcatcttcaaaatacacagtcaggtacagaattggacctcttcttgtcactctcaccaccacattgtccaggctcccaccagctctcacctggatttcagtaactacctcctcactggtctcctgggttcccccttcactcccttcagcctatttcccacacagaagcagggggatccc

SEQ ID NO: 140624 - DNA, 390 bp, Homo sapiens
aggagctaagattttagtaggggagacagagagctagcttatggtagacagcatttattaaggttcaatcctatgccaaaagactagaaaaaaatacgccaagatgtttgttcatggcgttcaataattttatctgcatatgctaggatattacactgcttgatattttccctccatggatcttctaaattgtgtactattaacacatattatagactttgataacagaagaaaattaggtttaaaattgaaaaagtataaaacttggcacctaatgggttatatctgaggtctctgctaattaaagtcctcaaagttttatatttgaaactttagaaatatatctaaaatatgaatactttttaccatctcaagagctatgaaccttgg

SEQ ID NO: 140625 - DNA, 509 bp, Homo sapiens
  misc_feature (78)..(78): n is a, c, g, or t
ttggactacatttagatttatatccttacctatcttgggatttatataataatcagaaattggagtcagattaccttnatgtataatggttaacttttaaagaaatttaagtggattaaagttaaataaactttagagaaacctaaaagtcacagaagccttaaaggtacatacatatttttaaaatcctaattttacactgttagcatcttgatgtgatatcaacaccatttatgaagacactctttgttaattagtttatggggtgttaggtgaattattcagtaaatggttatcaaaaatcaaatatttaactataaacattgaatgataaacaatattcctctgatcttaataattgtcgtaagtacattacttcaacaactatttactgaattccttttgagtggaagacattgtccaatgtgatagggtctttgaaattaaaaaaaaaaaaaaaagaaaagcctgttatccaatttgatgagctcaaagtctgttgggtgaga

SEQ ID NO: 140626 - DNA, 169 bp, Homo sapiens
tgagaatgaagtagttggagaagactccttggaggaggttccctaggggaagaagatgagaaggactagtgactgtgtaccatgggttgtcacaccaaccatatggcctccaggtgaaggaaaagtagtttggtttataccaagggttccccatgttatcccaccagct

SEQ ID NO: 140627 - DNA, 372 bp, Homo sapiens
tctcgatctcctgacctcatgatccacccaccttgggctctcaaagtcctggaattacaggcatgagccactgcacccagcccaaaagctttgtgcttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaaggtaatactggtaatttttgtactgtaatcaaagatgaaaaatataggccaaaatcatagaccttgcatagaag

SEQ ID NO: 140628 - DNA, 265 bp, Homo sapiens
tagtattcagccacaggctgaaggagaactcatgcaaatttctggagcttttgctctgtgcagctcctttctcaccattactccatcccaaacactttgtctcctcagcctcccagaactttaatctcggcctcctcaatcaccagacccccatatactgcctgagttccccctccctggactgtagtccagatagtgccttcagcagaaagctggggtgagcagagggcaaccttgtttgtctctcttctctcttttttttttt

SEQ ID NO: 140629 - DNA, 327 bp, Homo sapiens
tttaggacctcagcagttatcctcatacctcctttgggacacaactgttcataaggcaccatcaaaagccacactgcatctgcacctagcatcattcctcccaggggccacctcctcagaatgcaattttttttgttttgttttgttttttgagacagggtcttgctctgtcacccaggctggagtgtagtggcacgatcttggctcactgcaacctttgcctcccaggctcaggtgattctcctgcctcagcatggcattttgctatgttgccccggctggtctcgaactcctcagctcaagcaatccacctgcctcagcctccca

SEQ ID NO: 140630 - DNA, 247 bp, Homo sapiens
ttcaacaattattcttaaaaatacatatatatatatatggcttcatatgaatgcctatttaagagtcacatacctactgctatagaagataaagagatgcttacaaggtatgaaaatgaaattctcttttggagaactggatggcctctatgagcaaggttaaatttcttgctcacatatgtttactaatcattgcaaaagttcttctaaagcaaatataggcaatcagtccagttatatcccagag

SEQ ID NO: 140631 - DNA, 206 bp, Homo sapiens
gtcagcaaggaagcacgaagttaaagaagcttcctcctgttctacagctgttcgtagggagagaagattctcaagggacagtgtgaatgacggaaatgttaaattgaggaggaggcggagcttgggtgtggaggcatttattgtttggtctgtccagtaatcccttcttctgggaccttcctctcccctgtcacacttctgcatgg

SEQ ID NO: 140632 - DNA, 242 bp, Homo sapiens
ggaccaaccatatcttgcttagattttcctgagatatacctgctgccatacccggttcttccaacaagcccacctttgccttgaggacgagtgctgtggggcacagcttgaaatccctccccccgtaactctgtctatctcagaagacttcctccaggccacctgcaacaggtaggggcggggtaaacgcatgtataaaggggacagctgcaccagtatggagcacagagggcatgggtctg

SEQ ID NO: 140633 - DNA, 138 bp, Homo sapiens
agtaagtatttgttgggaaaaaagacatttacttcattgatatattaagttgttcatgtaggtaatactttatgccacagaaaatggcccgattccttttaagcctgaaaattctatgggtcatagaaagtttttttt

SEQ ID NO: 140634 - DNA, 422 bp, Homo sapiens
ttcagcttccatagctggactacatgcatacgctctacttttttttgtgtgtttttagtagagacagggtttcgctatgttgaccaggctggtcttgaactcctgacctcaggtgatcctcccgccttggccacccgaagtgctgggattacaggaatgagccactgcacccggcctcaaacgcctgtttctgttttattttgccaactgtgtaagtcatgttgtagatcccatgatccttacctctgaatacttcagcatgtgtatcttaaaaataagaacattctcctacataaccatggtgtcattatcacacccagaaatttaacgttgtgttgccgtatgctatatcctataatgttatcgcttatgcaacccatattcagatatctctggtggtctcagaatgacgtttatggctt

SEQ ID NO: 140635 - DNA, 309 bp, Homo sapiens
agtggcgagagggtggtggtgggagggtggggcagagacccagaagtgcctgtgacactctcaggggctgcaaagccccagaacggccttcagagctagggacaagccaccgagtacctgggagggcaggagaaggagggccacccaaaagacaggatcctttaagtgaaaggagaaaggagagggaggaagagggagggaaggaggggaggatgatgaggctggagaaagaaacagccccaggtccttcccgggaggggctgccccataaagtgaggggggtgcccagtggccatcgtcaccacacca

SEQ ID NO: 140636 - DNA, 153 bp, Homo sapiens
agtacatgccgcaaaactcgccagtcatttcagactaaaggggccagaattcccctaatttctccataagagaaagtaaagctatcactaaagcaaatgtagaaaattaactgttgaggctgggtgcagtggctcacacttgtaatcccagaa

SEQ ID NO: 140637 - DNA, 310 bp, Homo sapiens
aaggcaggcttgtgctcaggcatcctaatgctgagagtaggaggcaccgcccatggtgggcaggggtgggatgattctcaaacacaaggcagagtgttcaagtgagccatgctgaggtccttccactggagaggttggggtgaccttgctggctatagcctgggtaagcaggtagggaagatgtttttctcttatgccccagtttgacagggcttactccccaaccccagctgcaaaagcccttgcccagtccctaactaagtctcactggcaacttgtgccctgctagcatttcagtctcagtcctggc

SEQ ID NO: 140638 - DNA, 129 bp, Homo sapiens
agaattgttaagtctgagcaagaaaaagcatagcgggttaaggacaagtgaaacgaagagaaccctctgtccctggcagaatctgcatgtacatttcttgtctgtccttgtctctcttcttcctgtctg

SEQ ID NO: 140639 - DNA, 471 bp, Homo sapiens
actcaacctggatatgttttgatttggtactatccacagtttcaggcatccactgggagttttggactgtatcccctgcggatatgggaggactactatattctgcttacaaaatgtaagaaccttgcaacagtatagtgtgggatcaagattctctatcttaaacatgttcagatttttctattccttggtcctggttattcacccaaactgcttttctggttctctaacataggccacatttgcttcctctgctttcttaccaaaacttattctccaaccctttctaatctagcttctgccccgtatggtattccagttctactgaaacacctctccgaagatcatttatgggctgacatggtggctcatgcctgtaatcccaacactttgggaggccaagacaggaacatcacttgaggccaggagtttgacaccagcctgagcaacatagtgagacttcatctctat

SEQ ID NO: 140640 - DNA, 658 bp, Homo sapiens
ctgcaatctgatacaggggttaagggcaacaggacattgaagtcatgcagtctgggcttgaaatacaagttggaatctcctgtgactcaggagtgtgtagcataacagaagtaatgtgaggtataaagtatcgttggttggatatgaatcccagctctcctctctggtagctggatgacccaggacaagctattcccatgtcattccctaggcctagtcagattaggactctctgtccatgatattccagtgccagcaagtacagtctatgaatctggatagtaactaaatcagtactgtgaatgaaccaaggtatagtttgaaatgaacctctaagaaagacatagaagcacgcagtgaaccccagaaggcattcccccaaatgcagccccctcaaaaccatctatagggacaaggcactcattcccccagctgctgggaaaaccaattgctcacagctgtgtcctccctgggactcctcccctgaagaagggagctgctttgcccaaggtaatgctgccttccaaagagcagcccacaatcaatgcccacttgatgcattggcttgtcccagttctgaagggccgtctcagctccagccatggaattggctttggcctctattacaactattgcaccacagttcaactacctcttc

SEQ ID NO: 140641 - DNA, 385 bp, Homo sapiens
ccctgcccccaggcaacctcctgtctggtaggcagcctgtgtcgctgatgcctccctccgcaaggacgtcccgcagtgtaaggcaagggttctagatgcacctctggtgtgagagcggtgccttccacacagcgggcactcgggatttgcccaacagattccaccttcccccaaacccctgcaaaaatccccagcagggccgcagggctcgcagccctctgagcgaaagggcctggcctgtgtggcatgtgctcagagatgcgggatctgcaccccagaccctgctggagatctgctccatgtggggaagtagagcttagtgtccctgagggctgcggacaggggtgcatcagccttgtggccgaagtctctggccttcacgcct

SEQ ID NO: 140642 - DNA, 434 bp, Homo sapiens
aatcaatgaacaaagtttacaaaagtttcaaattaccactgcaggaatatttcaaatatattttataaagcacagcaaaactggtggaaaatagttttgattttcctgaaaacagtcaatcagagccaaagattttcagggccccatcccaggcctatcatttatcaaagtgtgaaacactatgagaatctgtattctttgaaaaacaccatgacgttcattttatttgaaatcttatataataaagaagttatagggatggggagactttagaaagttacccagaaaaaacactttaaatgagtcaactaacaaaaacaaaaaaactaattcatggctattagaaatcttatcagtggttacctggggcagtagaaggagaactccaacagggcacaagaaactctgggatggtggaagtattctctatcttg

SEQ ID NO: 140643 - DNA, 377 bp, Homo sapiens
tagaggacgcccgggagccttaccctactcaagcttgaattctgtgaagctttccctggcctctccaataattaggagctctgactcctttactttactcaccgcccctgaattgagcaagttatattttaatagtgtatacaacgaattgcagtgaatgttaacacgttcaccttttattgctaacagcaatgctacccgtgcttccaggctctatccaaactcactgcttccagataatagctggctggtccctagggagaattctttaactctcagcatttgatgctcaattcagtacctcctcatattcagcactgtagcttacaagtgctctccgggttcccttcctctcctccccgacagactaaactgct

SEQ ID NO: 140644 - DNA, 167 bp, Homo sapiens
gtaggaaccacaggtacttttacagtgtagctttcggggtggggaggagagaagtagactgacagagataatagaggtagtttcttctttccaaaaatcttgggcactggcccccatgaagaagatgcccactttccaaaccattgctcccactttgcagatgggag

SEQ ID NO: 140645 - DNA, 415 bp, Homo sapiens
ccttttaaaggttaattttatgactaaaagctggcctgatattactaagaaactgcaaaaaagttgatggatggaataaaaagccaattaaggaattagaaggtttttgcgaaaagtaagaaacgaattggaaaaagagaaagagagaaagccaaagctgtccatcttgcagacggacagaggggagccacggcatggctcacgctggtgctcagagagagaaagagttaagctgctgaccctgaaggcaagggagccggctgtgcagctgcaggtgtgggggcggcaggagctgcagagccgaagcaaacagccgagataaaggtggacagtgtgagagagctaatgtaagtaagctgttaacatggcgagtgcgctggcgcccagagaaagaagaagaaactgagtgtaaggg

SEQ ID NO: 140646 - DNA, 459 bp, Homo sapiens
aatctatcactctctgctcccagattctgaatatagtatcttcccacatctctggcctcccccaaaccacacgtgcacagagcagacacaaagcagcccagttacggctaaaaaaagcaaagagatttcagctactgcccatcaaaggggagacagaatttgggctgtaagctcagccaagtaaaccacctaagaaaaccaaataaatcaagaacataaaagaattcatcatctctggctgggtatggtggctcaagcccgtaatcccagcactttcggagaccgaggcaggcagatcacctcaggtcaggagtatgagaccagattggccaacatggtgaaatcccatctctactaaaaatacaaaaattagccgggtgtggtaacacacacctgtaatcccagctactccggaggttgaggcaggagaatcacttgaatctgggaggtggaagttgc

SEQ ID NO: 140647 - DNA, 471 bp, Homo sapiens
atcattcttgcctcagcacagagtggttttctgtggatggtataaatcaagtaacctcctcactcccctctgtctcataatcatatttgcttttattgaaaacatttgtcactaacttaaatgtcttaaattatgcatatcttatcgcctgtctccttgtggttcactgtacctagaagtgtacttggaatatatcagtgattcaaatatttgttgaatgaaatagtgggtacagtttagcaaggttacaaatgtctcctttatcttgagcatagtaaagtggcaggactctgtagcactttaatataaagtattctgtgctctgaggtgatagacatataaaatgcaggaacagcaactgaaacaaaactataaaacaaatgttatcatgtaattgttttttgacatttattttttcaacactgttcctactttactgcttgttgcacctttacttcccatgtgaatgag

SEQ ID NO: 140648 - DNA, 276 bp, Homo sapiens
cagactgcccataaagaagatttctgccaagtaacacagtgaaagctgttgacattccctgcttccttcaatatgaaacttccccaacaattcaaagtcacaatccatgatctactacttagagttcaaagtacatcattcatcacaatatagtccaaatagtttctaggagattaaatgacataaacacaacaattgaagaggaataaggaataaaacaagatggatggcagtggctcacacctgtaatcacaggactttgggaagccaagcggg

SEQ ID NO: 140649 - DNA, 358 bp, Homo sapiens
gagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctaggatggctgtggggatcaagggagacagtggccatagggatgctatgttaaccgcagatgcggctgtaggagcactttgctaactgccaacgtgagttcagactcttcaggctatttggc

SEQ ID NO: 140650 - DNA, 368 bp, Homo sapiens
ttcctcagtgctctgtgaaaactctacattcacaagaataaaatcaaaggcacttggaaaataagaatgcagtccaactctccacatctagactgattgggaccaggcagattcagatactgacaaattgaaaatagcagagatgcctcaaaaccagttttctgggagggatgttgaggaagtctaagagtgtcagagggagggggttgctgttgtgtaaactgacatggaagacctcgatttcaagatgataaaagctcagtctctaaggaggagctaaggaagagaagtaagccgagggcgtctttgattgtgtagtaagggtggaaggtgattttatcggaatgggaggtgattcctagggggtt

SEQ ID NO: 140651 - DNA, 112 bp, Homo sapiens
ttgcataagtaactgttgggatgtgccattttttcaaagagaaggcactaagaaagacataaggttttaggctggatgatctctggtttcaacctctcctctacaatgttat

SEQ ID NO: 140652 - DNA, 869 bp, Homo sapiens
aaggttttgaaagtttgatatagtaccttttctaattcccttcttgttgttcctgcttttaatgtgatattcgaaaaacctgccaaaaccaatgttactaggcttctccctatattttcttctaagtgttcaagagttatatgtcttttaattttatgtttttatgtttagtgtgtgtaaagtattttgtttgcattgaagagaaaggtccaagttcgttatctttcatttagacgttgagttttctcacaccattggttggggagtctgaccttttcttcactgtttggtcatggtaacctagtaaaagattatatgataatacttgcacaggtttatttctgggttctttgttctgtcatgtatctttttttcactttatgccattaccacattggttttatttttgtagctttggactcttttgacatcatgaggtatggtactttgttcttttctaaagctgttggctattcatggtaccttgagattacacatgaattttagaattatataaaatatctctgccaaataagtaacattggaattttaataaggatgacattgaatttgtacaatactcagaaatattgacagtttaacagtattacatctcctggctgagaaacatgtatttgtgtctgtgtttgtgtgtttgtgagtgtgtggattggcatcagagatagtgctgagatgcaagacaaagagttcaaagtgtttccttggcctgtctctggtctcctgcacaactcttaacatacagaaggtaggctaaccacttgatcctcaactggtttatcttcttagatgtatcattgtcaagttggtaggaaaataaaaattcctttcacaagttgaacacaattgtc

SEQ ID NO: 140653 - DNA, 360 bp, Homo sapiens
ggtgtgagccactgcgcctggcctggatttctctatttgtttatgcgaaatcgtctactggcattaccatctctcaaaacattttcctggacttttaactaaagattttttccattgtaatgggcacaagtgcaatttccctttcattttaagagactgtgagaagtaacaaatcaggtaagtaaaattattaaagaaggaactagcacttaaaaaatataatttataaaaccaagttgcctaagagaagcgtcagcttacaagactttgttacttcatggcattaatagtttcaggaacattataatacatagtttaattttctttggtgtttgtcgtgtttggggggtggaggtactt

SEQ ID NO: 140654 - DNA, 114 bp, Homo sapiens
tgctgggattataggtgtgaaccaccatgcctgcttgggatatttaatatattctctggaatatgaaagaccaaagggcaaaaaaatagctaagacacactcttgaagagaaag

SEQ ID NO: 140655 - DNA, 648 bp, Homo sapiens
gctgaaagagtgaccaattcctgaaaaaagaaaagagacaaggagtaacgagaatataagttcccaacagaggctaatctatatgttttctaaagctgggaaaataaaacgcaatcagaatatccaaatattttgcaaacactactaagacatttcatttggtccaagcccctgatttatagacattataaacaattgggcaaagcacaaagcttgctggagattcttcaaaagaatgatacaaacagcaggaagaaaattaataagcaacagatgcatgcatgagcattctgtgtaactggctgtgagtacagcatgtgctgttttgtttgtgcatgagtttccttaacacatgcactatttgtatctgtagatatcataccaaaaaaatcaccattacgaaacaggcttacatattatcaattactacaattttaacaaaatgcataaagacaagtattcatggtgaaaaaatacatatattttacctctcagtcacataccttttttccttcaaaaacaaacaaatattggataagaaaaggcaaagcaatagtttgccagagaatcaactgatgcacttggttgcgagacaggttttaaatgtgcaaattacttccatccaatagttcgcttttgtttcaaacc

SEQ ID NO: 140656 - DNA, 430 bp, Homo sapiens
tacagtcacactaaatgttttcagaactttattaattttaagtgtatcaacatgtttatagctgcaatgttttctttagctctttccttaatgatatctgcagaatgaacagaactgtcctctatgacccccataacttatttgttagtctgtgatgtactcttatcaacctctttgtgaatctatactcaagacaaatgtatttttctaaagaaaaaagtagaggaacttaccctgctaatttttagtgtttttttcctctgaataatcaaatactgaagaagtcagactacgcacagaaaaggtaattcagtgtctacctctcttatgttttcttccaccttgtattactattgtgatgaataaagccaacaaccacttcagtctaccaagcctgaaaccctgtgaactgctatttactctttcttcc

SEQ ID NO: 140657 - DNA, 353 bp, Homo sapiens
tctagggggatgaaacagcgcaatctctgtagttaaattcttgagttaaaatgaagataaaattattggggaggtggggatagagctgaggggtgaaagtgggaggagaatggtttctggctcccggcaggttcatgaaagagaaagggtcttcttcctgagcagccttccgagagtgcctcatacctaagacagtcagccctgaccagcaacaatagccgagaaagggcttgtactggccatgccagagtctagagggaagagcttggggctcagagactgagcagtcctgcgtgctcctgtggtggcctaatgtgacctattatccagcaactcccatctatttctgaaaa

SEQ ID NO: 140658 - DNA, 256 bp, Homo sapiens
atcgcggtggccagcgtcagcgtttgacaaaggaagtactcagttacaattaccttcctgttggccagcagctcagataattgctttgcaatgtgtgtgagaacctcataaattaaaccaagaaacagaggggccaggtctgggctgaagggaagtgtcaagtggaggaggcagtgatgcaaggctacctttgaagtcactttgtttgtgaaaagtctgctgtgctctcttaaggaaactccactggaatgaggtt

SEQ ID NO: 140659 - DNA, 1189 bp, Homo sapiens
aagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggtaatggagctactctctactggatcacttttcctacaaagggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatgattacactaaaggattgtctccatacctatctgttcaaattagagctctcatatgtgtttccttgtgcacttaatctacaccttgaaatagatctggattatccattggaaagtgtctccacagtttagcattcttagattaaacatccatgtggtaaatgtgcttgctgcctctttgctcctgttgcatctgtatattataaatgactgagttctggcttatctgagaaac

SEQ ID NO: 140660 - DNA, 791 bp, Homo sapiens
tttttgtttaaatgaagatcttcaaagatcttagagtctggttgaggggaaaggatatcaaaagaatatcaataaacataccagtgagtatatcatttgtgccagtgagtggtatagacaaagcctcttattaactgtttattattttccaggggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatgattacactaaaggattgtctccatacctatctgttcaaattagagctctcatatgtgtttccttgtgcacttaatctacaccttgaaatagatctggattatccattggaaagtgtctccacagtttagcattcttagattaaacatccatgtggtaaatgtgcttgctgcctctttgctcctgttgcatctgtatattataaatgactgagttctggcttatctgagaaac

SEQ ID NO: 140661 - DNA, 696 bp, Homo sapiens
aagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggtaatggagctactctctactggatcacttttcctacaaagtaggagatggtggtagtggggagtgttatttagacaaaagcaggaaccattcaagagaaccctagttgtgacttaggcttcataatgggaccaatccaatgttctcagtatgattcaattgagtaaatatttattgatcatattc

SEQ ID NO: 140662 - DNA, 1149 bp, Homo sapiens
aagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatgattacactaaaggattgtctccatacctatctgttcaaattagagctctcatatgtgtttccttgtgcacttaatctacaccttgaaatagatctggattatccattggaaagtgtctccacagtttagcattcttagattaaacatccatgtggtaaatgtgcttgctgcctctttgctcctgttgcatctgtatattataaatgactgagttctggcttatctgagaaac

SEQ ID NO: 140663 - DNA, 1016 bp, Homo sapiens
acgagaccaagaaaaatgtacatcttgcaaactagcaaaaatggtaaatattaccattggtgtggagtatgtggaataatcatattacagtgaagtctttgaatttacaatgtgattgatgatcaggtttcactgtatgtaatgtaagtatcctcatgtctgaaagaagaacttggtaatgagagcagaggtgtctgctttggtgaccagctgccctggtttgccaaggactctctcaagccctcagtcctgggcaagctggggccattggtcccactagtgactgcccagaattgattactccttatgggatgaggagaagtcaaacctctaggagttgagcttatggatgctgtatgtcagacttggtgttaggccctgggacacaaacatgaggctttattctgtataaaaagaacaacacataggagactgattagcatcctttttcttctgaaaaccacttacccatagaaaaagatttcaactgaggaccaacatttagacggaaggttgggactgtttttattaccttagatttccaagttgtcctaaatataagatgcagttcataaatacttattggaatgtgagctttcagttgaaaataaatacactttctggttttgtttttgaaaaagccaaatctaaaatattgcagttgttttttttttttgtactttgaaggtaactatatggagcaagaatattattcagatattattcagtggttgcaaaaagcaataaataattcagtctgagattttgactggctaagagagaaaaaggcgggagaagaaaactggaagaagaacagaggagttagcaggtgacccccagaactggtgcggcgtgtgtccctccattactctgcaggctcccagacggtccttttcaactcccactgcacattggaaccacacaggaagcttaaagaaagtgattgatgcctggctcctccagggaccactcttttttctttttgttctgggattggcatagtgcttgacctgtaa

SEQ ID NO: 140664 - DNA, 921 bp, Homo sapiens
tagaacacacttgtctgaaattatgaacaaataatcatttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacgggcatgcaccgccatgcccggctgatttttgtttttgttttttgtttttttttgagatggagttttacccttgttgcccaggctggagtgcagtggtgcaatcttggctcactgcagcctccgcctcctgggttcaagcgattctcctgtctcagcctcctgagtagctgggattgcaggcgtctgccactacgcccggctaatttttagtatttttagtagagacggtttcactatgttggccaggctggtctcaaactcctggccccaggtgatctgcctgccttggcctcccaaagtgctgggattacaggcgtgagccaccgcgcctggcctgatttttgtaaagatggggtttcaccatgttgatgagtctggtctcaaactcctgacctcaggtgatgtgcctggcctataaagcagttttatcttcccataacattttatatgctttttaggattcataaatacttgctaactagttcctaaaagggctgtttcatgggatgtcattattaggcttgggaatgtattgatcttactgttgcaccatttttttgttgttgtttattaagaattttatacagaaagtgttgaataaaatctgaaaaactttaaaagattgttccgttttacataggatagacagcttgataactgtacccgtgtcaccctgagtctgat

SEQ ID NO: 140665 - DNA, 357 bp, Homo sapiens
aaaacatcatccagttctctccctcaccttattttgtatatgtgtctctgaagaactagaaaagatgagttccaagcacattataaagcaagagcaatgctactagaataagtatagtttcccagaatcacttttagaaagcactcacttgcatttttagttctaatatgcttgttttaaaaatccctcatgttttcaaacctcaacctttttattaggtctaccataacggattcttcttcactcaggagaaagtaatcatcttgattatcccaacatttctaacatgataggcaaaaagttcccctgatttttttcatgcttttcttctccttaaattcttccatttacaccttc

SEQ ID NO: 140666 - DNA, 234 bp, Homo sapiens
gacgctggaggccggagcctgggcaggtgctgtgggttcaggcgggtgatgcttgagggctgggatcaagcctggttggcgcgtggatgaggaaaagagagaggggcaggggcaactccggtgaatgatgcggttgggggctggggggcatctgggccccccggaatgcccctgactggacttagaggctgggagcggattgaagccccagggcggccgggggagaacaggatg

SEQ ID NO: 140667 - DNA, 735 bp, Homo sapiens
catataatacttctgcacaaaccccttttcttagagccactttacttatctttacgacagaaaaatagatatgaaatacattttttgacagtcttttgccagcacaataaaaatatgaaccaggaagctaagtaaagttttgttttgtttcattttctctttgccctctgaattcctttacttggtcatgcctctttggttcatctaaaccccaggtatgtcctctctacccaccgactctcgatacagagtctttccacatacaaacatatgctcttcattgatctatacctttgtttctccaaatctttaaaattggatattttggtgactttaaagattctcaagcatattcatatttccccatgtcttatttgcacagctgtttctgcgctaatgcttcacttggtatcaaggtatcaaagctgagtcagccctagaatctgtctttgaagtccagggtctgtgaggaactaaaagtttcatgtaagtatgatgaaacatgtgaaagcatcgtgcacacattactgtggtaacaaagaaaggatgagcaattctacctcagaaagttagtgctaaaaccatcattcacatgaggaatatttgcccctacatttgaaaaatgaatcggagccttttatggaaagacatcccagatggagagcacaacattttcagagacatttgctcaggaaccacagtagtggagaactgtggcattgctggagagaggaa

SEQ ID NO: 140668 - DNA, 231 bp, Homo sapiens
tctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggca

SEQ ID NO: 140669 - DNA, 1394 bp, Homo sapiens
tgttactaacctaataggagtgcctagggaagtggctgtttcacagtttggtgagatgtttggggtcatctcaccaaagaacaaaccagaccacagttgcccaggtatgtcaaggggtcagtgtagggtaggtgctaaaagtgaaactggtccctctgaggtcacctgctcttggctgtgagtcctagggtccaggacttgggtgcccccacagctctgcactcatgattctgtggctctctgtccatctggccacagttcagaagccaggctttctccacccttacgcttttgtcaatttggtttaatacataaagatggtttagttcttgcttgtcttttaaacaccttcacagatatcatttgcaccttgccaaaggtgagagatgaataaagcaagaatattatcttcgtttaacaaggaaacccaagtaccaaagagatgatgtgatttgcctaagaccacatgatttctctggggcaggacctgaactccagcccagcattcctgatccttaccctggactctggctccctgggccatgaggggagtacagtagtgggaaatgcaggatacactccagggactcgaatccctgagtggcaggcctagttctttccccagcgggtccggggccttcgagcttcaggcccaagctttttgtggcaacctgtatgaacgcggagggagaagtgccctagaccagactccagatcgttcctagtggggctgtcagcggctttagcctcactgggcgctagatgggagtgtcccctccgtacccggacgaaggcggggcgcccgctggcaaagcgcattttccagcgcaagctgttggggtgcggggctggcgagtgagggaaaacagagggtggcgcgcccaccatcagcgtctgtgcagccccacctgcgccgcgggttggtctcagccggatcctgcagccctcatcgagcaaaggctgggcgcggcgcccccactgccggggagggaagaggctgggaggacgcaacaggcccaggctgtgccgggcggggagcctcggcaggcagctgcacccccagccccagagggctggggaaggccggcccgaccagcagacggaaaggtggcgctaagtcgccttcaagcccgcacggctctcccggcctttcctcctgtcctcagagtcagctcccccgcccgggacgtcccgcgccactccgcgcctttggccctggctcaaggtcttgtgatgtgattagcaaagccagcgccttgtcctcagacactcagccctgcccggcaggccccggcgctcaagccctgtttactgagcctgggcggggagggggcggagaaacgagcccgggctccaccggcaagactgccgcggcggccgcccgcgtggccacc

SEQ ID NO: 140670 - DNA, 316 bp, Homo sapiens
gatgtagtctgaggttgtgggagagtgggtagcaaggagaggctctgctgtgtccatgaggcagctggctgtctcctagcagactgctcacacatctacaccatcccttctctaactcacctgctgagctctccttccagaggtacccttcactcttacctctacagccatccctcagtgtccgagggggattggttccaggacccctgcagataccaaaacccaagcacgctcaagtcccaccgtccaccctgtggaacccgctgatacacaaaaaggcggccctctattttacatcccgagaacactgcatttt

SEQ ID NO: 140671 - DNA, 845 bp, Homo sapiens
atcacttcctgaatgtaatggtacaaaattaagatcactcataatagtctgaagtagaaacaacccgaatgaatgcttactgactgatgaatggaaacaaaatgtggtatatttgtacaatggaatattattcaaccataaaagggaggtacttatacatgctgcaacagacagaccttgaaagtattatggttaccttgttagtatagcgaagacagaaagagagaaagagagagagaaagaaaagaaagaaagaaaaaaagaaagaaagaaagaaagaaagaaagaaagaaagaaagaaagaaagaaagaaaagaaggcattatgctaaatgaaaacagtcacaaaaaactacttattatatgatttttgtttgtatgaaatgtccagaatagggaactctacgatagacagaaagtagattagtggtttctatgggctgaggaaagtgaaagtggagggtgacagttaaatgtttctttttgaggtgatgaaggtgtcctaaaaatgtggtgatggttgcacgtatctattaacatactaggccgggcgcggtggctcacacctgtaatcccagcactttggaaggccaaagcgggcggatcacctgaggtcaggagtttgagaccagcctgaccaacatggagaaacctcgcacctactaaaaatacaaaattagccgggcgtggtcgcgcttgcctgtaatcccagctactcgggacgctgaggcaggagaatcacttgaacccaggaggcagaggttgtggtgagctgagatggcgccattgcactccagcctgggccacgagagcaaaactttgtctcaaaaaaaaaagaaaaaaaaa

SEQ ID NO: 140672 - DNA, 436 bp, Homo sapiens
agagctaggtgaacaaccccggacaaggtagggatgtgtagttataatttgtcacacgtggtataaccaatgatgtgagctaattttttacattattgactctgttatagtttactgaaactgtatgacattcagaaagatacttggttaaaaactagccttagctcattgatatcatttgaaaaagacatgtggaagaatgtcctgtggtaccacagtggctttagctatctgacctttgaaataaatgcttgaacacataagtgcttcctcaaagatagatgtgtatgctgcagatttaaagaaaacattgaaatcttaatgttggggaataagaataacctctactatgtttactttcagtgttagaaataccttattattatgtctttttggccacagagagccttacatcatctgaggtttaaccaaaagt

SEQ ID NO: 140673 - DNA, 584 bp, Homo sapiens
agcaagttcaggggcacttttaacagacacaagcccagtttagaagaaacccttagaataaaaaagagcacacagggaataggtaaatgggaaaagctaacactgagagcctttaaaccaaaacctggtggcaagtgaccctgcagaatttcctaatcgcttcctttaatcctcttctaactgcagttgtgccagattgtaacacgtttacttttcaatacctgaatttgagacgttggaaatgctgattattccttacgaaggcttcagggtttaaaattcacttaatacagcctaacagcaaaacttgggaggaaatcagctcagctgacataaccaaagataataaaggaaaaaccaaccaagttaactgctgaattagtgtcagttaaaacaaaaatggaaaatttaaacagtcttctcaagcaggcttctcatttgtgcccagaagtcactgaaattggtgtggacattgctgatgcaaagattttgaagagaggaggcaccatgattgatttgggtggtggattcagagaagcagggtactctgaaatgagcaggatattagcacatggtgaagaaat

SEQ ID NO: 140674 - DNA, 466 bp, Homo sapiens
ctctcttatacaacaatataaacaaatatagttcacccaatgtgctagaattactctctattcctagatatagattagaaatgtttaaagaaggacaaaaagtatctggtgagtggctcacattctcaagctaatgtctacagttcttcaaattttataaatatttttgcttcttaatgctatgatgacagttgagcagggagcagcggtcagagaggaatgggaatttagcaaaactgtcagccttccctgttgtgaaacatacatggtattatggaaactcatatgctgctctgtgatttacatgtacgattcactcccgcctcaagttcaccacattgtgagcagtgtggttagcacattcgctaagtgtgtctttgaatgaatgaattctatattttaatgtatattaaaattgtatagaattttgtcaagaattaaaagataggaaaataaaaactacaaa

SEQ ID NO: 140675 - DNA, 140 bp, Homo sapiens
ttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgat

SEQ ID NO: 140676 - DNA, 585 bp, Homo sapiens
ctactcgggaagctgaggcagaatcgcttgaatccgagaggtggaggttgtagtgagcagagatcactccactgcactccagcctccgtgacagagccagaccttgtctcaaaaacaaacaaacgaaaaagttctaaatctagatatgttcacaagactgaaatgtacatgtagagttgatggcaaactaactcctcagttgcagattttgatctgacagttctagaaatgctgtccacgagcctctggcagagacaaatccagcgaatcgttgctcacattaggtgcatagtaggccgggtgcggtggctcaggcctgtaatcccagcacttggaggcagaggcggtaggatcacgaggtcaggagatcgagagcatcctggccaacatggtgaaaccctgtctcaactaaaaatacaaaaattagccgggcatggtggcgggcgcctgtagtcccagctactcgggaggctgaggcaagagaatcgcttgaacccaggaggcagaggttgcagtgagccgagatcgcgccactgcactccagccttggcaacagagcgagactgcgtctcaaataaataaata

SEQ ID NO: 140677 - DNA, 654 bp, Homo sapiens
gtataagcatggagagcggtataccagggtgtactccagagtgagcaaaatgggaactcatgtcagaaagtgaaatgaaaatgtaggctgaaattctatcagtaatactgcaacaaaactctctgaaaccatctcacttaactcggtccaccaacttgaaagacactttccttttcatctgtgaagcccactgctggggctagcaggctactattatgactaagcaattccacttccatctctcaagctgtttacttcctgaaaggtagctgtttgatccaaacctgtttatgccagaagttcttgtttaatttactatcaaactaatgaaattaatgcaagacagttgtttatacacaaaccagattgcttgctttggaaagactaaaagggagttgttaaaagaaaaacatgccaggcgtggtggctcacacctgtaattctgcactttgggaagccgaggtgggcagatcacttcaggtcaggagttcaagaccagtctggccaacatggtgaaacaccgtctccactaaaaatacaaaagttaaccgggcatggtggtgtatgcctgtagtcccagctactctggaggctaaggcaggagaatcgattgaacccagggggtggaggttgcagtgagctgagatctcacca

SEQ ID NO: 140678 - DNA, 313 bp, Homo sapiens
ggaaagagatcagagagattgtggggaggtgggggaggcagaccacctagggttttgtgggccatggattttactctgagtgagatgggagcccctggaaggctttgtgtagaggaggggtagaactttgttacatgttaagatgatcgtgtggacataaaaaggaggtagaggcagaagcaaagaaagtagttaagagtctattgcagtatctcaggtgtcttagtcctttcttgctgctatacctgagactgagggatagcagaaatttctcacaacacaaatttctcacaatcttggaggctgggaggtc

SEQ ID NO: 140679 - DNA, 333 bp, Homo sapiens
gatgttcactattttctgagattactaacctttctttaaaaatatgtgtttgtggctgggtgtggtggctcacgcctgtaatcccagcacttcaggaggccaaagcgggtggatcacgaggtcaggagttggagaccagcctgatgaacatggtgaaaccccgtctttactaaaaatacaaaaattagccgggcgtggtggcgcgtgcctgtaatccctgctactctggaggctgaggcaggagaattgcttgaacccgggaagcagaggttgcagtgagccgagatcacgccactacactctagcctgggcgacagagcgagactccatctc

SEQ ID NO: 140680 - DNA, 193 bp, Homo sapiens
ggggaaaatatgctgaacaaccagggcagaggtgccattcctctgctaccattcgtttctccactgcccttcagactcttccatctctcactgtactttctcgcacactgtctttcctccagctttaattcttcctttgccctctgctgccctttcagctccttctgtctgagccccacagttcatcagtact

SEQ ID NO: 140681 - DNA, 324 bp, Homo sapiens
atttggagagattttgtctaaacaagaagctcctggtgtctgagacagagtagaagtagaagtcaaagatggagtctgatgtcctgagctgggtggaggcagtccaactaatccacacactcacgatgagctcactgatctacatagacaagctataaaaacacaaggctcagatcaactgccttgggacctgctttactcattcccagcatgctttcacattaatcctgttgccactgaagaagaaactatcttccaagggctctaaatgtcatttttatgtttgcctggtctgtcctagattctagaagaaaagtcatctga

SEQ ID NO: 140682 - DNA, 390 bp, Homo sapiens
aaccctaagaatttcaatatattatgagtcagtgaaaatatagtatttgttgttttgtttccctaagtgcccaattgagagatctggacaattactattatagagattgtgaggatggacagagaaccttttgttgactgaggtagtcaaagaaggaaggctaccagggtgagctaggattgagcagtgagaaggattgtttctatgtatggagaaaaatgggaaagagggaattgtggacagagcagtgtaagcaaggatacggaaatagcaaagtacaggtcatttttagggacagaagatgaatcagtttagcattagaagatgatgaaaaagtagtctgaagttaaagtatggaaagccttcttcaaacataaggtcaaatacagc

SEQ ID NO: 140683 - DNA, 915 bp, Homo sapiens
ggggagggatatcataggtaattagatcatgcggttaattcccttaccctgttctcatgatagtgagttcccacgagatctgatggtttataagaagcttttcttccctttgcacgatacttctctctcctgccaccatgtaaagtaggatgtgtttggttccccttccactgtgattgtaagagtctgaggtcttagcagccatggtaactgtgagtcaattaaacctcttttcttccaaattagtctcaggtatttcttcagagcagcattaaaataaacttaccagtaaattcgtactgacacagtggggcactgctataaggatacccaaaaacgtggaagtgactttggaactgagtaacaggcagaggctagaagtttggagggctcagaagaaggaaagatgtgggaaagtttggacttcctagagacttgttgaattgctttgaccaaaatgctggtagtgatggacaatgaagtccaggctgagatggtctcatgtggaggtgaggaacttgttgggaactggaataaaggtgacccttgctatgctttagcaaagagactggtagcattttgctcttgtcctaaagatctgtggaaggtcgaacttgagagataatttatggttatctggcaaaagaaattaagcagcaaaacatccaaaagttgacaaagcataaaagtttagacaattcacagcctaatgatgtggtagaaaagaaagacccattttctcagaagaaattggctgcagaagtgaggagcaaatgttcatcaccaagacaatggggaaaatgccttcagggcatgttagagacctttgtggcatctcctcctctcacacacctggaggcctaggaggcaaaaaatatttcatgggctaggcccaggaaaccctgctgtgtgcag

SEQ ID NO: 140684 - DNA, 249 bp, Homo sapiens
ccttctaaggagaccacccactagaatcccttgctctcatttgtgtctaattttatctgatctccatttattcccaaaaggtactattacaaaatatatactagtgtttaacttcttttaaaaagctgtcggtcagacacagtggctcacgcctgtaatcccagcattttgggagaccgaggcaggtggatcacctgaggtcaggagttcgagaccagcctggccaacatggtgaaaccccgtctctac

SEQ ID NO: 140685 - DNA, 435 bp, Homo sapiens
attatactagtgccagagtaaaagcaatgcaagcagcaactactttttcttgttattgagaaacacctagtctaattagataaggataattaattcttaatttcttctgatgaagagttttcttgcagtagaacaactttaccccattccaacaatgtttatcatttagaaaagctttaaagagacttctgcttgagtctctgacccaagtaatcctgtgatacctacacagggctaactactagtcttggcctcctgtatgttttaaccacctcaccctttcatcaatgaatcctatctgctcttcagatgctgggagcatactagataagtagataattttaaaagtatccattcaaaaataggcatttcatgcctataatcccagcattttgagaggttgaggcaggaggattgcttgagcccaggagtttg

SEQ ID NO: 140686 - DNA, 453 bp, Homo sapiens
gggtttaagcgcttctccagctcagcctcccgagtagctgggacaggaacacaggtccctctcagatggggcaggtgagtcaaggctcgtgtgtattgctgtctccatcaggcgctcttttaaaagaatggcaaagcttttaatcccatctttattaccggtaagagtgtagggggaggatctggggcatagcctgggtctggccttagggtttctagaaaccaggggatatttttctaagaagatagagaatagagctttcctagtgtggttagacctagggaagacctttcttgcagtgcagcaatgcagaccgacttccaatccctaggtcaagctggagtctagggacagaggggaggagacccctgcctcctgtgcccagcctcaacttgtctcctgaccttcatggagtcacgttgcagctgcctccctcctggcttatgtaataat

SEQ ID NO: 140687 - DNA, 531 bp, Homo sapiens
acttcacacaataatgaccatatccctatccaggtcctgggcaaaggactttcttctctttcttagaaaaatgaaggattttttttgtttaaatttagcagtttccgcatcatgaagggaccagtcaatgacactcaggtaaccccaatacagtcacaaattccaagcacatgaaagcccgtgtttctgctaccagccagagtgggagtgtgcccagaacacagtccccaccggggaagcccagctcgtcagtaccagggtctcttctccttctccccgcttctgctaacgcatgcactgagcaacttcctggacagacaagccatttgaaaacaggattccagggaaggatgcctgtgatcaggcactgtggtcattaaatccgggttatgccgaggaaaccaggctggggggatacagcccattgtgcctccaagtgggaggttaggatgaggtccctcagctggccctgacaggaacactgggccaggaatgagcccaggccaagcaaggccacggtactcagggagc

SEQ ID NO: 140688 - DNA, 259 bp, Homo sapiens
cctgctgccgccattgagatgtatatgatctggactcaggctctgaaggagacaaagctacacaggctactcagcatcttcctcatttttgtactaagtcattgaggtcctttgtcctttcttggtctggacacaaagaaggacatggccattctaccaacctttctgagacccacctgtctctgttgctggtatctctgcaaagctacacccagcctcagttctgcaactctgcaggtggactgctggctcccttttg

SEQ ID NO: 140689 - DNA, 1048 bp, Homo sapiens
gagaaggaactagtgtttggtgcagataataaccaaaatagtggagaagagagaatgacaaatggttgcaaaatgatctgccaaagtgcagcaaagtatgaaacctgcagcattacaaaaactaagttgcagacttgccatataaagtgtggcgcccattgcttttcaagcctcctggaccagtaataggcagcttgagtgggaagaccacaggagtagcttaaatggcactaagaaatcgctatcccagtggtctagtgtggtcaggaagtcagtggtttgaaggtggaaccagataaggactacaggctgtagtcacaaattgttcttccaaaacactgcccttgcatttttttcccattgtttatagctgcagatgcctgactactccagtgtaattaaaatatagctctgcaaaagaaagatgttccattagcccctgcctcccctcaccaggagacagccttctgtggtttcgtttacaatttaacatggtttactgatatacctaccatatttgttaggattttcatattgagtctttttcattttattttctaatgggttttgttctctttgtttttgtttcaatttacttaaaacaaaacgcacgcctcctgcattggccacctgctgcggcaccaaccccttcatgcattgcccttttcttgctgctgtgttgggatggtgcgcgcaccaccctcactcaccctccatttcttgatcactctccatgttcttgcacctctgccttccacttcctggtcatagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140690 - DNA, 1295 bp, Homo sapiens
gagaggaggaaggggggcaggagaaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140691 - DNA, 328 bp, Homo sapiens
atggatgttcactgtataaatcaatgtgtaaatgtgtccgagaactccagagttgatgagggcttgtaatgcacttaaaggtagctcaccacaagacagtcttcctatctaaaatcagcattgcagtcccagccatttcctgaagctaccaccctcactttctccccaactctgaaatgcttttcactctctacctacacctggactgaccctgacaccctccagtcacaacaactcacatggactgtcctccctcaggacttcagggatagccctcatttctttggacaagctctagcccgaaacctcactccttcacccaagctaa

SEQ ID NO: 140692 - DNA, 238 bp, Homo sapiens
gggcgaattctactctctgtgcgtttgtgtatgatatgtttgcggtttcgatgatgtggtctttggaatagaaacctgtgaggaaaggcattcctgctaatgctaggtgccaatggtgagggaggcatgaaagtcattgagagtcgagcccaaaaagatgaagaaaaaatggaaattcaggagatccaactgaaaggatgattcaagaaactgtttagctgcccaaatgaaaagtggc

SEQ ID NO: 140693 - DNA, 1563 bp, Homo sapiens
caaaatctcaaccatgatcttgagatggcaaaggttttaaatacgttttggaaatatactcattggtatatttcttttgagaaggctgaaatgtagctggggacagcaggttgatcacaagggacgatgatatgaggtaagcacacaagagctatggacaagacaaggtctaaaggattttgaatacaaagcagaaatatttcgaccttctcatttctggggtgggagtggggagtgttcattaagtacatatgacaagagggagtgtggggagaaggtgaaacagtagactacatttatggattaagtagggaatgtgaacaaagatgttaaagtcatggcgatccggtagacagattacacagaagagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140694 - DNA, 861 bp, Homo sapiens
ttcaaaggtcgccttggagtttatgtactgtgctaactgccatttctcacagaggtgactgaaactgacaagtagtttctgatccattttataggtgatgtgcttcattttcatcctctagttttccctatgtttgtagctacaggaaacataaaacttcccaactttaactcaaataaatcattacaggctgagactcgggctgagtttgcggagaggtcagtaactaaattggagaaaagcattgatgacttagaaggtaagatcttaagtagtgtttttagtttaatccttatggttgaataccaacctggcaaaacaattttccaattcaagggcatccacattgatacgctcctttgcacttgcacattcttcctgtgtgtcctctggggtttttctctgtggctcttgaactcatgaacctaagtcttctgctcacgaggtgactagttagccaccagccatagtggcaaatgccatccagcttgacttcatgctcattagaagtgtggcaggtttatttttcactgtgagtgaggtgcttattggtgagaatgactctagtatattttatatctttagtgttacttcctaattaaattgggaatgatgtggtgattgtggtcttgtttttagaagaacccatcttcttccaagtatgaattcaaagtaaggatttaggggttattttaagtcatatattatcttaacaaaatactttatatcctgaaggaggagggaaaaattatacttaagcatttcttccctaaggcacttaggttttattttagtaataaccactctatctcacagatatcctaaatgttgagctttgaagcttgtgaaggattagctgtg

SEQ ID NO: 140695 - DNA, 262 bp, Homo sapiens
  misc_feature (21)..(21): n is a, c, g, or t
ccggacctcataggttcgcgnggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgtgttttgtttttaacacctgcgacctatgaggtaccgg

SEQ ID NO: 140696 - DNA, 403 bp, Homo sapiens
tccagcatcaacccgggaaatggcacatttggaccaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140697 - DNA, 143 bp, Homo sapiens
tcaagcttctaacgatgtacggggagttaaagatttagacaccacatacaactggtaaaggacgttttcttgagagttttaactatatgtaaacattgtataatgatatggaataaaatgcacattgtaggacattttctaaa

SEQ ID NO: 140698 - DNA, 445 bp, Homo sapiens
  misc_feature (5)..(5): n is a, c, g, or t
  misc_feature (24)..(24): n is a, c, g, or t
  misc_feature (29)..(29): n is a, c, g, or t
ggtcnactactactaaattcgcgnccgcntcgacctactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140699 - DNA, 1693 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140700 - DNA, 2454 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaaaaaaaaaaaaaaaaaaaaaaaacaaaaaaaaaaaaaaaaaaaaaaaaaaaaaaaaaaaaaaaaaaaaaaaaaaaaaaagaaaaaaaaaaaaaaaaaaaaaaaagaaagaaaatagagaaaaaagaaacaacaaagacgacagaaacaggaacagagcgcccgccacacgaccagaccgagcgggccgccgcagaccagaaacgacaacacagaaaaccaagcggaggaagaggaagacagggcagaacaagacgcggcgcgaggagccagagcaacaagaagctgacatggacagtgcacgggcacaccgcacggacgagacgcagcgacagacagcaagtccccgaccgcgcagcaaccagcgcgcgacgaacatcgacgcgaaacgaccgagagagcccacgcgccacgcgagcaagcgaaggagaagacaccacagaaaagagcatgcgactcacggacccaacgcaccagaccgcgcgagcgaccgcgggcaccgacgcccgcgaacgcggcccagaccaccccagccccaggcacggagcgcggcgaagcgacaaaag

SEQ ID NO: 140701 - DNA, 1694 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140702 - DNA, 1934 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaagaaaacaacgcaacacaacaatcacacacaaccaaaaaaaagg

SEQ ID NO: 140703 - DNA, 2210 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaacacgaaggaaaacaaaaaaaaagaacggcgcagaacgagagagacacaacagggggggacgccaagagaggtacccccgagggggccacaaggaggggaccacaaggtggtgtagagaaagggggccccacaggcggccgcggactacaacgaacacagaagagcgccgcaccactacacaagcgctaggaacggggaaaacacacgaacggggaacccgcggaacaacaccacaccatgagcggagcaacaaagcgagggcaaccccccgagaggctccgcgccgcggcgagcaaacacggcgacaagcacaaaggac

SEQ ID NO: 140704 - DNA, 2260 bp, Homo sapiens
  misc_feature (2246)..(2246): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaagtccaacaaaacaacataaaatctaaccagaacataacaaagtcttgggggcatgtggattccgcttagcaaagcatctttatagcccatatcgatgaggaacctggggcctcgccttgggtaactgtaaaccctcctattgcgtcatttcccaaccgatgggaaaccacggagtttagaaaacgatttccgcaggtttttgcctgcctgatttaaaaatactcccgtggggaatagtccgtctgattctggaccataagacgtcgtactgcgtctttcctaggagtcacaaaaggggcgtacaattgccgggaggtttgcccatgcattcttcctagcattttagcccatttgtgggccanctatttacagtatg

SEQ ID NO: 140705 - DNA, 1951 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggggtaagcgggcccggcgccaggaggccacgaatggggtgctgcagagcagtgactaaacagcatgaccttctggcagctgcacattacctgtttcagctccgggctccttttgtgctcatttgatgtggatgagccacgagtatggaacatggaggactcgtgtggggtgtcttatgtatgaatgcgtgtatcactgcatgccttacctgcacactgattttgtgaatggccttgtgcatttcctgtgtccactaacaccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140706 - DNA, 2206 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140707 - DNA, 1140 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140708 - DNA, 1848 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaacttggttttggcaggttatttttggggggcccggcccactcggcttttccacccgg

SEQ ID NO: 140709 - DNA, 3407 bp, Homo sapiens
  misc_feature (1037)..(1037): n is a, c, g, or t
  misc_feature (1049)..(1049): n is a, c, g, or t
  misc_feature (1056)..(1056): n is a, c, g, or t
  misc_feature (1059)..(1059): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcgcagaaggaagacagatatgaggaagagatcaaggtcctttccgacaagctgaaggaggctgagactcgggctgagtttgcggagaggtcagtaactaaattggagagaagcacantgctgaagatgncgaccgnaantatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatattgtgtgtgtgtgtgtgtgtgtgtatatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctcagaaaacctatttatgtcatctttgcttttgtgagtttgtgttaccgcacaactcccagacttttaactgcctgtaccttggaaatgtctgctgttcgtaacttcttcagtttgtataacagtgctgcagctgtatttggtttttacctctccctgttcccacggcacaccgtcagtgaaccttcaccaaaccccacgtgcattttatcctcagtgaattgttggtggaggtgcacctgactgctctgtgagaatccgtgccatggctcctttgggtcaaagatgccctcccctccgtcttaggttcttgtctagaaatgagtaatgtcttacaagcatgcctagttctaatcatctcatcctgtgtttgtgattgatgtttgcctgcctaaatgtacaaaccaccattgtgtccaaagcacagctattcatgacttaattttctaatctcaccacagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140710 - DNA, 1851 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140711 - DNA, 2892 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatgtaataaactcaccaccatgccttccttgctccctaatctccatctttgcactcttgtgttcaccctttttgtcataacctagaatagtcattgttttttcactttctgctaatataaaggccaattagattaagtctgtctatacaaaccattttcttttcagaatccgtttattttgtaaacgctgaactagagcagtgaactagaatgagtgaccttgagcactgtccttttgggaaattaagctaaactcaagtaaaactagaaggccatgccgtttgttgtacaggaacttctcaaaaaatatcaaaatttgtttcctgaaattcaactaagtacaacataatcattttcgttaaatataatttgaaggaacccttaaagtgtcaggttattgagaatctgaggataaggaaattggcatgatccaatacagctttaacagtggtactacaaaagatcatctcttttacttttaagaattctagagtaggccgggcacagtggctcacgcctgtaatcccagcactttgggaggccgaggcgggcggatcacgaggtcaggagattgagaccatcctggctaacacggtgaaaccctgtctctactaaaaatacaaaaaaaattagccgggcgtggtggtggatgcctgtagtcccagctactcaggaggctgaggcaggagaatggcatgaacccgggaggtggagcttgcagtcagccgagatcgcaccaccgcactccagcctggacgacagagcgagactctgtctcaagaaaaaaaagaatggtagagtaaaaagaaccctctgctgagtaaccaagcctttaattttgtgtttttatgaaaggaattaaaatacccacgataaatatttaccacaacctgtgtcaaataaatgggaaattaaacacagattgtacaatgtgagcttgggagttaatggcccagattttactgttaggcagtaagagttggagtaggtagtcttgttatcatgagaagaaccttgaacagatacaactaatttacatattactaaccaaacttaaacattaaactttttctactactttaaattctaacctggaatgtttcagagttcttcattctaatatcaccctgaattccattgaagctggaaatgtcattttccaagcccacctgtcattcatttacccatgcagaaaaaatggtaacttgaagagagtggcatgtgcctgctgccttagaggttatagaatccccacagtcaacaaaaaagcctctagagacatgactgttgccatggaaaccagagaaaatgtgtcttctcatccctcatttgtaaatgagggggtggagcagatcatctgtctctaaggtctttttcagtgctaaaatgtggtgattctttgggaaaaactttttgcatcaagtatgattaaatattctgaaagacgagtgtagcttaaaatttgttttgtttttaaattctgttcatgggtcttcttaaaatggacccttgccgaaaggcggcctgtgacggcctcaggtgggaagatggatgtccttccaagggtgtggctggcagtggggtttgcatgactgcttcttgtctgtgtttcaagtgctctcatctattggtttggtttcctttcttttttttttttttctcattgtgccactttttttttcctcccacctttttatcttcacgcaataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140712 - DNA, 1437 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgactgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140713 - DNA, 1061 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140714 - DNA, 1465 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaaggtaagatcttaagtagtgtttttagtttaatccttatggttgaataccaacctggcaaaacaattttccaattcaagggcatccacattgatacgctcctttgcacttgcacattcttcctgtgtgtcctctggggtttttctctgtggctcttgaactcatgaacctaagtcttctgctcacgaggtgactagttagccaccagccatagtggcaaatgccatccagcttgacttcatgctcattagaagtgtggcaggtttatttttcactgtgagtgaggtgcttattggtgagaatgactctagtatattttatatctttagtgttacttcctaattaaattgggaatgatgtggtgattgtggtcttgtttttagaagaacccatcttcttccaagtatgaattcaaagtaaggatttaggggttattttaagtcatatattatcttaacaaaatactttatatcctgaaggaggagggaaaaattatacttaagcatttcttccctaaggcacttaggttttattttagtaataaccactctatctcacagatatcctaaatgttgagctttgaagcttgtgaaggattagctgtg

SEQ ID NO: 140715 - DNA, 1378 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140716 - DNA, 836 bp, Homo sapiens
  misc_feature (1)..(1): n is a, c, g, or t
  misc_feature (808)..(808): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtatcgcagaggaagcagttgaggaggtcagtccttccgcagtgaggagctggctcggtggttgcgggagtcatactanttggaagcttgtgcttgagcggcttcgt

SEQ ID NO: 140717 - DNA, 801 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagctcgcagaaggagacagatttgtggagagattccggtcctttcccacgatttgggggactttcacactaca

SEQ ID NO: 140718 - DNA, 1191 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgctgggtcagcatttgtcctgggttcccttgtgtga

SEQ ID NO: 140719 - DNA, 753 bp, Homo sapiens
  misc_feature (1)..(1): n is a, c, g, or t
  misc_feature (654)..(654): n is a, c, g, or t
  misc_feature (661)..(661): n is a, c, g, or t
  misc_feature (663)..(663): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggnaaatgtncnagcttgagaggattaaactttacgacactgagtacttgagctagctagagtcttgagaggagcagatttggaggccttgcctttccgcaa

SEQ ID NO: 140720 - DNA, 1160 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140721 - DNA, 825 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140722 - DNA, 1073 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagaggtgagaatgcctcatcagccatcttttgcagctgcctttcctggtggaataaaccggagggctcctgtgatctttgaggtttaagaatttttcagtcccctggtggtgggatcatttcctctattgatcccaggtataactcggttggttttgttcatttagcattagtgaaacacctactatgtccaaagcactgtcctaagccctaaggttacaaagaagaagatgatcttgttcctgcccttatagaactcaccatctaatgagggagacagacatgtaaaggagaaatgtcagggatacaagttggccctttcactcctactgaccacagagcaattgtgcattttttaaagtgtaactttattttataatatacaaggaggcttaggtgtaaataaaggaactgtggactaaa

SEQ ID NO: 140723 - DNA, 640 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcaggtctgcgcctccccggccctgcgcccgcgcccagagcgccgggactcgagcctggcacccccggctggatccccaccccgaggactcggggagccaccaccctacccccaccaccacccagggcggccagggcgcgcgtctggaaagaaggaagggaaacgcaagagccaggcttagtctaacttagtctggtctgaggacgcttatttcccttctctggttcccatggcccgcgaaatcaagtc

SEQ ID NO: 140724 - DNA, 310 bp, Homo sapiens
tattccttcaaggcgtagaagaacaactcggaagctctaattctgagaacccaggcgtccgagcaggccaggtgcagcatccactgctagagaagcccaatgacgccctatataagagtcgtatgacacacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140725 - DNA, 1802 bp, Homo sapiens
gagaggaggaaggggggcaggagaaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140726 - DNA, 734 bp, Homo sapiens
atggatgttcactgtataaatcaatgtgtaaatgtgtccgagaactccagagttgatgagggcttgtaatgcacttaaaggtagctcaccacaagacagtcttcctatctaaaatcagcattgcagtcccagccatttcctgaagctaccaccctcactttctccccaactctgaaatgcttttcactctctacctagctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtcagatcctggggcccaaagccttgtggacacccagcagtggccttcaggaagccagggagcaatgtacagtcttgattcccgagtgaggccatctgctttgttggcagaaatgggtggttttgagaagcagagttcctttgtgtccagaaaacggttctaattttaatcctgctaggggatcccaggctttatcaggaagccaatcagtagcactgcgaagaaggaccaaaactcctctcccccagccacaaagacccggacaaaagatctttggccggaagg

SEQ ID NO: 140727 - DNA, 759 bp, Homo sapiens
gcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgattagaaaaagaaagaagccaaagagaaaggtacctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagagtgtaggtcagaactgaagtacaaagcatcaggaggagctggacacgtttcaagatttgattccaattagttcttggttcatttttccaagattcctcggtgagtggtgtgtccttta

SEQ ID NO: 140728 - DNA, 1884 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140729 - DNA, 2205 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140730 - DNA, 1884 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140731 - DNA, 2921 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatattgtgtgtgtgtgtgtgtgtgtgtatatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctcagaaaacctatttatgtcatctttgcttttgtgagtttgtgttaccgcacaactcccagacttttaactgcctgtaccttggaaatgtctgctgttcgtaacttcttcagtttgtataacagtgctgcagctgtatttggtttttacctctccctgttcccacggcacaccgtcagtgaaccttcaccaaaccccacgtgcattttatcctcagtgaattgttggtggaggtgcacctgactgctctgtgagaatccgtgccatggctcctttgggtcaaagatgccctcccctccgtcttaggttcttgtctagaaatgagtaatgtcttacaagcatgcctagttctaatcatctcatcctgtgtttgtgattgatgtttgcctgcctaaatgtacaaaccaccattgtgtccaaagcacagctattcatgacttaattttctaatctcaccacagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140732 - DNA, 2030 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaacctagaataaagaaaaatggcatagatcacgagtgagctaagctcgagggggggcccggttcccatttcgccctatagagaggcgattacaattaactggccgtcctattacatctttttagctggggaaaccctggctttgc

SEQ ID NO: 140733 - DNA, 1921 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaacacacaacccaaaaacaaaacaacactgttct

SEQ ID NO: 140734 - DNA, 2505 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaaaacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaagaaaaaaaaaaaaaaaaaaaaaaaagaaagaaaatagagaaaaaagaaacaacaaagacgacagaaacaggaacagagcgcccgccacacgaccagaccgagcgggccgccgcagaccagaaacgacaacacagaaaaccaagcggaggaagaggaagacagggcagaacaagacgcggcgcgaggagccagagcaacaagaagctgacatggacagtgcacgggcacaccgcacggacgagacgcagcgacagacagcaagtccccgaccgcgcagcaaccagcgcgcgacgaacatcgacgcgaaacgaccgagagagcccacgcgccacgcgagcaagcgaaggagaagacaccacagaaaagagcatgcgactcacggacccaacgcaccagaccgcgcgagcgaccgcgggcaccgacgcccgcgaacgcggcccagaccaccccagccccaggcacggagcgcggcgaagcgacaaaag

SEQ ID NO: 140735 - DNA, 2180 bp, Homo sapiens
  misc_feature (1037)..(1037): n is a, c, g, or t
  misc_feature (1049)..(1049): n is a, c, g, or t
  misc_feature (1056)..(1056): n is a, c, g, or t
  misc_feature (1059)..(1059): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcgcagaaggaagacagatatgaggaagagatcaaggtcctttccgacaagctgaaggaggctgagactcgggctgagtttgcggagaggtcagtaactaaattggagagaagcacantgctgaagatgncgaccgnaantatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140736 - DNA, 1885 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140737 - DNA, 1793 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140738 - DNA, 2152 bp, Homo sapiens
  misc_feature (1966)..(1966): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatggtccagaccctggccctatccccagcatggttctcctgttctcctctttggggagctctgtaccaccccggttagcaagataaaggcagccactgatttctcaagggtataccacactgccttacaacatataggcatgttctaggcctcatatgataccgtgtctagaaacatcccatctggggccttctgtacatccatggtcacttctgtaaggtgtgaatatttgagtcatacggagctgagagattctgagtaaagtggtaggcccactttagcttctctcactgctcagtggccctggagcaggatagattgggctggcctactccatgcatccncaaagagtgctctgaggttgtgcagcgctcagttacctattaatcttattcaacaaattcttactaactgctaccaatgaggaaagcctttggtgagctgagcttacattgatgaattcaagcaccctagagaactatctgggcattaaagagaggcttaaattcttttatttattcagcaaattt

SEQ ID NO: 140739 - DNA, 1227 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagctatttctgtttgctattctttttacttcttatttattgacattttagtttcaacattgaataaaactacaaagctgcttcacacaaaaa

SEQ ID NO: 140740 - DNA, 1830 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaagtaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 140741 - DNA, 1888 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaacacacaacccaaaaacaaaacaacactgttct

SEQ ID NO: 140742 - DNA, 2344 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatattgtgtgtgtgtgtgtgtgtgtgtatatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctcagaaaacctatttatgtcatctttgcttttgtgagtttgtgttaccgcacaactcccagacttttaactgcctgtaccttggaaatgtctgctgttcgtaacttcttcagtttgtataacagtgctgcagctgtatttggtttttacctctccctgttcccacggcacaccgtcagtgaaccttcaccaaaccccacgtgcattttatcctcagtgaattgttggtggaggtgcacctgactgctctgtgagaatccgtgccatggctcctttgggtcaaagatgccctcccctccgtcttaggttcttgtctagaaatgagtaatgtcttacaagcatgcctagttctaatcatctcatcctgtgtttgtgattgatgtttgcctgcctaaatgtacaaaccaccattgtgtccaaagcacagctattcatgacttaattttctaatctcaccacagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggttaggtctgggggatcctctatac

SEQ ID NO: 140743 - DNA, 1058 bp, Homo sapiens
  misc_feature (1)..(1): n is a, c, g, or t
  misc_feature (1011)..(1011): n is a, c, g, or t
  misc_feature (1014)..(1015): n is a, c, g, or t
  misc_feature (1020)..(1021): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgtctgtgtttttatgcaacngcnnggccnntgaatgcgttttaatggcctttgccgcgttccgatca

SEQ ID NO: 140744 - DNA, 1248 bp, Homo sapiens
  misc_feature (1201)..(1201): n is a, c, g, or t
  misc_feature (1204)..(1205): n is a, c, g, or t
  misc_feature (1210)..(1211): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgtctgtgtttttatgcaacngcnnggccnntgaatgcgttttaatggcctttgccgcgttccgatca

SEQ ID NO: 140745 - DNA, 793 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgaagcttgaagaagaattgaaaactgtgacgaacaacttgaagtcactggaggctcaggctgagaagtactcgcagaaggaagacagaaattttggaagctggaatccatgctctctagttcctgcctgg

SEQ ID NO: 140746 - DNA, 1251 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 140747 - DNA, 1267 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatgtaataaactcaccaccatgcctttttttttttttttaatgagacagggtctcatatgttacctaggcgcactatagggatcctctagata

SEQ ID NO: 140748 - DNA, 797 bp, Homo sapiens
  misc_feature (1)..(1): n is a, c, g, or t
naggcggtacggcccggaattatgggatcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaagggggcaaatgtgccgagacgagcggcaccgcgtgcttgaggagctgcacaaggcggaggacagcctcctggccgccgaagagccgccgccaagctgaagcgacgtgcttctctacagagcatccagctggttgaggagagtggat

SEQ ID NO: 140749 - DNA, 775 bp, Homo sapiens
  misc_feature (733)..(733): n is a, c, g, or t
  misc_feature (752)..(752): n is a, c, g, or t
  misc_feature (755)..(755): n is a, c, g, or t
  misc_feature (768)..(769): n is a, c, g, or t
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagattgtgccgagcttgagagattaaactgtacgacaccttaagnactgaggctagctagaggnctncagaggagacagnntaggag

SEQ ID NO: 140750 - DNA, 953 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgagaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggagaggcaatgtccaggcttgaggaggagttaaaactgt

SEQ ID NO: 140751 - DNA, 189 bp, Homo sapiens
actgcacttccagcctgggtgacagacaagaccctgcctcaaaaataaatgaataaataaatgtatgtatttaacaaaacttttataaggcctatttatgtgtcaggtgtgattctaagtcacttccaggccaggcgcgatggctcacacctgtaatcccagcactttgggaggctgggcgtgcagtgg

SEQ ID NO: 140752 - DNA, 479 bp, Homo sapiens
aataactgaatgtagtcacagaggaaaaggaatttacaagactataacattctcatttacatacaaaaaatatgaagtcaaaatgtgtaaggaattaaaggttacatagtaaagatagagatatctcatttcttctatttaaggcctgttgtatgatcgctttttcctaaaaatagttttctcttcctggttttgcctttaactccttcaaacaatccattagcacttagagctatctcaaatcacatgccaacttaccaaagaatgaggtcattaaatgactgcagcacaaggacacacaatttaatagggttagctaatatttaatataagatatttactgtaaatatcagtgttttataagtactgatctgaaaagactgagaaacaagtaaaacaagtttgccaccttttatgaacactgcttcttgcatgttcaacctgttacacatggacatacatacgacggtataagttca

SEQ ID NO: 140753 - DNA, 370 bp, Homo sapiens
aaaattagctggacatggtggcacaaaattagctggacatggtggcacaaaattagctgggcatggtagggcatgcctatgaccataggcatagctacttgagaggctggggtgggaggatcacttgagcccaggagctcaaggctgtagtgagctgagagtgtgccactcaagcgtaagcaacagagccagactctgtctcaaaaataaaaaaataaaaaataaatatattgatttagatcaattattattttaatggctattcaatagcctactgcactaatatgctatagtttatccatttccctactgatgagcattgtaggttgtttccaactttttacactgataaacaaggctgcaataaaca

SEQ ID NO: 140754 - DNA, 405 bp, Homo sapiens
tgaggatcccatggagaccaggctgagcaacatagcaagaccctgtctctaaaaaaattaaaaacttagccatgtgtggtggtgcgcgcctgtagtcccagctcctcacgaggctaaggaagaaggattgcttgagccgagagtttgaggctgcagttagctatcattgtaccaccacaatccagcttgggctacagagtgagatcctatctcaaaaacaaacaaacaaataaacgaaaacccaaaaaagtcaaggaggtcatacaaatgggcaacaagtatatgaacagaagctcaacatcaagcatcatgacggaaattcaaatcaaaaacaaaatgagacaggaagatcgcttgaggccaggaatttatcaccagcatagacaacataacgagacccatctc

SEQ ID NO: 140755 - DNA, 451 bp, Homo sapiens
gctgttctagaggatcccaggcgtcaaagtaactgtctgttctactaaaatgttaagcaccatgagggcaaagcctagctctctcttgctctctgctatcccccgcgttcccaggtaggcactcagtaagtgcgtgatgaatgatgaatggatttagacaggcagacagttagaggcaggaaagtagttctctgaatccaacttgctgatatgacaaattctcttaaacccaacagctgttaccaatagaaaaaagtagtctctaaactctcttttggtacctctaagactctgtggccacagtgtgaggaagcagctagtgtcccctgtggaacagagctgagtatcctttgtttgcctgatgtctgggggctaggatactaaaactaagactgccagtatctacccctgagaaacatgggtctctgcatgacatggttacttgacgcgt

SEQ ID NO: 140756 - DNA, 153 bp, Homo sapiens
acatcaaagtaacaaaactaaagttgctaaaggtatcaaatccagaatagaggttctagctgatccttgcataatcctggtgcctgtagtgataaattaacacatattagtgttgtttttaaaaaaccatcctatactgagcagaataatagt

SEQ ID NO: 140757 - DNA, 607 bp, Homo sapiens
gctttatccataacaactagaacaatagggagccacattagaaagaaggtcatgtttgcgttatttttataggggctttatgttttattttccatgttgggctccttctagatctttggatctgtaatacagcctccctcgttttgtgactatgtttccaaaccccaatttggaatgaatgacctgaagctgattatcggaatacttaaaaccagttagaataatagcccaggcaagttggctcacacctgtaatcttaacactttgggagtctgaggtgggaagattgcttgagcccaggagtttgagaccagcctgggcaacacagtgagaccttgtctctaaaaataataaaataaaataaaaaattagcccagtgtggtggcatgtgcctatagtcccaacaactcaggaagctgaggtgggaggattgcttaagcctgggaggtcgaggctgcagtgagccatgattgtgccactgcacaccagccagggcaacagagtgacaccctgtctcttaaaaaaacaaaacggctggatgcggtggctcacgcgtgtaatcccagtactttgggaggctgaggcgggtggaacatctgagatcagg

SEQ ID NO: 140758 - DNA, 407 bp, Homo sapiens
gctggagtgcagtggtgtgatcttggctcactgcaacctctgcctcccagcttcaagtgattctcctgcctcagcctcccaagtggctggagttacaggcacatgccaccacgccgggctaatttttttgtatttttagtagagacggggttttaccatgttggccagattggactctaactcctgacctcaggatgcgcctgcctcggtctcccaaagtgctgggattatacagtcttgagccaacatgccctgcccaactcatttatttaaattttatccttcttaaactttttagtttgtttaaatgcagggatttatattaaatatattctccttctgtggctgttctgccattgtaactggttgctatgaagctgctgtttttccaagatttgaagtgcaga

SEQ ID NO: 140759 - DNA, 488 bp, Homo sapiens
gagtatttaacttacatataaggagttctaagaggagaacaaagagaacagaaaagagacaattgctgataattttgcagtattaaacaaaggtatgactcttcagagtcagaaatcacagcagatgcccagcagcacagatgaaattagcacccagatgcaatatagtaaaaccttagaaaataatagaacaattaatctgcaattttttttctttctctcctttcttgaaatccacagctaaaacaatatgtatgaatccttgttccaactgcctatgaacctgtggctattaactgtgcaggcttgctcttctgtcttccaccagacacttaaactctagggtacaagtgctaaattatctgcacggacctcttgaaccactgcactaacttggcttaagataagtcacaattgcccaacactgcacattacaactctctgcaaacaagagtttcagtaattcttcatagctatattggactttc

SEQ ID NO: 140760 - DNA, 268 bp, Homo sapiens
atttaggctgttatgattttgaaatttttatttccctggcttgaagaccagtacttgttctcactgccattattaaatatttccaactgagatgcaaaaagattttggcaccctctcaataaataagcacaaggtcagtttgtttggtttttcagttatacttctaaaaactaaaaagtattaacaaaccagagaacacagctaaaacacaaagttacatttcaaagtgcaagtgttctgatttaattccctaacatgaccttgagtt

SEQ ID NO: 140761 - DNA, 263 bp, Homo sapiens
acagccagagtgagttcttgtaagaacctgaccactctgatggcccctccctgtgtcattaccaatactgattcctccctagcctcaattctaaggttactccctctaggactcaactccaaatactctccaatcccagcaggagccgcaagccactgatcccaccactgcactgcccacccccatgtccctctctttcccagctcaccttctgtgctcctaatttctcccttgccagcaccctctgtgccctaggcccctcc

SEQ ID NO: 140762 - DNA, 422 bp, Homo sapiens
tgatcacaccactgctctcaagccaaggcaacagagtgagaccccatctcaaaacaaaacaaaaagagaacactaatgccgttagaaaagaatgctttcattactaacaccactggggagccaagcaattcaaacccgcctgactccatgtggcagcttatttcaagtacaggcaaggagactcaaaggaaataaacagtgtgtgggggttctagcgatgcaaacctataaggttcttgtaactatcataatgcttgatcaatacttattaacaaaccacattctaggaggaacaagttttaaaagcctgaaaattggacagccaacgtcctaaaggtgagtgagtagcagtgagagagagaccaaacacagtgtgtccctggggtgatgctgctgtgctttaggtgaaaatgtcagtaaat

SEQ ID NO: 140763 - DNA, 468 bp, Homo sapiens
ctccactcactcagagtatgtgactagatattggacaaaacagctagtttcaggccgcccccatgacacagagctgacataaccacagccctactacctaacaatacccctactagagcagctgacttcccctctgagaagaacttaggaacttgtgtactaaaccaaagagacgaccagataaggactccaagcactctgatcagcaagtccaccctggttcctctgtcccaagccaggacttaccctagtctagaggaagttctcaccaagcatagcctaaattcagctatcactttgcctccactttgagcccacatgaaggttggcagaagaccctgagggaaggggatattaatcatcttctctctggtcaggagtagctgataggaggccgggcgtcgtggctcacgcctgtaatcccaacactttgggaggccgaagcaagcagatcatgaggtcaagaga

SEQ ID NO: 140764 - DNA, 346 bp, Homo sapiens
attgctagtgagcttaagtaccttttgatgtctttattggccatctgtatttccttctctctttgtttctcttcccccatccctagatttctagggactgactttaatataggtatttcacatgcattctgaatcctaattctttatcacatatcaactaactcctcccagtctgtagcttgtcttaactggtggtgtcttatcagtcagatatttgaatgttggtatgtttttgtcaaatgtgtctatctttgtttatggctagtgtttctgtgtgtcttattttaagaagtcttgtgttatttaaaaagtaataattccctcttgtccttttcctttaggttct

SEQ ID NO: 140765 - DNA, 307 bp, Homo sapiens
gtttttctgctttatatagatgatgaaatagagccagaagttgtttgtcttagtttgtagattgctacaaagttgatgtcagcccaaatgatctgactacaactgactagaaaattaggtctatcttacaaccaagaaatacaatgtagccagaatgggcaggttagagcagccttctctggaggagtaaatgcctcctgttaatgttctgtaaatgttctgtcttggatcctctttactaaagtttcattttaagaatttaaactgtaaatgtaatgctgcaaatggacattgaggtagcagtgta

SEQ ID NO: 140766 - DNA, 130 bp, Homo sapiens
ttgcttgattgggaaaaataatactcccagcttgaacaccttgaggttgggaccacatgattggacatgctggttttaggatctctgtattaatctactgattcaaaatacagctcccaccaaaaacaaa

SEQ ID NO: 140767 - DNA, 236 bp, Homo sapiens
tttttgaagcgaggtaaaaataagatttggggtgtcctcataacaattataataaacaaaccctggaaagatgactgtaaacaaatttgtttcatttttacagtgtaatagtggtctagagtaaagatgaagaaagtttgaaggaaggaagccacatacagaagtgagagaaccaccttgaagatagtttcatcctctgaagatggtttcattttcccttgagaaccccactcctc

SEQ ID NO: 140768 - DNA, 357 bp, Homo sapiens
agggaagaaggactaatgtctgtggacactctgaggctcacagggagaagccacacactcgcagcaccagatgagtaaacagaggcttggaggggtgatgaaatttgccaacagtcatcaatcgttccaggaacaggtgatgcttcccggcagtgagactcgaaaccagcgggagttcccagccagagacatgatctaagtgccaatggctgaatgtctgtgagcatttcaagtcattttaagaataggcaacattagcggcaccattaaagcctgctgttcctccagcccatcactgccatccccacctattaaaataatggcatgaaaaataaacagcctttatgtacaatttta

SEQ ID NO: 140769 - DNA, 494 bp, Homo sapiens
atttactgatcacctgccgtgtgccaggcactgtgctaggcacttgagagacagaatacagcaagacaaacatagttgcttcctttatggaacttatagtccagcaaatatgagactccctggatttgagtcacaatggctgcctcctagctgaatgactttggggaacttacttaacctcttcagacctcaatttccttatctttaaaaccggaataatcatagtactttcctcatagggcagtatgactattgaattgttgatatgtgaatgcatgtgaaactcataaatcataagattggcacttacagcttgtttcactgggttgtagattaggtgtgcatgtatggtttcactaaaagcttgtacttgaggcctaacaaaattagcaatttaattatgagtgtttaataaacgctataattactggacacgactctaagtagcagaagatatggccggggcgagcagatagatgttagagagtacaact

SEQ ID NO: 140770 - DNA, 284 bp, Homo sapiens
aaaaaaagtaagttaacattcattatgccacagacacaggaagcctttcagtttctccctctctccaaagcccgcatatgtacacatggctacttgtccaagttttaaactaactttattgtagttttaaactgttctttttttatctaatcacttgaagttattagaaaaaaaaagaggacgaacagggacgacgagagagccagagacagacacatagagagagaaacagaaaaactaatgccaaacaaatttcatcttctggggataataacagctgactt

SEQ ID NO: 140771 - DNA, 348 bp, Homo sapiens
ttgcagatttcattcaggttgagagaggaaacaagatcttccttagaaagagaagtgagggtagagaactaacaatctggtctcaatgggatatccaatttgccctgagtggaaaccatagttaatgtaaggagagagacgtaccaagaggcttaggccataggctgggatgagtctagaagccaatgattcaactccacagcaaggtgcgtttaagaactgaccaaaggtctgcatgagaagcactcgcaaggccagtctctggcgccctaagttgggtaaagccatggactgtgtgtgtgcgagataaggtggcagggaaataagaaggcaagcaacgctctccca

SEQ ID NO: 140772 - DNA, 502 bp, Homo sapiens
gttaaaagaacctgctctccattatctcaagtagcagaatatgttccaaatgcttcaaaggaaatgctaaactgtcacagctgtagatcatgcgcttgccctttcgacccccacatcctcatcacctgtttctttgtttgatcaccaataaatagcctgggcttccagagctcggggccttcacaaccgccacacattagtgacagccccctggacccactttctctctcaaactatcttttctcattcctttgactccgctggactttgtcacccccatgacctggtgttgagtccgatcaacccaacagggtttctgtgtgaggtgatatcaaagctctggactaggtggtggtgatggctgcacgacactgtaaaagtacttaatgccactgaattatacgctttaaaatagttccagtggccgggtgtggtggctcatgtctgtaatcccagcactttgggaggccaaggcgggtggatcacttgaggttaggacttt

SEQ ID NO: 140773 - DNA, 519 bp, Homo sapiens
aacagtagactccctcatagagctgtggcgaaaatgtaatgggatcgtgtaggtaaagtacccagctatgtgcccagcacactgccatgaccaaataaatgccagctgctattatcattgctgctgttcttggtatttcctgcagagaaatcaatttcacaggaatgcagggtgctgattggtagtcggtgatcatgttgccagaaagcaaaacatttcttttcaaatgaaacaattgtttcttttacattttgccaatgttcccagtctccgagctcagtacggcacagaaatgcccttcaatgccgtccatggaagccgggacagagaagatgctgacagagaactggcattgctcttccccagtttgaaattttcagacaaagatacagaagcccctcagggtaagtcatcaaggcagacttggtctttattaaatcatagatacaaggaatttgtaactatgtgcttgagtgtgtgggggattgataatttttggtaactaagtcttcaacctaa

SEQ ID NO: 140774 - DNA, 517 bp, Homo sapiens
taaaatacactaaggcactacaaaaaggtgcaaaagcccaagtattcagctcaatgttttccatgagttgccacgtaactggcactaaaatcaaggagaaacattatcaggtcctcagaaaccatccacccaccccctaccaccaccatgtcttcttcacagacacttggaaaaaccgttcaataagtatctatcaaaggtaaattaacaaaatgggtttccaaagtggttgtactcccaagctcattcacactgaatggacaatgttgactgccttgtctgtttacccttctgaattacaacatcctggggtcacggactaccttttggtcgcctgtttacccccaacttctacaaagagccagcacatgaatgaacgaatcaatgaatgaatgagctaatgaaggagtgggatgaagaacatacactgtcagtttgagcaacagttttgattttcttctggtctttgttaaatgtgcctctctcattggaacccacagttacagaaagattctgg

SEQ ID NO: 140775 - DNA, 181 bp, Homo sapiens
ccatctctaagacatcttttaaaggttttgttaaaggatttgtttgcagcctgctcactggagatggctcttaaggattaacaatcaccattcaggaactgtgatgagtcagtaaatcagactttttctctctgctcagaagcaagtaagcatcagctggggataggtaagttaaatgata

SEQ ID NO: 140776 - DNA, 263 bp, Homo sapiens
agagggaacggatggatgaggccgtccccagagggaacggatggatgaggccgtccccagagtgaacggatggatgaggccgtccccagagggaacggatggatgaggccgtccccagagggaacggatggatgaggccgtccccagagggaacggatggatgaggccgtccccagagtgaatggatgagcacccagcctgagcccgggaaggtgctgagggttagcacaggccgcctgctgctgtagaagtgcgcctgggtg

SEQ ID NO: 140777 - DNA, 497 bp, Homo sapiens
aatgttcctggcagaaggaacagcctatgcaaaggtcctaagacaggagcaattctgtgtttgaggaatttttaggagccaatggctgaagcagagaagagtagggtgagtgactgagagaatagaggagatgaggttaggaaataagaggccagatcatctagggctttcaggcctttttaaggactttggcttttactcttagtgactgtgggggtacctcatagggttttgagtagggaacaatattgactaacttgcatttttaaaggatcactctcgctgctgttttgagaataggctaacctagggcaatgttaaagctgggaggccagtgaagtattatagtcattgtagagatgaatttggtttgaacagtgtgataaggggagaggtgacaagtggtcagaatatggatgtattttggagactgaatcaatagaattttctcatggagtggatgtgcggaagaatgaagagaggagtcaaggattcat

SEQ ID NO: 140778 - DNA, 450 bp, Homo sapiens
tgtttgagtaggcagggatgatccagcagagaggggagagttgatggtgcaggagacgatgcaagaactggaaagtgaggtatgtggagtcacatctcccttaaaaatagaatggggagattttgcatcaaataggataaaacagattattagctgtttagcataataatcttaaaatgattaattgatgattttgcctgaatcctcagatgaatttttcatcttgcagccttgtgtgctttttaggtaagagaacccaatggtcattgtatctgggagcgtttctttgaaagcaaggtgttttttgaaagtagcatttggccatattaagtccaccaaatcttttgaccactgttcactatacactggctttcaactggattcaccttttgttaaatgcggtcaaccacgggaatgagtgaccttgcgactttcacaggggactcactc

SEQ ID NO: 140779 - DNA, 362 bp, Homo sapiens
gacccacatcgctgacctcttccaggctggagagcagtggtgcgatcatagcttactgcagccttgacctcctcggctcaagcgatcctcccgcctgagcctcctgagtagctggaaagtgtgaactccatcatcccatttcatagaggagaaaaccgaggctcagagatggtcactcaccaaaggtcacccagctgggactaagtgacagagctgggactacaacccacatctgtctggctccaaaacctccatacctccatcttatctagaaagagtgctggatgaggagtctagaatcagggtctaagtcctgcctctaacctgctgtatagcctcaggtaagtctctttccctttgtg

SEQ ID NO: 140780 - DNA, 209 bp, Homo sapiens
gctgaggcaggagaatcacttgaacccgggagacagaggttgcagtgagctgaggtcagcgccattgcattccagtctaggtaaccagggcgaaactccatctccaaaaaaagggctgaaggcaactgccttgtctttccgcccatgaagacacattgagagccaccacctgtgcagcagggagcagccctccccaggcaccgcaccta

SEQ ID NO: 140781 - DNA, 183 bp, Homo sapiens
gggagctttcaggtttctacactgtgaggaaggtcttatggtttcaacaaatgaagaggcttatgtaaaagaaaactgagccgggcacagtggctcacatctgtaatcctaacactttggggggccgaggcgggcggatcacgaggtcaggagatcgagaccatcctggctaacatggtgaaa

SEQ ID NO: 140782 - DNA, 442 bp, Homo sapiens
gtctgaagctcaattcctggatctgaatgctatggccctttaagaaacaaggaagcagtttttcagtagttcagagtaatgaacaagatggggagcaaactattaatcaaatggtagactactcagatcaatcagatcagcccacatacaaacaggcaagaaatgctcagagagccaaaccccagagaagcagaaggcagattttcattccagaagattccaagagtggggctgggcagatgaccactggcagggggacactgggagcaaccccaaagactagtaagtaatcaggagggcatctttcaggtagcaggaactggccagttcctgcttcttgacagccgtatgggacaaaaggctacggttatggccagggcgctggcacgcttaacatggaccgtggcgagaggctgggcatcacaccagagagtgtacagcc

SEQ ID NO: 140783 - DNA, 315 bp, Homo sapiens
ccaatttctctgtcccagtgagatgttgacacttgtatgatccctgcttggagacttccctcttctggaacctgccctggctcaggcatgagggctgactgtcacccttcgataggagcccagcactaaagctcatgtgttggcagtgttcttgcgggaaggaaaaagaccagccagcccatttgttactgcacaagcaaacagcttctggtagctgtacagatacatgcactttctttcctcactgtgtttccatagacagatttagtgctgtagaagagtagagggcagtcacgggaaggagttcctgttttt

SEQ ID NO: 140784 - DNA, 392 bp, Homo sapiens
  misc_feature (318)..(318): n is a, c, g, or t
attgtcaaagtaacattgcttagatcatgtttagtcaggatgatttagagaaatagattagaactccttttatccagtctaatataattcattgtaaaagtacagttggtcctctgcatctgtgggttccatattcatggattcagccaaccttggatcaaaaatatttgttaaaaaggccaggcacagtgactcacctctgcctcccaaagtgctgggattacaggcatgagccactgcgcccggcccatatgacctgtttttcttttatagagtgggagaaatatgggaggtgacttggtgtcagtcatctgtgtnggttaaatcaagaatataatccgtgttttgcttctgaatagctctttataacagtgatgggttactttgacgcg

SEQ ID NO: 140785 - DNA, 502 bp, Homo sapiens
ggtgttctagaggatacccttcgacggtgtctgtcccatggtcccttttattcccgattcctagaggccagcttaacttggttggtttggaaaatctaccaggtgaagtcttctcctcagtggcccgtttcgaaagggacatgtcgggcacatgattgcgggtccaagcaagttcagccctctcttgctactgttacatacagaaaagaagtccttaatggttagcctccaaagttatgaggcagaagaacataatgttaagcacggaggaacaaaactccccaggataaaaatcctgactctgctaagttcctagctgtctgaccctgggcagctatttaacctctttatatataattttctcatcaggaaaattgggataataaaatcccctaacttacaggaatgttatgagaaataaattagttaattcataagaaggacttagcattactgcctggcacatactaagtgctcaataaataatagctcttgttattac

SEQ ID NO: 140786 - DNA, 181 bp, Homo sapiens
ccaccttggcctcccaaagtgctgggattacaggtatgagccaccacgcccagcctggctcagcatttctaaagattgctatacctcccccatcaggaggcagtatggtaaggtgggtgccttacccaccttacagaggaaagggaacgtgcactgaaaagttaataaagcaagagggcta

SEQ ID NO: 140787 - DNA, 350 bp, Homo sapiens
gttttaagtgacactttaagaaacactgataatattacaggttttcagtacataacgttataaaaacaattcaactaacaagtggataaagaaaatgtggtatttatgtaccatgtaatactactcagccataaaatggaacaaaataatggcatgtgaagcaacctggatggaggtggagaccattattctaagtgaagtaactcaggaataaaaagccaaatactgtatgttctcacttagaagtgggagctaagctatgaggacacaaatgcataagaatgatataatggactttggggattcatggggaaaggtgggaggggtgagcgaaaaaagactacacatag

SEQ ID NO: 140788 - DNA, 107 bp, Homo sapiens
ataggaatgttaacaggaatcacctcaaggggtgaggattcaataattgaatgttaagcatttagaactgtgccgggcacttaataagatgaaataaatgtctgtta

SEQ ID NO: 140789 - DNA, 165 bp, Homo sapiens
atcaggaagttaatttcaaatgattgtggtactgtgtcactgaggccacagagtcctaacaaaggttaggaaatgcagacagtgactctcagcatgagttttcttgcacagcaaatgtaaaaatttagaaacacagtcaagcacatattgtttatttctgcttta

SEQ ID NO: 140790 - DNA, 783 bp, Homo sapiens
tccaaccagccgcaaccatgcccaggaagaaggcggcggtggcggcctgggaggagctgagctcgggcaacggcactgcccacgccagggcccaggaaacgtggcggccccgcagccggaagcgcgagcctcccgagcgctgcagtagcagcagtggtggcagcagcagcagcggcgacgaggacggcctggagctcgacggggcccccggcaggggcaagcgcgcggcgcagcctgtggcagcaggcaaggtgggcggtgcggctgtggtggtcgccgaacccgagcacaccaagaagcacgtcaaacttgagacgtgctgtgtttactcaaggtttaatggatttagggctgtgcaggctgtgctttgttaaaaaagcgcttgaaggcagtatgcttggtaaaagtcatcaccattctctaatctcaagtacccagggacacaatacactgcggaaggccacagggacttcctcacaaagtgcaaaggggagcttttgattttgggggcaaccaactgggacttgattggtcgaaaataagtgcctaaacaaggccaggagtggtggctcaggcttgtaatcccagcactttgggaggccgaggcgggcagatcacaaggtcaggagatccagaccatcctggctaacacggtgaaaccccgtctctactaaaaatacaaaaaaaattagccgggcgtggtggcgggctcctgtagtcccagctaatcaggaggctgaggcaggagaatggcgtgaacccgggaggcggagcttgcagtgg

SEQ ID NO: 140791 - DNA, 226 bp, Homo sapiens
ttttacccaccactgtccctcacctatcagagcctgccagctctcaaaaaccttactggtgccagtgaactttctcaaagagaaatacacaccatttttctctctgtctccctctttataaaacctctaactttctctttatgttttggacacactaaagacacccattcttcatgtatgtgtcaaattgtaatacttgtatctcaaataaaacattttaatttca

SEQ ID NO: 140792 - DNA, 753 bp, Homo sapiens
acatagaaagacagcggaaaagcccactatatgggctttgaaatcccacctggaggtttgggctcccaaaacaactgactttggagcaactgtatcacaaacattctctctatatgtaagattatttaatctaaataactgcaatgtgaagtctggcagtaggacatcatcaattaaatttgaaacatatccagcttcagcttgatttagtaaccctaataatcataaaacccaatacaattgcttcaaagagaataaaatacctaggatacaacttacaagggatgtgaaggacctcttcaaggagaactacaaaccactgctcaaggaagtacgagggaacacaaacaaatggaaaaaatattccatgctcatggataggaagaatcaacgttgtgacaatggccatactgcctgaagtaatttacatattcaatgctatccccatcaatctaccattgacttccttcacagaattagaaaaaactactttaaatttcatatggaaccaaaaaagagcccatacagccaagacaatcctaagcaaaagaacaaagctggaggcatcatgctacctgacttcaaactatactacaaggccacggtaatcaaaacagcatggtactggtaccaaaacccatatatagaccaatggaacagaaaaggggcctcataagtgatgtcatacatctacaaccatctgatctttgacaaatctgacgaaaacaagaaatgtgggaaggattccccatt

SEQ ID NO: 140793 - DNA, 668 bp, Homo sapiens
  misc_feature (18)..(18): n is a, c, g, or t
  misc_feature (25)..(25): n is a, c, g, or t
  misc_feature (32)..(32): n is a, c, g, or t
tgcatgatacgatcgagncggaccntcgcgangtgttatccggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcaga

SEQ ID NO: 140794 - DNA, 209 bp, Homo sapiens
ggtgcttgcctatcatcctagctactcagaaagctgaggtgggaggattgcttgagtttgggagttggaggctgcagtgagccatgattgcagcactgcactccagcctgggtgacagagtgagaccctgactcttaaaaataaaatttaaaaaagatacattagttgtaattgggcacagtggcaccagctcccaaatggatacacag

SEQ ID NO: 140795 - DNA, 191 bp, Homo sapiens
aggcaataggaagtatggtattatgttcacgatctgatgatagcatttgttttaaaatattttaaaagattagacacaaaatgtgtaaaagacgtttaaaagtgaataaatataaatcaatgctgttgcaaataatttttttatcagtttatgtatctcactaggcttgacattaccagccttctgagctg

SEQ ID NO: 140796 - DNA, 224 bp, Homo sapiens
gataactacagcaacacctcagttatgactagaatttatattaacatataaatgcacatactttacatgaagcaaatgctcatcatttcccatttatctctactggatgataagaaccaatgaccacatactaaaattttggaactcctgagggttctataattatttcaaagggatatattaaaacgttccccctggctgggggcggtggctcatggctgtaa

SEQ ID NO: 140797 - DNA, 206 bp, Homo sapiens
aactctcctgctgaatcctcagctaacttctgcttatcttcttccacaaattgaacttttcaatcatgagcacagcacacaggaatgaaaagcagcttgtttgtgctcaactcaagccccatctccctgatcctgccaaatcatgagtttactttgatgtggtttccctttaagttctgcaagtcatgatttccctatggttgtat

SEQ ID NO: 140798 - DNA, 116 bp, Homo sapiens
catttgcaccccactaatttgccttaaaaacctcctgatctggaggcacaactcagagaggtgatctttgaacacaagttcactctttccccccaggttgttggctttgcaaataa

SEQ ID NO: 140799 - DNA, 417 bp, Homo sapiens
gcaaatactgtgacattttctataagggacttgagcatctgtggattttggtatctgcagggaatcctggaaccaataccccatggatacagagggacaactgtactaaatttggagactggattggcatgcctcagtgtcttccacagtcacctcttttcttgttaggtttcatagagaatctttgtgcatcttgaaagagaaatatttagacatgtttaaagagtttttgacacatgatctttgccatgaactattaggtaattttataagattcgcagttcatatggtaaattattttctcccaaagagccaaattaagattgtcagctggaaccaaatccttgctttcgttttaaagcatattaaatctgtattattgttggaaaatatatatagttattttccagcttgttc

SEQ ID NO: 140800 - DNA, 166 bp, Homo sapiens
agattgtgccgctttgtgatgaagtagagaatattgggcataattccatcctgatgttggaaggtgataggtgtgagtttagttctcatccctgcgacgcctctgggacgtcggttggtgaagagcatctgccttcctctagagagcctgagtcactttcacttaa

SEQ ID NO: 140801 - DNA, 131 bp, Homo sapiens
tgtaggctgcagccacacaaagctgaggatgaggaggaaggatggtctggggcaagctggggtaggccttgcatgccaggctattggcttctcgaacgttaccctgaatccctgggaatggaatggaaccg

SEQ ID NO: 140802 - DNA, 370 bp, Homo sapiens
agatagctctcactttagagatcccccattctgatggaggcagcagagcttctgcctcagttagcacccagatctcctgcccctggggaccctccagtctgataggggctccaacccacacctgccttccaagtcctgccatctctggctttaggagctcaggatggggagggctgttacgctgggctaaggccaggttgagctcaaagcttcctgccttggagaaggaatgaggagtaggatgtggtggttctgttggcaattgccctgggccaggagacaggcaagtggcatcaggcgccaggcagagcgcaggaagggtttcagcagccaggcatcaggcaagcaggcagctcatttctgtaggcaa

SEQ ID NO: 140803 - DNA, 648 bp, Homo sapiens
tatcaacaaagaatgggcttgaaacattataaaaattgacaatgatttgttaaatatgttttcttaattgtaacgacttctccatctcctgtgtaatcaaggccagtgctgaaagtcagatgctattagtacctacatcagtcaacaacttacacttattttactagttttcaatcatatacctgctgtgaatgcttcatgtgctgcctgcaagcttcttttttctcattaaatataaaatattttgtaatgctaaaaaaaaaaaaaagaacatagaagacaaacatcagaaataaacccatccactatggttaactcatttttgaatatggtgtaaagtcagtttaatgatgaaataatattattttcaacaaatagtacagaaattaaactatgcaaaaatactattaataatgatgttggatcattacctcacaccatacccccaaattaactcagaacatggcatacaccaaatataagagcaaaaactatgaaatttctagaagaagacagaaaaaaaattatgactttggcttagttgtttcttagaagtaacaggaaaagcataattcataaaagataaattgaaaaatcggacgtcatcaaaataaaaaatggtttatcttcaaagtcacctgttaagaa

SEQ ID NO: 140804 - DNA, 347 bp, Homo sapiens
gggtccagctgtagaagcgagatgggggcggttcgggaggcaaaagcaggaaggcagaaggaagcttggagctcatgagcccctctgtgctggcgcacggcccacgtcctctaaacaaaagggatgggctccttcagtggttccgtgggcccttggcaaagctcgtggaaacaccagctcctccccagcattcattaccaatgcgaagcactagccctttgcttggggcattctagacccccaggtgcctaggctgggagccctgggccaggtggtgggggggtcctggctgtggaatccagatgggacctaccactgcagctgggtattaggcagatttagccagg

SEQ ID NO: 140805 - DNA, 223 bp, Homo sapiens
ataacataaatgcccctcaaaaccaaaagtctcaaccagcaacccatcacctagcagaccacaagaaactcagatccaaaatgaccaagtatccccagtgggagaatccacaaaagaaaacccactgtaaggatggtacttcacaaaatccaggtggataaacctcaattctcaaaaccccctttatagtaccaccagcagccaaaccaccttcccaagtttc

SEQ ID NO: 140806 - DNA, 490 bp, Homo sapiens
ggtcagaggatccccgtcggatgaaaggtcatatgtttatgtgtgtaggtgtgtttgtgcatgtgtgggtgtgtgcatttgtgtgtttgtgcctgtgtgggtgtgtgcatttgtgggtttgtgtgtgtatgtgtaggtgtgtgtagtgtgcaggtgtgtttccacgtgtgcatatgcataggtgcatgtatgcatgtgtttgtgtgcacacatgtagttgtgtgcacgtgtgtgtatgggtaggtgagtatagtgtgaaggtgtgttttgagtatgtacatacaggtaggtgtgtccacgtctgcttgtatgtctgtgtgtgtgtgtactcatggctgcgtgtgtgtttctgtgtgtgtcaacaataagtagaaagtagacaaaacgctcggaacagctctgtgggccccatgccggcaaccagagtggagtcgtttccacaacctcagagccctgaaatggctgtttccacaacaggacacttgccaga

SEQ ID NO: 140807 - DNA, 199 bp, Homo sapiens
cttctggttgaattgtcttccacttcctctgctttgataacgttggcttccagacagcgtggtagaagagacagtgttgatgggtcttggagctagatgattgtgtaaggaatatttaaaaaaaaaaaaatgcaggtagtaggatgtcacaaccaacctttttaggaataaactagacaactgtatgaagaaattgttt

SEQ ID NO: 140808 - DNA, 319 bp, Homo sapiens
tagccaatgagatctatataaattatctcctggttggaaataaaaacaaagctactgttttcccagtgaaaaggggggaaactaggctacgtgtaccttttgtctttttctcttctttctgcctattctgtggcttaatatttgcatatgcaagaacattctggtgacaggcaagaggagagccgcctactccggtgcaacaagagacagcctacgtccatggtactgtcatgcagcaacagcagccctggatttattttttttttaaccttgggaaaatgacacctctttgcactaagccatggtagtaaggttgcca

SEQ ID NO: 140809 - DNA, 320 bp, Homo sapiens
ttcaataggagcaaaacagttaaaatttaggaataattacgacaaaagatttgtaaggcctgtacactgaaagctatagaacatttctgagagaaataagagacctaaatagatggagagataatatcatgttcatgaattggaagattcaatattgttaagaactcaattctctccaaattatctatggagttgtgatattatgttatctatacattgattttcatccatggttcctgactcataactcctgtagctcttgttataatgttggggtgctttaggcctcagaagcaggcctcaggaaatagaatctctct

SEQ ID NO: 140810 - DNA, 210 bp, Homo sapiens
gcagtgggccacgggatccctgtaagccatgggtgaccgggtgccctcttcccccaggaccctcctccccagggaccctcctcccccagggccctctttccccagactcttggggtagagacggcctgagtctcttgagatggagtctgaagcttctggtcatctgaactgcatgttgatgacaggaattgtcttcaggacgtcattagg

SEQ ID NO: 140811 - DNA, 344 bp, Homo sapiens
gaattgcttgaacccgggaggcggaggttgcagtgagccaaggtcatgccactgtactcctgcctggtgaccgagcaagactccgtcttaaaaaaaaaaaaaaaaagaaagaaaatttccagaaaataacacagggaaatcaagatgtagaaaatatggaaagaatatcaataaaaattctcatacactgcagaagggagaagttgtgctgtacgatcaatttgaaaaacaatttggcaaaatctagtcaagttgaaggtgcacacactctgttaccctgcattttcctattaaaatgtgcctgtggatgctaccgggcaccacccagatcccacccctcagga

SEQ ID NO: 140812 - DNA, 477 bp, Homo sapiens
cttaaccttctgcctcaggttgcccaggccacctctgaactctgccaagtgtcaatcaaaactcagcaacagataaagaaggcaataattaatgcagcagcctcacaagcccccagaaaggtgtctcgagtccgggtggtgtcgtccttgcagagttctgtggtggaaactttcaacaaggtgctgagcagtgtcaatccagtccatttacatcccaaacctcagtcctcctgccaatgcagggatcacattactgatgccttggtacaagtgcttggagtgtagggactcctttgaacttgaaaagagtctgacccagcactatgacagatggagcatgtgcatcgaagtaacatgcaacctttgtacaaagaacctcgtttttttacaacaaatgcagcctcctttcccatgcccgtgggcataaggagaaaggggtggtaatgcaatgttcctactcaattttaaagccagtcc

SEQ ID NO: 140813 - DNA, 189 bp, Homo sapiens
cagtcacatcactcagtacaccatcagttcagatggatcaggagtccatgccacatagtcttttgaatacatgaaagttttagtgttacgcgatgcagtctgtattctgtacctttctttgacccagagtattcctgagattcttccccatcgattgcagctctaggtaattgattttcattgtttgat

SEQ ID NO: 140814 - DNA, 395 bp, Homo sapiens
tgcaacctctgcctcctgggttcaagcaattctcatgcctcagcctcccgagtagctgggattacaggtgtgcgccaccacgaccggctaatttttgtatttttagtagagacagggtttcaccatgttggccaggctggtctcaaactcctgtcctaaagtgattcgcccgcctcggcctatcaaagtgctgggattacaggcatgatctgccatgcccggcctcctctacaattatcttaactcaatagttttttaataacgttgtttagtttcaagtacaggatttgtggttttctttctttcttcttttcttttcttttttcttttgaggcggagtcttgctctgtcgcccaggctggagtgcaatggctcaatctcagctcactgcaagc

SEQ ID NO: 140815 - DNA, 389 bp, Homo sapiens
cctgatccgatccatattgggtgtctgataaagtggtggtatgtagaacctgtatgtgtatacatatgtctgtgtcaatgatgtgggttctttctgaaacacctgaggtaggtaagaggtagccttacttgtttttccagatcttgctagaatagtagatttttagggtttgctttggattatggaacaatgtatgttgccttgaccattagggaggcttctgggtaatttccatagagattctggttggcctctttactgttgtctgaaaaaactagaccaaacattcggggctgggggtaggattcttattctctccaaagaactgatatgaatatgtgtgtggggggctagataggttcatgctcgctcacctcagcattgagggg

SEQ ID NO: 140816 - DNA, 437 bp, Homo sapiens
gaggctggtgggagaagggattggggagtggctgctaatggatgtgggacttttggggtgataataacattctggaattagtagtaatgactgcacaacccttgtgaatatactaaaaaccatgtacacttgaaaagtgtaaattgtatgctatgtgaatacatttcaattttttaaaataacagagcttaccgacaggggatgagtacaaaggggagggcgaaggaaaagatgagtgatattgggcatgttgaattccctgtactcatgggttgtcctggtggatatgacctgcaggcatcttgatatacatacatgtctggtgctcaggacagaagtccaggctagagatagacttgggagtcttcgatccatggacagccgaagaacttcacttatttgtgctatgggcttgggcaaactactttatctcacat

SEQ ID NO: 140817 - DNA, 271 bp, Homo sapiens
tccgcccgccgagcccgcagcctctcgaccccgcgcgtctgtgtcaaggcatggccaaagtgagaaagagccaagacaaaacaagttcaaatagcaatagcaaaacaaccaaaaggaaattcaaggaaagcaaatataaatgagaaaaatataattaagcaaaaatgaatgttcgcaaaggcaagacaaaaaaccaagtcaaggagtaggttcaaagaaaagatgaaacgtgaatataatttaggatatttataccgattcctattgaaat

SEQ ID NO: 140818 - DNA, 268 bp, Homo sapiens
gttgtggcgggccggagagtccccgagtgacttaacattctctaaaaataccccatttttgaacttcgacgacctgggttggcctgctcactctgtgtccctgcgctcctctgcttctctgctccttcggtcttgtgtgctggggacacgtgggcctttccagttccctgcagccacctttggtctgtaggaaggcagtggcgcagggagcggtgggagcccgggtctgcagggctcaaggtggcgacggcgaagcggtctgccccac

SEQ ID NO: 140819 - DNA, 550 bp, Homo sapiens
acggttgtgttttcagtgcccagcacatacgaggtgctcaataaatatttattgcacaagtgagtcaccacacctggttggattatttattcttggatttgtgcattgatggtgccaaataatattgccttgtcccactgatgctagtgagcatggggaggcacagagcctcttgccaggggtgggtggttgggggattcagtctgctccacaatattttccaatggtgtgaggcagaagctgctgatgaggttttgggaagaatctgcagagaataggtaaccgaagtcagcagtatagataagggaagaggtgctatgtacagctgcctaggctgtgcactgcataactcagagtggggccagtcacaaagactatgatctgaatggcattccctgatacagttcagtatgatgaccctaagatgggttatatttgctgacccatattgcagtggtgagaggaataacggaagtcaaaaggggcagaattaactgggaaggaaacagaactagaacagcatgtcactgaagtcaacagaaaagtttgg

SEQ ID NO: 140820 - DNA, 205 bp, Homo sapiens
gataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaa

SEQ ID NO: 140821 - DNA, 464 bp, Homo sapiens
acagaacgagatcttgctcccatcccctcaaaaagtggtcatatcatagacaggttaaaaacaaagcaaagtgactgggttaaaaggggatttaattctggatgaagagcaacatcactgcagtggtttgaggctacatctcttgcattagccagctttgcttttgaactgaggacctactgtgtaattttaacctcttcagcctcagttgcttaatctgtaaaatggggataataatgtcaacctcagagggttcctgagaccatgtgagcgttgagcccagcgtctggcacatgttagcactctgctgctggcagctgggctcccatttctgctcacaaccccgtgcttttttttttatggaaacaaagtctcgccctgtcgcccaggttgggcgtgcaggggtgtgatctcggttcattgcaacctccacctcaaaagatcaagcaatactcctgcttcag

SEQ ID NO: 140822 - DNA, 616 bp, Homo sapiens
ccctcacaggctgaatggtggctgccctgagtgagcacagagctcacggggtgtgcaggggcaggcacggctgtcctcactgagttggctgccctctggggtaggcccagtatgaggtcccaagagctggactgacttagctcaggttcccaggcctagaacctgaacccagaccacctggcttgtcatcctgccttagcagaaggcctctctgaaacccacaagcagattcttgacccagtgagcatgagtcctttactctgcctgaaaaaaacaccaccaggtaacatcaggggctggtggtccctgatggcagtgcaatacattggccacagaggacatgggtattgtggaatcagaagatgcttgttgccacagcaaagaagagcatgatttcctggaaggcaacagaccccatggagatgaggctgctgtagcctctacctccctcattcatgctgcagaagtatagccttcctctaacagttgagggtctgaaacttctctgctttcctcagcccttgggagaaagcctaatgatccaaagcaagctgaatggagtcagtagacatggaaaactgggagccgtggtggccttcagagaagagaaccgatg

SEQ ID NO: 140823 - DNA, 332 bp, Homo sapiens
gacctgggttgctgatagaggaacactgttctgagtgccttgcaagggctgcctccttaaatggcctcatcaactctgtgagtagatactattgctaaactattactacgatctctgttttgcaaatggggaaactgaagactaagacttgcccaaggtcacacgggctcatcaatggctgaatgaggcttcaaacccaggcagtaggctgcctggctccatccctcctctaggctgctttatcagccacatgaatagatagaacgagggcaactgtggagtgtgtccctagagggagagcacagggctaccaggctgtggcaagcagcaca

SEQ ID NO: 140824 - DNA, 199 bp, Homo sapiens
ccagaggcaactaaacagaggcagctggcagccatggaaaatcaaatcccagagcttggggccattcctcctcaaatctctcccattcaggaagatgcccccacacaacctcagctactggggtgaaagtgccatgtgttactcagagcctcccaggacacgccttgggcctgaagctggggctaatccaatcatgata

SEQ ID NO: 140825 - DNA, 342 bp, Homo sapiens
ttgtattgttatgcacacacacacacacacacacacacacacacactctgatataagtgggttgtagtcctctggtgacttaggccgagatagttttttgaaaatgaaatgccataccttctttattgtagtggcaaatcaaagctaagtagcagtaaaactgttaatggactaggatacttgatgcagggagagggtcacagggcacaggcaagaatgcccttgccgtaaagattgcagagtagcagagcaggagcagcactttgtggaaagacccagcttaaccagaacaatgcccaaaaacctttgaagtgcagtgatgtgagagcgagactagaaaac

SEQ ID NO: 140826 - DNA, 305 bp, Homo sapiens
tttgtaactgcatccacttttcaagtaattaaaaaaatggtaagattactaaatgccttctttctctgttaaacgtggagtaagcttttcaaattgctgtagcattacttgaacatatcaagaacaaaatcaagagaaaaccaaaattgtaccactgtaggtttttactgaactgtgatagaaataggaatggtgattttagagaggaaaccaggtttgacctttcacttaaggtattttaaggttatgagtagggtgtggttcatattatgtacatattagtgttgaaatttataatagctata

SEQ ID NO: 140827 - DNA, 423 bp, Homo sapiens
ttctctgcctggtattcccatatctagatagctcctctagaaaacacacctccagttttttgcttgcagaggtctggctgcgtcacagagggaagacgggggtagtctcaccactttgcacatagactttcaaccaatccctctcttttcagcacatgcctcctctttatcttctctaatagtttctgatgcctccaagatctgaacctcttgggaacggcgagggacaatctacttatgctcatttgtagtctcttctacaggcactttagcttgtagcttttaaacttgctctgctaaaatggttacttctgcagttgtttttctcaacacaaactcttttcaaatctctaatctgctgatatttcttctgtcttcatcctcacagatttacacttttgaaatcctttattattcagttta

SEQ ID NO: 140828 - DNA, 476 bp, Homo sapiens
ctttcagttgcccgaggagaggagcttaaattcctagatttatggctctactttacctgaaacttttattttgcttttacttttatgtaccaatcgagtgtactctatttctgttggtgcttcctaaacagtctaagggagctctaaaaataagtaccaaccaatttatacagtaatgttcatagcgttgtttacagaatgcctcatcacaggtcggtatcctgggagaccccaaaaggtatgatactttcagagaggggccttagtgaaggaggtatagtttgcagtatgaatggtctgtctgtgatctctgaactcaattattctggtttttcaaaatctagtagtagtaaaagaagcaggcagagtgtagtagtcttgtgtcccgaatctctttactaacatgccatcttgctgcttctgtttggcctgattttcctcatcatgctctacatttctggaagtcctttggtctt

SEQ ID NO: 140829 - DNA, 395 bp, Homo sapiens
ccacaagaaattgctgaaaactaaggcttaggacagactggaacccagaaaagaaaggaaccccggtcttggtcatggttcatggcaccactcctttataacaatgccctagaagaagcccatgcacctcagtgggagcactcatgctgttcttggggaaccttcataggactgtgccctgccttgagctggaagtctctgcagtagacatccttccatattttgttcttcatcttctgaacgccttcaaggtttttcaattggaaaaattctatctgcataatcaacaatgtgctaaggaactctacttttagatcttcttagaattcatagttctttgtacatgaggattaaagcattcttctgtattctccacttgtgaaatagatttgagg

SEQ ID NO: 140830 - DNA, 373 bp, Homo sapiens
aggtcaggtgacgagacggtggaagagaatcccaggtggccgtggcagcatgtgcaaaagtgtggtacaccagggacttggacatggtgatcatggaaggtttgagaacaggaatagtggcgctcagtcagggccaggcttgaaggaggatcaggagcatggacttcatagggaaatcgttttgaagatgcagtttattaagcaaacaataatttgagtttttaaatgtgttgggtatttgttagatactgggatttttttttttttttttttgacgctgagtcttgttctgtcacccaggttggagtgcagtgagctgagatcacctcactgcattccagctcgggcaacagactgaaactctgtctcaaaa

SEQ ID NO: 140831 - DNA, 196 bp, Homo sapiens
ctgaggctctgagagagtaagtggccaggtcgctgtgctaagcaggggcaaaggcagaaggcaggtcccaaaggcaaatgctacaggaccaggcaggtcatataaatggatgaggtaggcagtggtgtggcaacagagcacagagggacccggagcacagaagggcgtgtccttggtctaaaaagagcagtaaagc

SEQ ID NO: 140832 - DNA, 427 bp, Homo sapiens
gttttcttccccaggacccagaacaatagatgcatacagtaggcactccactgttctataaaatgaatgaatgaaggaataacataaacagactgaatgaatagaacgagcagagatagtggtttgggaaaaaatttcctatatatcttcaactgctcataatacaccttaattcatataaaacaaacagaaactgcaaacaccgaacacctatgctatgttaacactatgctaacacatatacatatgaagcaggagcacttcttcatgagctgtcagaggtatgagaccagattaaaaaaaaaaaaaatcaggccaggcacggtggctcacacctgtaatcccagcactttgggaggccgaggtgggcggatcacgacttcaggagatcgagaccatcctggctaatgcggtgaaaccccgtctc

SEQ ID NO: 140833 - DNA, 169 bp, Homo sapiens
gccgccgcctactactactactactgctcgaattcaagcttctaacgatgtacggggatcatgccactgcactccacctgggtgaccgtgagacgccatcaaaaaaaaaagaaagaggaaagaaagaacgaacgaacgaaagaaagaaaaggtaaaatccctacttaaa

SEQ ID NO: 140834 - DNA, 808 bp, Homo sapiens
ataagacaagatgatgtactctagggcttttgctttaagtttgaagcacctggagtttctaatgctgatggtaattatagggaagacattaaaagggtaacttgctaaaggtcccataattgtccattctgtgaccaaagtaagtaaatttgcattaaaaatcactgagaaaatgatactctccaaaatttttccagagaaggttaccaaggacttggttaaagttagttagatgactaagaatgaaaactgtagaccatgaactgcatccactaaaataaaaaatcataagagaaattcctcaggattgcagtatcaatctggacaaaaaagatcattccaaattttgaatctacagagaccattctattattttccaacacttaagattcacattcaaaaatagaaaattctgcatgaaaaaagttttgctataagtatgtcatagaatattaaatgtaaaattcttctctaccattaagtctcctaaaaaatttacctctaagatacattttctctgaagaaatttcaaaattctgatattttcttcatatggtgctgacaatatgcaacccactcatattaatgctttacctagtcttagtgttatgcttaagacagttttagaatctcaaaaattttctttcataagcagaaaaacaatgctgacttctcttacctgtgaacactaaaagacttctcaagcaatctaaatgctgcattgagaagctataaataacctcaaacagtcccaattaggaacaatttaccatattaaaaaaagtcgaacctatcagaacctggaaag

SEQ ID NO: 140835 - DNA, 582 bp, Homo sapiens
ttttgtagcagtgcaagaatagcctagcataaaattgatactaacagtggggaatcactacaaagatgcttgaaaatgtggaagcaggtttggaactgggtaacaggcagaagttgtaagagtttggagggctcaaaagaagacacaaagatcagggaacgtttaaaacttcttagagactggttaaatggttatgaccaaaatgctgatagtgatgtgaacagtgaattccaggttgccgaggtctcagatggaaatgaggaacttattgggaactgaagctcaggtcatgcatgttatgttttagcaaatagtttggctgcattctgttcatgccctagggatctgtggaagtgtgaacttcatagtgacagagtatgtggcagaagaaatttctaagcaacaaattgtttatgatgtgtcctggctgctcctaacagcctgtacacagacacatgagcaaaggaatgacttacatttggaagttatattttaaaaagaagcagagcaaaaatatttggaaaatttacagcctgtccgtggggcagagaaagaaaaagcttttaattcaagcaggctgtg

SEQ ID NO: 140836 - DNA, 1032 bp, Homo sapiens
atcattaaaattagatgctcccaattcagggctcaaggcacacaagctattctccaagttgtttcctcctatagaacactccggtggctcagactgcagatgtaatgtgtttaaagttttagtttgcaatttatgttctgaatgatgcggttcagtagagaatactttagtagtaatatctgtatcattaccacagtctaacccagaagaagactggggattactgccaacagacaatgctaccaaggtagaagaggaagaaaaactggtttcaatgtcaagccctgctacatccattccatcacctgagtcatcatcttctgattcaggtgattctcctaaagtgagcccttgagtatcttctttttccttttccaattctctagatagtctgtgaaaatggccagaaactgtgatacggtctggttcagaagtgatttcattaattcgtgtccacttagtaaactctgatttgggcgatcccatcattttagacaatacggtttttccttcagattccatgagttcatttaatggccttttgccaaggggagaagaacacaactcagacttcccaggggcagcttccttctcttgtgcagggctggcagacaatctctcaatgcatagacctcgagtgagtttatgaatggtcttctcagtttgtactgacttatccatctccctaacctccatttgtgtttttgtctcatgtaaaatgtctctttttctatcactcatggatcgagatgctgtggtccagtgtttttcaccaactaaggagtgtgtggcagaagattctctcagtgttgctgtgaaagtctcgagtccagaagttgtcactttatttacttcccatgtattcagagcttggatagcttcatgtgatttgggcttttcctcccatgtgccacttcctttattttttctcaatgagccaaaataattctgtgattcagttgtatcatcttctgaaacagactcagcagaatttctaagctggactgagtcattatcgctggaatctgtata

SEQ ID NO: 140837 - DNA, 105 bp, Homo sapiens
attcttagtagaaaataaacataacatttatgcttgctgtatcataacatgatctgtgcagatatgcatcctaaggcttagaaaagaaagctttcgaagaatggg

SEQ ID NO: 140838 - DNA, 220 bp, Homo sapiens
cctggtgctcccctgtggtggtttcttggtggattaggtagcaagggaagaggtgagaactgtggcaccagccacgccaactatggcacagttttctcatcaaaaaattccctgtaattgatggcaaacaatcgaatagcaaagttctagttttatttatttttatatagtgagtgagtgatagtgataaaggataggcacaatttagtctcaatttaat

SEQ ID NO: 140839 - DNA, 367 bp, Homo sapiens
tatctgaggtggagtctcagtgtgtcaccaagcaggcacgatctcatctcactgcaacctccacttgagttcaagcaattcctctgtctcagccgtcccaggtggctgggactataggcctgcatcaccatgcccagctaatttctgtatttgtagtagagatagggtttcaccatgttggtcaggatggtctcgatctcttgaccacagatggtccacttgcctcggcctccccaaatgctggaattacaggcatgagccaccaggcctgtccttggttttctgttgttgtgttggtttgctgagaatgacgatttccagctgtatgtctctctagctacaaagtccttgcttgagagagatacat

SEQ ID NO: 140840 - DNA, 357 bp, Homo sapiens
gcgggcatcttggaaggagtctaagtagggagacccatgttcagctctgtgtttgaagacaatctgtgacagctatgaggagaaaggatcagaaaagatgagagtgtggggtccaagttaggaccaaccatggccatttaggtgaggaatatcaaatgcccaagctaaaacaaaagatcattagggcgagaggagacctgagcaagccaggcctggcttgctcaggtctgggaaggcagatgtgaggaaatgacatttatggtaaagtctgagggttgagtgggtaggttgggaagaacattccagaaagaagcacatgaactacagcctggaggtggaagaccttagcaagccagg

SEQ ID NO: 140841 - DNA, 177 bp, Homo sapiens
tctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccatatcacagtggtggctggtggatg

SEQ ID NO: 140842 - DNA, 240 bp, Homo sapiens
taagtacatactaactgattcatacattgctagactctctttctgcatgcactctctctcatgcatatgtgttttactgcagtactatctgtttccccaaatagattagaagttccataatgtaggggaagatattctgcccatatcattggaacccagcagaatgcttaaaagacagcatgcctaaaataaatatttagataaatggaatagatggatgataaagaagtaaattaaaaa

SEQ ID NO: 140843 - DNA, 513 bp, Homo sapiens
cagttagctgagatggtgccactgcactccagccagggcgacagagcaagaccccatctcaaagataaaagacaaggggagatagttaaaagtaaatgagacaataagaaaagaatattgaagcgagcagatctgagtacctataccaactaattcaacacaagaatggtctctatctgatttctctgtaattctgcagtccctttactggaaatctaggagataagtgatgttaaataacttgccaaaaagttatacaggtagtaagtatgtgctgaaggcacaattcaaaccaaaggaaatctagtcaatttaggcaagtttatatcttaaagttattttaactgaaatttaagtgaaagggatagagagagaaggatatatgatgcggaactcaggatctaaagttaaaattgtgggctgtgtgcggtggctcacatctgtaattccagcattttgggaggccaagacgggtggatcacttgaggtcaggagttcgagaccagcctggcc

SEQ ID NO: 140844 - DNA, 184 bp, Homo sapiens
atttactagctagaaaagaaggaggtcgggggtgaaaagtaaatggtgtatgaagcccagaaattcctccttgattatccaagtgatgctgtgaggcaaacgcttccacttaccaagaagagcagaaaaatgtgcactttccttctaccagttacattatagctcttattttaagagacaaatt

SEQ ID NO: 140845 - DNA, 528 bp, Homo sapiens
cctaggagtatgaggctgtagtgaaccgcgatcgtgccactgcactccagcctgggtgacagagcaagatcctgtctctgtaattgacaaaaacaaaacaaaacaaaacactaacaaaacaaacttaattccaagttaacaaaagctgaggagttattttttcccaacttcaggctgcagccctgctaggtttgcaaagaaatgggaaatttaaggataactctgaaggttgtataattcatgccactggttctaaaaagcaaagttgccttccccaccaaaatccttcatctttcagacaaaggcagggttttcttgccgtttccaacacctgacagtgtgaactaccggagtaagagagcaaggaccagggcccgctgctcctcagcctgaaaggcggggcagccaatcagaactaatctctgtgctggaagtaaattcagtgttctcttccctgatctggtgcggcggggggctctgacggcaggggtgggcttgcttcccttggtgcccccatcccatacccta

SEQ ID NO: 140846 - DNA, 795 bp, Homo sapiens
tctggaatgaagttcaataaaggtgatttataggtcaataattctggacggaagccaaggccagctctcttccctcccacatacccctaacccacatgcatatagtgttcattagtgacaagagggagataaggtcctaatcagtctaggcaggcaactgcaataaccaaggagtactctcattatctaatatgaagaaaagattttctattcaggtgagacatttggtgcttaagattcaattcagaagctacctctgtgcagaatgcaattacatacatggccttgaataagtcatttttttgtgcctcagtttcatcatctatgaaatgggactagaggggttgagaggaagagagactactatgtgacaacccattatattattctatacctactgaaatggagaagcaagaggaagaagagatgcctatgtttttcaaggacttggaaagcgttttgcttaggtctataaaatgtatatagaaagcattgggctacttctctaggactgtgttgtaattagaaggggttcataatgtatcttcgaacaaaagaaaatggagctttctgatggtatcagtttgataaccgtaaacagttcacagtaaggtaagaaggtacattttggcggaagccaacattgcatttgatgtattcttaactcagctaacaggcaggctttcaagccacgttatctgcccccgcatcttgacctcatttaacaagttgctatgggagcccagtgaaggttgatgcaattttcttatctttggaggaagaatgtaactgtgc

SEQ ID NO: 140847 - DNA, 1107 bp, Homo sapiens
atctcttctgatgcgaagaggtcactgagcttggctgtgttagccaggtttaggtggggctggaccgggtagggataggggactgtctgacctctcccagggactgtgttcagggaacccaagggaatctgagaaggaagagaaagttaccacctttgacacatgtggcagagttctctggaacctctcctctgttcctaccacaggaaggccacaggcacgcaccagggctgtactggcctaaaccatagttctgtgctgactgagaggttctgaaattagaaaagaggtctaaatcctgcttccaggtttttgtgaggtggagaaaagcagagtgacctgggagaagtggttatcaacaacacagctggtgacttcttccctggggtgaggaaggttttccctttccctgccccgagctgcagtggtgcagtctgttaccttggagaccagctaacacattcccgcagggcaagcttcgctgctgagttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgaggctgcaggggagtgagacccagtcttcagattgggaggactctgaagactggctttcggctcacagtttaaaatgtcagaaactcaccttggctgacctgataagccagggcacagaagtgctgtaagtctgaagctgttccccgcaccccccacagctgcagtgacacatgcaaccccctgggcccgagagatcccctcataaggctttgcttcttcagggaggagggcaccaatgtcgtgcagaaaatatgtttctccacccagatcatccgccattttgagtcaaagctttctgagtaagtatgtttctcactgtcctcccaacaccacagaactcaagaattatgtcatttcagtccgggcatggtggcttatacctgtaatcccagtactttgggaggccgaggcaggtggatcac

SEQ ID NO: 140848 - DNA, 689 bp, Homo sapiens
atctcttctgatgcgaagaggtcactgagcttggctgtgttagccaggtttaggtggggctggaccgggtagggataggggactgtctgacctctcccagggactgtgttcagggaacccaagggaatctgagaaggaagagaaagttaccacctttgacacatgtggcagagttctctggaacctctcctctgttcctaccacaggaaggccacaggcacgcaccagggctgtactggcctaaaccatagttctgtgctgactgagaggttctgaaattagaaaagaggtctaaatcctgcttccaggtttttgtgaggtggagaaaagcagagtgacctgggagaagtggttatcaacaacacagctggtgacttcttccctggggtgaggaaggttttccctttccctgccccgagctgcagtggtgcagtctgttaccttggagaccagctaacacattcccgcagggcaagcttcgctgctgagttgcttggaggagcttggagaaaccagaagtgagatccaggagaagtaaggccctggagtgccaggagcccttctcccaaagatggagaaataaatgaagaaatacaggtgagggtgagcatcacaagggttgacaggggtggtgagagggtgtcggggaggccagatactaagctctggactgagtgagaagatcgagg

SEQ ID NO: 140849 - DNA, 491 bp, Homo sapiens
gggcacagaggccgagggagccccagggagccacagggacagagacagaagcagagggagccccagggactgagacagagaccaagtcagagacagaggctgagtaagagacagaccaacaaaagagagacagagaccgagagatggagagcaaatgagagacaaggatagacagaccaagagatccaaagacgcagagagacagagaccgagatcgagagagacccagagagacacagagactgaaagatagaggttgggagagacccagagagagtcagagggcaagaatggccagagactcagagacagacactgggagagcagagaagacccagagacagacgcacagaccagagagacagagaacaggagccaggcactgagagtggcagggacaggaggtcagaggctgagggagaccatgggggacagagcagcagatgctgagccgggccctgtctgagctgcccggaaggaagcagccatcc

SEQ ID NO: 140850 - DNA, 336 bp, Homo sapiens
gtcatttcatttctaagactcattgttttaaaatttaactcttcatgcccaaagagacatcttctttcacaggccccttcatgatgaatgatactccttccttgactcttccaatgtacagtcattttccaatggcagactgcaaaagactagatgtttcaactaaaccaaacactaacagtcctttgagtgctgagcaccataactggtgaagacaatggctgcttggaaaagtgactttatccttaggagatttctccattcccttgagatttcttccctttcatacaactgtgaccactttgttcagatcttagaggctcaatctctctatag

SEQ ID NO: 140851 - DNA, 1113 bp, Homo sapiens
aaacattctatattttcttctttttatttaatgactctagaatctaatggattgtcgttgagaatctccccatacaaactccttgtttttatttgtctggtgctcatgctagagctataatttctttgattctcttttttgttttcacttcatgaagtgtttattatgtgagctggtcagaaattataagaatgatttttataaaatgtagtgaatgtaaaatttttagatgtaatttcataatatatgtattaagttattttagttagaacatttcattttgttgttttaatttaagaaccctatataagctgttttctttagttattgttcctttcagtttttgtaattgacataaatgagtttattttgccaatttgttcaggtaagtacttggaaaactttgtcagtcatggggatgttttgatctattattgtagtgaacaaacaaagttctgggtgtgtaatagatgcttcataattagccataaatattcctggagttagtttgtagctccaagtaagagattgaaaataatctgtggcgaacaaatggcattaattgtgcatgtggagaggacgtctgttctcaggctgcagaaccaactcattatgaatgtaaagaggatttcttttcttattttctaattatcttcagttttgtgatatctttatgatttatccccagctatgtatgcctcagagcctttcttcatttttgcgttatggctagtttgtcactgttctcttcattccacgtaatttcacgtggactttaggttaactggggtgtttgaggttatttataggttatcagtgcaacatttagatcacttgagataagagtaattcactatcaacaggtaagaggattaagtcagttggcattgtttttctgtgtttgtaaaagaaaaatttttaggagacaatggtaagtgaggaattttacatttaattttctgtgacatagcaaaacatttttccatacaaaatcttctatttatttatttattttagatggagccccactctgtcaccaggctgatgttgtgccactgcagtgcagcctgccaacagagtaagacccgtctcaacaacaacaacaaaaaaaaa

SEQ ID NO: 140852 - DNA, 1190 bp, Homo sapiens
aaacattctatattttcttctttttatttaatgactctagaatctaatggattgtcgttgagaatctccccatacaaactccttgtttttatttgtctggtgctcatgctagagctataatttctttgattctcttttttgttttcacttcatgaagtgtttattatgtgagctggtcagaaattataagaatgatttttataaaatgtagtgaatgtaaaatttttagatgtaatttcataatatatgtattaagttattttagttagaacatttcattttgttgttttaatttaagaaccctatataagctgttttctttagttattgttcctttcagtttttgtaattgacataaatgagtttattttgccaatttgttcaggtaagtacttggaaaactttgtcagtcatggggatgttttgatctattattgtagtgaacaaacaaagttctgggtgtgtaatagatgcttcataattagccataaatattcctggagttagtttgtagctccaagtaagagattgaaaataatctgtggcgaacaaatggcattaattgtgcatgtggagaggacgtctgttctcaggctgcagaaccaactcattatgaatgtaaagaggatttcttttcttattttctaattatcttcagttttgtgatatctttatgatttatccccagctatgtatgcctcagagcctttcttcatttttgcgttatggctagtttgtcactgttctcttcattccacgtaatttcacgtggactttaggttaactggggtgtttgaggttatttataggttatcagtgcaacatttagatcacttgagataagagtaattcactatcaacaggtaagaggattaagtcagttggcattgtttttctgtgtttgtaaaagaaaaattgtatgagattctatcataaagtgtgtaaaatgtaacaaaagttagaataagtaaaacattaatataagtgggttgtatattgtaccaccatatgaagaaacatcagaattttgaaatttcttaagaggaaatatatcttagaaataaaatttttaggccaggtggcggtggttcacacctgtaatcccagcactttgggaggccgagatgggtgggtcatgaagtcaagagagcaagatcatcctggcaaacatggtgaaaccccatctctac

SEQ ID NO: 140853 - DNA, 906 bp, Homo sapiens
aaaaaatgcaaagaatttgtaggtatgattagtgcattataggtgttttcaaatttctcctatgataaattaaaaatgtaatgttgggcattaatttcctaaacccaatgctcagcaattttctcaaattgtttacagtttttccaagagacttcagaaccattccctggagtgaattatttccaatggtgaagagtaatggatggatggcatgagattctcaaaaaaatcttgctcctatttcagaagtgtcactccagccccttgaaggtccaggaaacctggctgagtagtgtggtctatggaggtgcatgggcttcagaatcaggccaacgttgatcctgagtcccagccagctgcttagtagctgtgggatagttacacaagacacatctacaagaaaagtcatgataaaattgattgcaaaaacagcaatttgaaaaatttcttattgtattcatgtccttggaaatggcttttatagtcgttcctatcaagagacagattctgtttcccaaaccttgaacttctcttgacttatctgcactggcacagggtgccagtttggggcccaggtttaaaggtcctaaatgcttctgttatctttttcagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagccagaagaatggcccggctgagcccagcctaaatttctaaccagctcaatcctgagctagtatgtttcgggattgttatgcagttataagttagtaatatatacacccattaaagacaggatctcaggacagat

SEQ ID NO: 140854 - DNA, 934 bp, Homo sapiens
cctgtagtcccagctactcgggaagctgaggcaggagaatcgcttgaacccaggatgcagaggttgcagtgagctgatgttgtgccactgcagtgcagcctgccaacagagtaagacccgtctcaacaacaacaacaaaaaagaagaaaatttttaggagacaatgtttttccaagagacttcagaaccattccctggagtgaattatttccaatggtgaagagtaatggatggatggcatgagattctcaaaaaaatcttgctcctatttcagaagtgtcactccagccccttgaaggtccaggaaacctggctgagtagtgtggtctatggaggtgcatgggcttcagaatcaggccaacgttgatcctgagtcccagccagctgcttagtagctgtgggatagttacacaagacacatctacaagaaaagtcatgataaaattgattgcaaaaacagcaatttgaaaaatttcttattgtattcatgtccttggaaatggcttttatagtcgttcctatcaagagacagattctgtttcccaaaccttgaacttctcttgacttatctgcactggcacagggtgccagtttggggcccaggtttaaaggtcctaaatgcttctgttatctttttcagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagccagaagaatggcccggctgagcccagcctaaatttctaaccagctcaatcctgagctagtatgtttcgggattgttatgcagttataagttagtaatatatacacccattaaagacaggatctcaggacagat

SEQ ID NO: 140855 - DNA, 122 bp, Homo sapiens
ggatttgctggtgcagtacaactaggcttaatagggacatgaccagacacttcacaaaataatatgtacaaacagccaatgaacacattaaaatgtgttcagcatcatcagatatcaataaa

SEQ ID NO: 140856 - DNA, 128 bp, Homo sapiens
ggatttgctggtgcagtacaactaggcttaatagggacatggaaggactcaagtttacaactttacctcctacagattcttcctaattaaaaggaagtattactcgaagatatattcaagcaaaacaa

SEQ ID NO: 140857 - DNA, 238 bp, Homo sapiens
tgctttgcccaagctgcttcctctacacagaatgcttttcttccttttccacctttcaagctaaggcccagctgaagtcctgcatggtccatggagccttcacccaaatccacactgtcttgtcctaagaaagccagggatggcaataggcaatgatgtgtggaggcagctcctaccttctcactggttgttcaatatttgggaattttgtgaatgatgttaaaccattggtacctta

SEQ ID NO: 140858 - DNA, 451 bp, Homo sapiens
aaatcctgtttaatgtcttatatcttatctcgaaatctcagatcttgcatttaaggagtgttatatatatactttatagtatatgatgcattgtggattcattttttgcttgtttacaagttgtaaaaaaatatatatgtggtgggaatttgtggggttccaagaacagggttcctcaaggagtgtccttataaaacttaaggatgtattaggtccatatcagagaagctgctacttctatatgtgtttccaacctcagtagcttcaccaaaggcccatagctcctccctccatcttcatgttcttgtgaccaatgatttgaaaaacaattttgggaaaatccagagtaattgtgcatcagtaacatgtggttaagcaaaattggggtagcaatgctaatacttctgtcattgagcagttttatgtgtgttatggtaattttacattatct

SEQ ID NO: 140859 - DNA, 208 bp, Homo sapiens
caccatccaactgtaagtcgtatgaggaagggactacagtttccctcaccactgcatcctcagttctcacagtacttggaacataagaggcattcaataaatggaaatttttgtcaaggatttctttttcttttttttttttttttttgagatggagttctgctctgtcccccaggctggagtgaagtggtacgatctcaactcactg

SEQ ID NO: 140860 - DNA, 108 bp, Homo sapiens
cctacagagggaagtttaggaaatctaacttaattcattccacagccactcttgacatgacatatgaaccttcaaccagatgcatgtgttatgccttggtttaattat

SEQ ID NO: 140861 - DNA, 396 bp, Homo sapiens
caggatggggcaggaggacattggggggagcatgagcagaagctccccaaggaccacaggcgtctgcagctccttgtcttcatctcgaggccccgagtgccgatcactggtagctgcccactcaaacactccaaacacatagccagacacacccctgcttgttccccaggagtcctgccacctgtgcctggaggtcctctcctcacctcacagccctctttggtgtcagggaccccctgccccgaccctggccctgttcctctctgtgtcacatagtctgctgcctggggccgctgcttctttatccttggcaaatgtgtgtttgttgatagactgttggatctcgggctgacccaggagatgccagggccttgactgcccaggggcccaggcccc

SEQ ID NO: 140862 - DNA, 498 bp, Homo sapiens
aggcctaaggagccacaggagcctgggggtggggtgaaggagtgaccgagatgagatgctgggggaatcaggggtgtggctggctgtgtgtttggagtgtttgagtgggcagctaccagtgatggcacgcggggcctcgagatgaagacaaggaggctgcagacgcctgtggtccttggggagcttctggctctgcttccccccaaggcctcctgccgcatcctgccttctccatcccctccccgtgtgctgtcccctgcttgttccccaggagtcctgccacctgtgcctggaggtcctctcctcacctcacagccctctttggtgtcagggaccccctgccccgaccctggccctgttcctctctgtgtcacatagtctgctgcctggggccgctgcttctttatccttggcaaatgtgtgtttgttgatagactgttggatctcgggctgacccaggagatgccagggccttgactgcccaggggcccaggcccc

SEQ ID NO: 140863 - DNA, 251 bp, Homo sapiens
actacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttgga

SEQ ID NO: 140864 - DNA, 175 bp, Homo sapiens
tcattgctacagatgctaatataaatcaattaggggctgacacagcaattggctgcctgacaaatgttccataataatgcagctcaagagaatgtggaatttctgaggtgctggttataacgctttcaataatagctgtaaattccatgccatgtcagcacaggtggaaagctga

SEQ ID NO: 140865 - DNA, 116 bp, Homo sapiens
gtcttccacgttcctctgggcagggacacacttcatatttccttgtgtaccctggcttagcaagtgtgttccataaatcggcatttcatatttatcaagtgagtggtgtccagtgg

SEQ ID NO: 140866 - DNA, 493 bp, Homo sapiens
tatgcagaaaaaacagggaaggggagcagagaaagcagaaggcagagagatagcttttattttaaacaaggcagttaaggtatatttcactgattaagtgacagttgagcagaaacctgaaggagataagggagaaggccatactgacatctggaaaaatgatgttcctggcagaaaaagcaactacaaaggccccaaggcctggcatgctggagcaactgcaaaggagaccattgtggctacagcacaaggggaagtggtaggaaatgaagtcagagcagctgggagagagtggtgtgaatcctacatggtcttatagaccatggtagggacactaccttttaatccaggtgggattttaatctgggcacccaggtgacagttttcagcaaagcagtgacttgatctgatatatacttaaaaggattattctggtcactgttaaaattagattgagggggcaaagagcaaaaggaggaagaccacttagaaa

SEQ ID NO: 140867 - DNA, 225 bp, Homo sapiens
gcctggggcctatagctgacgaggtaacaggtggaacgaagaaaatgccaacacccacggctacccgggatccacatcaacacctggggtgcagagggagcatggctctgtgcagacgctgcccgtccctggcgcggtcattacacccctccctcgacagcctaactccacgtggctttcccgcaaggtgtgaggaaggtgaggaagccacaccacagcccgggg

SEQ ID NO: 140868 - DNA, 390 bp, Homo sapiens
attcgcgccacacctgccctctgttcaatggcctgggcatgctccgggacctctgtcctccagttctccatcccccacccccgcctcttcatcctgtccagtggagcatggcatctgtgttctggccctaccccacttctcttttattctctcttctctgccttctccacccccatcctcaccctcacccttctctatccacactcagcccatttctgtctctggcagtctccacgtccaatcgtgtcatgggcttcttaccctgccccagctccagcctctgggcctctgagctcttcctcccttgaggctgtctcctctgagaagtcttcactgactccctaggctgagtcacatcttctagatccctctagtcctgcgtgccctcct

SEQ ID NO: 140869 - DNA, 411 bp, Homo sapiens
tgatcatccctgccacaggactcctgcatttccctattgtgtgtgaaactcaacagcatgaaaggaaaaagaaagttgaaagaagaaatgaaattggatccatatttttaatcattataagtatgagttatacttacaatgataatgttaaatggactttttctggggtcacagaattttggccaaagccccaaaggtgaagacaagtgacatgtaccccatgttgcaaaggagctgctagacatataccccaaatcttcaatgctgacaaaaacttccttcaggccgagcatggtggctcatgcctgtaatcccagcactttgagaagctgaggtgggcagatcacttgaggtcaggagtttgaaaccagcctggccaacatggtgaaacgccatctctactaaaagtac

SEQ ID NO: 140870 - DNA, 302 bp, Homo sapiens
ctgagtctgggagccccaccttgaggctgcactgcttccttttcaacaagcccctattctagaaattgaaagagtgttagggtagaatggggaggcaaaacttctgctgtggattaaaacatgtaaattctctccattttcacctcttttcatagcagcagccaagaaattttcccttcaaaaatccatcttgaggcattcccttctttaacaaaccagtgttatttcagctcaagatgattaaatgagggttctggggaagtacaagagtcccttcaaggaaatatcttagggccatggat

SEQ ID NO: 140871 - DNA, 399 bp, Homo sapiens
ttttcctcctccttctgcagcttagctactcttacttgtccttcaacaccttacaaggaagaaatacttatgaataaatgtgggctaataaaggaagctacagtggaaagacaggtggcaaaaagaagacaggcacactgatgaaaactcaattcagtatatatcctataaagtaactactatgtgtccactgctgtgctaacccttcagtgatggaaactaagtgacagaaacttaatccaaggaggaaaccactgtgatcaaggagataagatgtcacaaatgaaacaagccagaacacaccccagggtgggccatctggtaggtgctatgggcagtcacaagggaagagctcagtggggctggagttgtgagaaaaagcttaggaagaggtggcct

SEQ ID NO: 140872 - DNA, 108 bp, Homo sapiens
aggcttttgactgaaatccatgaatcatgccagtagtgaaggtcatgtcggtgaagatcagtcattcctgaacttaatcaaaattcttaggctggaaaggaatggtgg

SEQ ID NO: 140873 - DNA, 167 bp, Homo sapiens
aggccaggcacgatggctcatgcctataatcccagcacttgggaggccgtggcaggcagatcacttgaaaagccatccatgatccatccatgatccagcctcgccatccatgatccagcctcgcctctcttttcctcacatatcctgtctactttactccccacatt

SEQ ID NO: 140874 - DNA, 292 bp, Homo sapiens
ccagaggcaccaaggaggccagaggcaccaaggaggccagagtcccaatgaggcaggattggtggagcaagggcccgcaaaggcctcctcagtggcctcgactccctgctccaatcccttcacccagcggcgctaatctgaaaccttgatctgttctttattctcccggtcccggctcacacactgatggcttatactatactactatgcaacttccgcacaggacccaggcgggggcactgggctggtgccaggagtcccctccctgccttttcctgcactgggctaactc

SEQ ID NO: 140875 - DNA, 928 bp, Homo sapiens
agcaaatgttgatatattatagggcaaaaggctgcaccttgttcttctttaaaattatttcagatatccttgttcctttgctttttcatgttaattttagaatcatactatcaaattttaatcaaaattattttgggttggattgcatttactgaatttatagattaatttggagagttggagttgtcctttatagagtcttgagtcttcccatacatgatatctctctccattaatttggtcttatttcatatctttccataatgtttaataatttttcccatgaatgtcctggacatattattttagtgcataactcagtgcctgctatatagtagatatccagtaaatttttactgaataaatatgttttgttgctagtgtgaatggaataagagttcaacaaatgtttgtgtattgatttttttatctaggaacctttctgaagcatgtttttctatttttttttttttctttttgagacagagtgagactccatcataaataactaacttaattaaatgggtcctttcaaaaaaaaaaaacataacaaaacacaacacacaacaaaacaaacgagaccacaaaacaaagaggcggggggccgcacaacacatcacaagacgagagcctatataacgagacaccatttaatccacgaccgcgcaccaaaggggccacatacataacgacagagcacgactcaacacaacaagcagctagaaaaaaaacagcgaacgtgtcctgtggggagaacaacaacgggcgggcaagcggcaccccaccaacatgcacacgcaccaacataccatgggacacacaccacgcggagtcgcaataaataaaaaacagaaagcgacaccgacaaacccacaagcacacgatcgcaaaccaacagacccaaccaccaaacaaacaccggaagagt

SEQ ID NO: 140876 - DNA, 785 bp, Homo sapiens
acctactaccacaaaaacagtatgggggaaccacccctatgattcagttatcttcacctggccccacccttgacacttggcgattattacagttgaaggtgagatttgggtggggacacagccaaaccatatcagaggccaaggcaggaggattacttgagtccaggagttcaagaccagcctaggcaacataatgagatcccgtctttacagaaagtaacaaaattaactgggcgcaatgacacgtgcccatagtccagctactcaagaggatcgcttgaacccaggaagtggaggctgcagtgggccatgatcttgccactgtactcccacgctgggtgacagagcaagaccctgtctctttaaaaaaaaaaaaaaaaatttcgatttacagtgggtttattgggacataaccccattgtaagccgaggagcatctgtattgtttcctcttcagcttaaaggctatgtaacagagaaaccccaatgtaggagaatttagggactaaggaacttagtcattatgaaacaggttaggatgagaagcaccaggatttaggctgagcctatgaaagtattttctaagttcaataaagtaaaactataagaatactccatctgaatattcaatgttcttttgattttgtgattcagaaggtcctaaatcactattattcttaagtcacaacttgtagtgccttgtgattctgggattcttcaggtcagatcagagtagcgggaaaggttttaagattaaaggcagggccactgtggggtggggttaat

SEQ ID NO: 140877 - DNA, 442 bp, Homo sapiens
cattcccctcactcatttatccctcgtactttcatttctatggaagaacatggcactggcatatgtttgtctcttacagaacaagagaaagagaccctctagaaaggaaacatcaccaaagtgggcataacctgcacacaggtaagtcacaggggtaattcgtcagcatgatgtctcatagagctaggtggctaaggcactgctaggtgcacatgaatagcacaaagaagccatgtcaggttttagacataccctgttctgtgcttctgtgcttcggttcaacctcaaactgacaagatccacccagcacctctgcgccactgctgctctgatggcatcatttcatgcctcattcatacactgtgcagtggcacttaatgttcactcttcaaagagctagaccatccagacccaatttctccatcataagccagtgcacttt

SEQ ID NO: 140878 - DNA, 150 bp, Homo sapiens
acatatggtgatcctctataagctgctcagtggcagaaaatagctgtccagttgctaggtttattttaatttgcttatccaaatgttcagacagcagcctcaaagctcaactcttattattacaaccaaagatcaaattatggagttgca

SEQ ID NO: 140879 - DNA, 294 bp, Homo sapiens
ccacactgagacagacacatatacacaaagacacggagacatctgaggaagacagattcctcccccagatcggcacacactcacgcattcatccacccgaacgttacaactatacacagtacatgtatgcaggcgtttacaaggacaggacacacgctctcacagaaaccaaccctctagcaaacaaagaaacttgaacagacattcatatgggcagacacctatggagatgtacagactgcagatggaggaggtgtcctcttttagggggtgtctgggaatggatctgggtag

SEQ ID NO: 140880 - DNA, 309 bp, Homo sapiens
tgcctagtcatcgtattttttagtccatttttcttttttttctgatgtattatttgcatgctctgggtattaatcctgcattagttttatgtgctataggtttcttcctccattggtggtttgccttctttgtccactgtattaatgttatactttgggcagaagaaggcttttttccaggtatcccttgactttctatgttgttattaatacatttatagtctgtctaataagccttttacatataaatttttctaaaaggtgaaaatcaaccagtaaaataccattatgctcaatagaactgtctac

SEQ ID NO: 140881 - DNA, 209 bp, Homo sapiens
tccttgaaataaccctcccatcactacctttgtcaatattcttcctgaaacaaaatgaaagacatctagggatgcctgtggacactatgctgtgacatcccttgcatcttctaggcctgactgcataagccattgtcctttttctccaactgccttagacactgtcccctctccagcatcctcctctcggggcacccatcactggctcc

SEQ ID NO: 140882 - DNA, 833 bp, Homo sapiens
ttttgaagactcatttatacctggtccacattgacaaacttatttgcgatttgtatatttaaataattttttcaagatattaacatacaagttcaattctttcttgattgtaatacttcaatatttaatcatatttatattcatatatatttatgcgagcagcaaaattctgtggtttttggtgttctggagtgtacatattttagatttttactgacaaattaatttctactactagtgatcatttctagcattctcaactaacacacttttcaaaaatcttattgtatacttcattaaaaacaatacataataatggatattgaaaccaaaatttctgcatattttcaatttagtacctgcctattgaaacaaaatctgaagggtgtcagtaatcctaggttaactgattagcaaatttcttttaggatactataatactctgactagcatgtttcatgcatgaaaagttcatcggtgatatgcagactacagttttaaatattaaatttaaaaattgatatataaaaatgaaaacttgaccaataaatatatctcacctgtaataatatatttacataaattatccacacaaaaaatatgccttttaactttataaacatagaatattttttgctatattaacatccaaagtcaaaagggtgtatcactctgaaaattctaataatagtgaaagacttatagctatcaaatttatttaaatcctctgttttaatatctactttaaattttcacttcaaaatataaagttaatggtatatatttttttttatatagctgaaatctgcccttgctaaagtttcataagatat

SEQ ID NO: 140883 - DNA, 524 bp, Homo sapiens
taccaacaaaaaaaagttcagaaccagaaggattcacagctgaattgtatcagacattggaagaagaattggtaccaatccttttgacgctattccacaagatagagaaagagaatcctccctaaatcattctatgaagcctgtaataccctaagaccaaaaccaggaaaggatataaccaaaaaagaaaactacagaccaacatccctgatgaacacagatgcaaagattcttaacaaaatacatctaaccaaatccaacaacatatcaaaaagataatccaccatgatcaaatgggtttcataccaaggatgcagggatggtttaacatacacaagtcaataaatgtgatacactacataaacagaattaaaaacaaaaatcacatgatcatctcaatagatgtagaaaaagcatctgacaacatctagcatccctttatgattcaaactctcagcaaaattggcagacaagagacatacctcaatgcaataaaagtcatctatgacaaacccacagctaac

SEQ ID NO: 140884 - DNA, 1003 bp, Homo sapiens
taaaggggcaaacaagttccctcagacctcttgtataagagtcctaatctctgccctaatgacgtaatcaccttccaaaagtccccacctcttagtactatcacattggagattcagtttcaacataggaattctacctacagtggcaggttgcgctgtccagcctcggccccagactccagaatgtcagacgtctttccatctcttcagcccctcactccccatgtaggtcccagcagggctcggtgcagcctcccaggccacatctgctacccctgccctgacacagatgatcagagctggctggcagacactctggaacagaggcctgaggttgttattaatgtcatcctcctatatttcctactctttgccttccaggcatgtggtgggatggcagctccctgttcccttgtgattgggaggtggggtaacctggccaacaaggtgtgagaagtgacatctgtcatttgggctggagcacttaattgccagatagagatctctttccctctgccgtggcttctgacggcctttgagatggcagctgctccatcacccccagtcctggagtaaggagacatggggaccctgccagcccttgacgggtagtagcgtgcatgagaatgacacttcctattaggagccaccaagatttcagggttgtttgttgctgcagcataacctggcctaccttaactcacacacatctccaaaaagcaaaaccaagatggagctcagaaatagcatgaaggacattgtgtttggagaccaaacgctcatagtggacatctttggtgttcacgccacaggagggactggaagtggcaatagagttggccctttgtggggccttagtaccgttagggcaaacctcagagaaaatccatccaaactcttccctggccaaatacggagactgaggtccagaaagggcagggcttcacagcatgctatagtagaggctggcacagaacctgctaacaatagactgcctccattt

SEQ ID NO: 140885 - DNA, 300 bp, Homo sapiens
ctctcaaatggtctacttgagctcaggcatttaaagttgcgtattggcggccacagactttgggaggatgaagggtgaggccctgggagctcgggaatggggtttggccaggcagctatgacctggccccttctgcttcctcctggtttgtggctcagtttggccctgggataggcttctgtgggttccagacctgttcctctccctgcaggttctgccaacagcctccccactccctgctggaggaagtctagctcctcagccagcccttaaggcctagcatggttgtcccctgcccac

SEQ ID NO: 140886 - DNA, 467 bp, Homo sapiens
taaaattaaaatgctatcaaagtgaatttgaaaaatgaaaagggaattttgaaaaatactcaaaaaattaaatcacataaacctattactttcaaaggcaaaaactgcaattacttttgcaccaacttaatagtttcatcagacattaagacacatgcatgtatgcatgcatgctaattctcatggtttgttctgggcatgaatctgcctctatttttttctgataaccactgacaagaaggtaggcatatgattcccatagtcacctcagaaaattagaattcaaagtatagagtggcatttgtggagctgcatgaatttatgagtcacctttcctcttcatctttcacctcgtctctccacaaatcctatacaccaacatcctgggactccttattcatggtgcattccttcaaacagaaatttttctccctatcaccttctcccctggggatcgcatactcccc

SEQ ID NO: 140887 - DNA, 78 bp, Homo sapiens
gggaggggtgatcacaaaatgaaactgggagaggaagaggaagggagatggatgttgaacatccaaatgaccattaat

SEQ ID NO: 140888 - DNA, 398 bp, Homo sapiens
gctgctcttattagagctgttgtcttttcattgtcagttaaattgttttctgaaataaataggaatttaaaatgtagccatattttagaaaaatcactttgacagtgtccttttaaattagcatagttaatgtagcatacattgccagttttaccaaaaccaactcaagaataactgtttattacatgtgcttataattcacttttgcaataaaaatgcatatagacacctagtattttcttactatgatatcttaaaatgtaaaatcttcaacaaaacatgatcagtctcagaaactgcattggctggtataaaaggttgaatagcattataatcttttgcctaatgtggtagcataagcctggtttttttacccctttatagaattttgaatttgg

SEQ ID NO: 140889 - DNA, 464 bp, Homo sapiens
ataattacagagcccatttcttcaggctgctgtgaggattaagaaggttggtatgcggaggtgcttagagctctgtctggcccataataagtcctgaacagcctccactgacattgtctggaagataaggaggcatcacatggcagatggggagatggaggaaagggtgttctcggcaccccgaagggctcacagggagatggaggaaagggtgttctcggcacccggaagggctcacagggagatgggggaaagggtattctcggcacctggaagggctcacagggagatgtgggaaagggtgctcttggcaccccaaagggctcacaggtgtgaaacaccatggggatgaggcagcttgggatggctaggaggagatgctcccagagacaggaggaaggccaggcctggggaactgtggagggtggcaggagtccttccctcaggagcctcttccctgggcc

SEQ ID NO: 140890 - DNA, 530 bp, Homo sapiens
taagcccagtacctgatagttaccttttctgatcctctgcctcctcctggcctcccctggcaagtagactccagtgtctgtcctttccttcttcgtgtttgtaggttctcatcatttagctcccatgtgtaagtgagagcatgcagtacttttttttctgttcctgcattagtttgctgagagtaatagcctccagctccatccatgttcccgcagaagacatgatctcattcttttttatggctgcaaaagatgaactttaagtttggttaacttattcttttttgcaggcagcaaaagtttattgtttagtatcaatatagtatgtaattttttatatggattcatttatggtctgtattaacagtctcacatattggtacaatattgtacataaagtttggtaagacattctcttaggaccttgtcacacattttctttagtattgttgatatcatttgcttcctgtgtttaaaacgcaattcagaatgtgttttgaaatccagatagaatattgtcttaatctaat

SEQ ID NO: 140891 - DNA, 132 bp, Homo sapiens
tgcctcaggtacccccagactttcccaccaaaagatcccactgcacttgtgtcaactggttatgctgatcaaaccctgtaaaatccagaacaaaattttaaaagctaatcagacaaatcctaaaaatggtgg

SEQ ID NO: 140892 - DNA, 253 bp, Homo sapiens
agactgcctgatctcagaacttctaacacagtagaaaagatacacattaatagaaaaatcataaaaatgataaacaaagttgcaaactgtgatgtgtgctatgaaataaagtatagagtaccttaagagtacaaactgggctgggtgtggtagctcacacctgtaatcccagcactttgggaggttgaggcaggtggatcacaaggtcaggagttcaagaccagcgtggccagcacggtgaaaccccatctct

SEQ ID NO: 140893 - DNA, 196 bp, Homo sapiens
gaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcaca

SEQ ID NO: 140894 - DNA, 473 bp, Homo sapiens
aaatcccctgggctgatatttggagatggggccttggtgaggtaattagatttagatgaggttgtacgggccatgaggggattagtgtccttataaaaagagataccagagcttgctctcttctccattagagaatacagtcagaaggtggctgtgtgcaagctaggaagagccctcaccagaactactatgctggcaccctgatctcagacttccagcctccaaaactgtcagaaataaatttctgttttttaagccatccagtctatactattttgttatggcagcctgaactatgatgaggggagactgatgcattaacttcaaaaaccagaattttatcactcaaattttaactaaattgcccatttaaaataaaaaagcccaaatattcaccacactcctagttccaagtgaatcagcatccacaaaatataaaccttaaaaaaatttagtcacttccttccctcaat

SEQ ID NO: 140895 - DNA, 411 bp, Homo sapiens
caatttgcttccgggctgttcctcagacatgagaaattatagtaggaaaagaaatttgagagatttacaagcaattgactggatgtctttagaatcgaggggctttagactttgctatcattcccatcataataaacatactggaaacctggtgatctgtaggcagcatggaaaggaaggcccggaatctgtcagaacctgccaaagatgttcctgcagttatttggagaattaaagcaagcaacggtcagacaacattaaaaaaatgttgatctgtaatgggtggagaaagacctggcatgtatcagggacctgggtggaaaatccattaaaagaggcattatgaatagagtctgaagttctagagtaagaattcctgttccacttatatggcctaagttggtagtttgg

SEQ ID NO: 140896 - DNA, 274 bp, Homo sapiens
  misc_feature (208)..(208): n is a, c, g, or t
gagaatacaataacttttaaaaaataggcttgaacttctaatcctacctgcagggttagaaagcccctaaaatgcagctcagcacaaaagtgtttaagaggacagagacctcgctttttatgtgttcagttcagcagctctccttttctagaatatgtataattgtcattcttctaccaaattctaaacataccttctttgaaccagnataaattgtaatgcattataaaaaaataactcttttacctgttcaaatgataactcaggctcaaca

SEQ ID NO: 140897 - DNA, 423 bp, Homo sapiens
ggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactct

SEQ ID NO: 140898 - DNA, 323 bp, Homo sapiens
gcagccaaaccctagtgggatcttttacttaattcagaagtatgtttttcttaatgtgagaaacacagctcagcatgagcttacaggaaaggtgggcttagtgttgcctgcaggcatcttctgggccttattggatggttgcaccatcctgctgggcttaataccccacactgcccatcccccggagcacctgcatactctggactttctctgctgcctttccatgtccgtggtgtgtagggaaaatgtcccattttctcagggccctgatagctcctaagctcctatattaactgtgctccagtattaataaatgtgtaggt

SEQ ID NO: 140899 - DNA, 379 bp, Homo sapiens
atcctctctacctctccacagagctgatcagccgtggctctgcaggaagtcctttgctcagagctcccgattttcagatggtattgggctttggaaagaatgccatccagactgacggcagcagattctaatgctttagcattttgaagagcatcattgaggtccttttctatcaaatcagactcgttcttattcatactgttggttgcttccactgtttgcctcagctggcggagaatgccggacagagaggcatggctctggaggaattctgccaaatgggacagggcaagctgccgcctctccacaacctggctggcctcctcaaacagctggaagcagtcctcagcctttccctgcaggaggtggaggtcctcag

SEQ ID NO: 140900 - DNA, 309 bp, Homo sapiens
gatttaagctagcatttattttaggagacataaatagctaggtgtgcatagggtaggaaggtggaaggaggtatactgagggcaggtatttactctaatttcatgtgtataacacttaaaaatttacatttttggaggaaatggtgtctctatcaggtttaaattttgaaattatgtgtcgattgatatttttaaaaagaaagacaagtcatacctgacttataaaataaatatgcattttagttaaattgctgtagaatagaattcagctgtcctagaagactatattaattacagattaattattta

SEQ ID NO: 140901 - DNA, 206 bp, Homo sapiens
tcaggaggctgaggcaggaaaatcacttgaacccggaggcagaggttgcggtgaacagagatcgcactactgcactccagcctaggtgacaaagggagactgtctcagaaaaaaatagccagagtgtggctgaggtggagatgaaagtgacaggaggaaagatcacttggtggtcttttaggctgttgtaaacatttactgtaagt

SEQ ID NO: 140902 - DNA, 189 bp, Homo sapiens
agagtagggggtgttttctggggtaacttggaatttctgaagtcttcacagacacaccaggttggggcagtggagcatgtgccttgcagtgaactgtgctcactgatagtttgtatattaagccatttttactttggagaaggtggcagtttaatttgccagtaactacaatgaaagcaatttctattt

SEQ ID NO: 140903 - DNA, 371 bp, Homo sapiens
gggaggctggttaggctcattgctagctaagggacttctgaaaaattcattagtaaaatcacagctctgggggtcagtcaggcagccaaatgatgaatgttaaatccattacaaatgcccatcgtctttctttacatcccttctaatgaaaaattcctaactgcctaaatagcaagtgttctcaaatgatagcagctgtttattaaagaaataacacctcaaattttaaaaaccatgagtcaaatattattttcttcctcccattttatatgtgtgcaacctaaagaatagagaatttaagtaatttttctaagtggcagagcacagatttaaatcctattaccttggcctcagagtttgtgctttatttt

SEQ ID NO: 140904 - DNA, 520 bp, Homo sapiens
aggatccccgtttggggcttgctctttggggacttgctctttcggggtcttagctcttttggggtctatgctctttaggggtcttagctcttatggggtcttagctcagttttgctttgtttaatccagggtttcctgtcccccaaccccaggagcagctgttaacatctgtggagcagttgtattttgcagaacattatttggtaaacattcttttgaggtgttatgtctcctcagaagcatgttttggaggaaactctggaagtgttccctgcccttagtacctgcaggagtaagccttgaatgatggcattgctggctcagcaacaggtagtgggtcatatgtatttgaaaaaagtcatcctaggtcctcaatatcattcctcaaagcagctaccagctctcctgtgtgtgggatggggcctggctctggtcagagagccctctgtggggaggtggtttgtctgggaccagcctaggcctagggtgtaggggtttattcccctttttgcaggctggg

SEQ ID NO: 140905 - DNA, 122 bp, Homo sapiens
ttgcccctccttttcccctttacatagctgcagcagcatttaccccagtggcccggagtttcaagccagacttggagagggccggttgggggttgtgtctgcaggactcttggttctgcagg

SEQ ID NO: 140906 - DNA, 192 bp, Homo sapiens
ttaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggcccc

SEQ ID NO: 140907 - DNA, 282 bp, Homo sapiens
ccacccccagggccccttcagggccaatgttttcttgttacttcaacgtggtcagcctaaaggatctcactgcctccctgagaactgctccggggccgcagatctcttgctctctgtcattcctttctgggacaggagaccctgctggttctggaggagtgtggggtctggtctcccctctgcttctggccaaggtgccttgagcatttgcatgaatcttctcttccccttttctcgcttctagacaccagcttagttccctaagggttcaggcctttaaga

SEQ ID NO: 140908 - DNA, 736 bp, Homo sapiens
tgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctca

SEQ ID NO: 140909 - DNA, 641 bp, Homo sapiens
ctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtca

SEQ ID NO: 140910 - DNA, 163 bp, Homo sapiens
atgctaatcagtctttttctcatttaaagcgttcatctgatgaccacaatctgaaacttctggctgtgacaaaggggaaaccattctaagatttcctgctaatttcaaacaccctcatcctcacatacaggccacataagggccagtttctaagaaaagagct

SEQ ID NO: 140911 - DNA, 346 bp, Homo sapiens
ttgcaattacgtatctaaaacagtgctaacagattggtttatttatttgagagtcactagccctagcccactaccatacacttagacaggactgaaaggagcccccctgcccccgactttttttcctgtgtatagtgtttggggaaagattacaaggcatacttagaatttttcaagttgaaaaaattttgttttgcaaaaaggattgcatgacctgcagatcgcacacagtaattccactttcatgtgtgtagcaaagacagaatatctcactggcggcgtacaacccaacaaagcaaaaagggatgatcctggaaaatgtatacagaagaaattttcacctccc

SEQ ID NO: 140912 - DNA, 193 bp, Homo sapiens
cacctgaatcattctggataaacaacattgctgctcctctactgattcatcctcgaggttagaactatagaatgtcacaacacagaccacgtcatctacacatggaagtctggggagctgcagacacaccttcggcatgttccttggctcagtgagtactcagcttctaccctgagctcccaccaggtaatag

SEQ ID NO: 140913 - DNA, 428 bp, Homo sapiens
ctgcgttttctctctagaagcttgtaggagtttctctctccatgtattgaaacttcacatttcagtactgggtttggatctatttttatccacagggttgggtacttagtgaatccttccaatcttaaaaactcctacccaaatctttcagctctcagacatcttcaacaattcatttgtcaacttcttcatcttcccttcctgtagggtccagccccatagggtcggtgagtttctccccgtgtgtggcgacgagagagtgcagaaataaagacacaagacaaagagataaaagaaaagacagctgggcccaggggaccactactaccaatgcgcggagcccagtagtggccccgaatgtctggctgcactgttatttattggatacaaagcaaaaggggcagggtaaagagtgtgagtcatctcca

SEQ ID NO: 140914 - DNA, 314 bp, Homo sapiens
gccaagatcatgccaccacactccagcctgggtgacaaagcatgactctgtctcaaaaaaagaatgagtttcaggatcacacagccataggtttgagtttcagcttcaccaatgactggtgtgtaaccttggcagtttacttaacctctcggttccagcaccctcatctgtaaaatagggagacttagctttgtggaataataggaggatattaggcagcgctgcacattgagggtgtaccttgtacactgtcttgggatagaataaatggcgtgtgtgtatttccctctgtagatcccctttccttatctacc

SEQ ID NO: 140915 - DNA, 311 bp, Homo sapiens
atacaacctctatgccatgtgagggactacagaattaactgatattaaaaaggaatcctcactgggcgtgcctatgatcccagtactttgacaggccgaggcgagcagatcactttaggacaggagttcaagaccagctggaccaacatggtgaaaccttgtttctaccaaaaatacaaaaaaaaataagccaggcatggtggtgcatacctgtagttgcagctactcaaagaggctgaggtgggagaatggtttaagcccaggaggcagaggttgcagtgagcagagatcacaccactgcactccagcct

SEQ ID NO: 140916 - DNA, 349 bp, Homo sapiens
aatttatgaaatgtttttctccttcaccaaccaagcccccactgcctcatctcaaagaaggctcttctgggcaagcatggtggttcatgcctgtaattccagcactttgggaagctgaggtgggtggatcacttgaggccaggagttcaagaccagcctgggcaacatggcaaaaacccatctctacaaaaaatatacagattagccgggcgtgatggcatgcacagtcccagctactcaggaggctgaggtgggaggatggcttgagcccaggaggcggaggtcacaatgagctgagatcatgccactgctttccagcctcagtgacagagccagaccttgtcaaaaa

SEQ ID NO: 140917 - DNA, 216 bp, Homo sapiens
aggaaagcatgagaacatcatttaactacactagaattgtaaattaaaacaattttatcctggctcacgtctctagggctgccttgaaccactctttagtgtagactctcctgtccaacctccctggagtttttaaaacacatcgccctgtctcacatttctgtcttcacacaattttcttttcataaaaattttcccaccctggtttttttttgc

SEQ ID NO: 140918 - DNA, 549 bp, Homo sapiens
tgaggatgcttaggcattgggctgtatttggttgtcactagtgggtgggttggaggcacggaggcatcctgcagtgcccagggtggctccccaggacgctcctccagccttgaatgtcctgcctgcaagttcgggaacgcctggtctgctgtccaggcattggccgcggagcctgagtcccgtcaccaaccccatggggcctgggagctgggcggggccggaagagtagcccggggaggcaaggcgaggctgaggtccacgctgctttgtgggatcctctcgggctaggggtgccgtgcccgctgcccaagcctgcacctccagaggttcgactcgccgtccgggaagccattcatgccctctcgtctacggaggatggcggccacatcttctgcaccctggagtccctgaagcggtattctcggtgagatggagcctaaagcgctcccgagggaaaaggaggagttaggctcggcccacttctcgcgtgtcctcaagatgtcttgcaagaaggttgacccagcctggttggcgctatagacccaatgg

SEQ ID NO: 140919 - DNA, 568 bp, Homo sapiens
aagtatacagagaagtgcaagcagaatgagatctgtagctgcttaagagtggctgataattaacccttctctctcttccccaatcccagtgggtccatgacttttggacaataaagcacccaacctgtgacagcactaagtgattcctgtgccacaggcgggaagcctctcagtgaggctgtgcacttaacagtcatcccaatgacagggaggacagtcttatacacaggaagtttataatgaactgaatttgacaatggcagcctgttcatgtgcagaaactaagatcagtgcctggggacaggcagtcaacttttaaatattaaacagcatataaatatgtatagccttgacctgaacacttgagttatacgttctgaataattatcatttctgaaagactaagggatagatttaccaaattaaaatacagaatctataggatcatgatgttctgcatttatagcattacacgatcaaagccccatctggataaaaggcaaaggcaacttcaaaaaagtccttagagattagatccttgaatctcatctgaagtccactggtttca

SEQ ID NO: 140920 - DNA, 345 bp, Homo sapiens
ctattactgagtcaaatttagatttctggcttttggttattggtgttctgaaacttttgtcttttcttctcaagagctggtttagcatccagacccaaatatgttataatgttgactttattatttaagtcatatattagttcctaaaaattatgaaatatcatcccaaactattgatctattaaaaagctaatttataaaaatgttatctcatttatccctctcctaaagagaagtaactagttcctatcgggaaaaaatgagtataaaaaacacagaggaaaacaggggaaggaagattataatttgcatttagaaggaaatagtgttttaaacctgttgctg

SEQ ID NO: 140921 - DNA, 304 bp, Homo sapiens
taaaacacgcctgtgataaaggcatatgtaaaagaatcagtggaaaaaaatagagtaacaacttttttcaaaaacacagaaaaaattacaaaattcagaatagtgattgcctctggggggaataaaagggaaaacagaactggggattagaacaaagtagatatcaaacttagtaaataaatatgacacacacacatgcatacatgtatatttaatatataagttaccaataagagctgaaccaaatcaccaaaacccaaactatatatttatatcttgttcatgttcacatctagctaaaaac

SEQ ID NO: 140922 - DNA, 314 bp, Homo sapiens
ccgagattgcgcccactgcagtcctggagtccgtgctgggcgacagagcgagactccgtctcaaaaaaaataattattattttattaggctgggactacaggcacccaccgctatgcccagctaattttttgtattttttagtagagacggggtttcaccgtgttagccaggatggtcttgatctcctgacctcgtgatctgcctgcctcagcctcccaaagtgctgggattacaggcgtgagccaccactcctggcccccactttttttttttaaattaaaaaacgcaatttctataagaagtctgtctccat

SEQ ID NO: 140923 - DNA, 123 bp, Homo sapiens
cccacctgccctgatacagggtaaaaatgctaatgactcctttcccagccttgctggcaagggaagcgtaagtgtatgccaagtgtagacactgagacacaagtgagacctactgggagcctc

SEQ ID NO: 140924 - DNA, 417 bp, Homo sapiens
tgccaaggagccaactccccagggcgagggtagagtgcaccagctcactaaaggggaactgagcagacaccagcagcatccttaatagcactgcccattcttctcatggctttggagaagtctcctgattgcacccactaattatttttccttgtggctaaaatatacataacaaaacacaccatttttaagtgtgcatttaagtggcattaagtacattcacattgttaggcaaccacccccgatatctatctctcaaactttttcatcttttgaagctgaatctctgtgccctttaaacactaactctccattccccactcccctcagcctctagtaaccaccattttactttatgtctctgtaaatttgactactctaggtacctcatcttaagtgtaatcatacaatatttgt

SEQ ID NO: 140925 - DNA, 213 bp, Homo sapiens
gatagaactcaaagaataaagccatgaggaatcgcaaaatgtttttgaacaaaggaaaatatatgtaaagtggtgtgttaggaagaattatcctctgtaggatgggtcagtggcgtcgagtcaggatcagatgggaaactcttatctagggttggccgatgggcatttttaaaattgttgaaaatactaataatgctttcttgtgcatcagtt

SEQ ID NO: 140926 - DNA, 460 bp, Homo sapiens
cagggaactggtgccaggctgtgggactgttgctgggggtctccagagcaccctccccattcgttcccattggactcagcccaacaatgactcctcccgcactgccaaggaggggctttcatgaccctgagtgcttggcagggtagagctccactacagttctcagtggcagttcacatccactgggtgggccgtttgggttttgcatgtcttctaatttatctgcagactctgggatgttactattttaggcctgccatctctaccaagtttccccttgacactacacgctcatcccactccagacgacagagcgaggactgcagatgcagttggccttgcttgatgcagcttcattgctattgcttggttcacaatagaagttaaaagtgatccccgttggccatttagaggagaagggtcccaaaatactttgggaaaaaaaaggacaggcctataa

SEQ ID NO: 140927 - DNA, 364 bp, Homo sapiens
cagggagggctacgctgcatcgtcctctctcatgaccatgtcggggacatctggagcatcacctgcttccaggcagggtgaagggaatgtggaatcactcgctgactcctgcatgcttcagctcggaagtggcacgcatctcttccactcgtatctcactggccaaagcagattacacagctgggcctaaccccaaatggaagaagtgtagcccttccctgtttccagaagaagagacaggcactgatggacaggggtgacagcctccccgctgctgttcctcgaacgcgccagacacgccccagccccgggcctttgccctggctgttccctctgcctggagtgcccttccccaaacacctgc

SEQ ID NO: 140928 - DNA, 274 bp, Homo sapiens
ccccctattgctggtgaaattgcttagagcaaggactgtcttacacatcacaggatctggcatagtgcctgaccgagggtgaaacaacaaatgaatgagtaattgaaaggagagagaaaaagagatagagaagtaaccaaaagaagaaagtttttaaaggttcagaggaaagaatgaggtcagttgcaattttttttaagtaagatgttggaaagaataaatgacatgatgaaaaggaaactgacatgattcctatcatgaatttgaaagctat

SEQ ID NO: 140929 - DNA, 514 bp, Homo sapiens
ttgcaggctatgggaaagggattggattgtattttgtttgtagggaagccatcgggggacttaagcagaggaaggattggcttcatctctttgaaaaagttctctctggatgctgatgggaggagaaatggaaggaaaagaaacacttttaggggcaagaacttttgagaagggtggaattgggagtgtggagttggggccagctttggcacaggaggggaagctaaacacgtggccgcatgagggcctgtaattctacctgaaatgggtaccatttgttagggtaaacaaatgaaccaaatgcccagtgatacagaccaagtgttggcaaacttcttctgtgatggcccaggtagtaaatgtctcaggcttcgcaggccatgtggtctctgttgaagctctgtgtagtagacaatatgttaatgactgggcgtgactgtgtgctaataaaagtttatttacaaaaacagcccgtgggctggatttagctcacaggctgtagtttgccaacctc

SEQ ID NO: 140930 - DNA, 394 bp, Homo sapiens
taagttatttcactggttcaataatggagttagatcattatgggggcagtgctcagggaaaagcccatgaacagggtgggtgatatggttaggcttcgtgtccccactcaaatctcatcttgaattgtaatccccaggtgttgaaggagggagctggtgggaggttattggatcatgggggcagtttcccccatgcctagtgatagtaactgagtgctcacgagatctgatggttttataagagttcagaagttcctcctttttcactcgtctctctcctgctgccttgtgaagaaggtgcttgcttccccttccactatgattgtaagttgcctgaaacctcctcagccatgaggaactgtaagtcaattaaacctctttcctttataaatga

SEQ ID NO: 140931 - DNA, 584 bp, Homo sapiens
gtccacaattccacaacacaacatctgaactggtagtttaacatgattaagggcatttgaacatactattaaataaataatcttgatgttttattagagaaaagtagttctgaaaatgtaatagatgccatacaagcacaatggtgcagttatgtataataacaaaatgtctaatatgtaaagacctgtagaagagtaaaagaccagttttctatgcaattttcccactgctattaaacagtcttgctaccatctgaagggaccctgagggggacacaatagagatccactcttcatatgtggcataaatgaaaatccaaggaatttcccccctttcactaagacatgtgaacttactaaccatagaaaaacaataataaaatttatagtttaatcatgcactttaactgggtatttttcccaatgtatttttaggtctttttaaaataaaaattcttaaatgttacaccatacacattagaattctgtaacacaatggctttttcttaatggaacaaattttagcgttaacacataccaataaaacatgaaaagaacaatgcagtaaaaatgtgttacggtaa

SEQ ID NO: 140932 - DNA, 291 bp, Homo sapiens
aatattgcacaggtcagagaagttaaaattttacttttttatttgaagagtaggaataaatggatctatagggcaaaacttggaattgaaacactatatagatatggatttccaaaacattttttttcaggagaatctcacaaaatatcaaccatcaaccacatcttcaacacagaagacagagtagaagctttttgggtttatgttgttgttttgtttgtttgttcaaaaaggggtctcactcggttgcccatgctggagtacagaggcatgatcacagttcactgcctt

SEQ ID NO: 140933 - DNA, 318 bp, Homo sapiens
cccataggaatctcttggtgttcataccaatgtgacccagaagtatgggtggcctaacacctgttgagttgttcttgagcaacagggaatgggtactgaaggatacttgtttcctcttttgtcctctgggtggacagttctgacaggcatttgatatggcttcttagaatgtccaacaacggtgagcagtggtcccatagtgggggcccagcttgataactcgtccttctattgtctgtccctcctgccctgttttactccctcagcccctcattcctgatctctgggatcacttcccaaagaacgtacctgcactta

SEQ ID NO: 140934 - DNA, 559 bp, Homo sapiens
gataataatagtgagtggcatgtgaggtatatgggaattttctctactaccttctcaattcttctgtgaggctaaaactattctaaaaaagtaaagtctattaaaaaatggggtaaaagaccatttgtgactaggatggagacagtaaggcggtatatgatgtgaactgaaccttaagaaaaaagtaggggccatataatgcgagacttcacagtcatgtcaaagattcttaattttttttaatcctaagaccaacgggaagccaggaaaatgttttatgtaagggagaaaataatccactctgcatttcagaaagctctacctagctgtaattggtagaatgaatttggcatcctagagtgaatgcaagtagagcaggcaacagatatcggcagcttggaccaagggttctggcagtgaagacaaatggaagaggattcacaagaaatataagaagtaaaatcaatagaacttgatgatgaattgatgttctttttttttttttttttaatcagactagccaaagattttctattttactggtcttttctatgagcta

SEQ ID NO: 140935 - DNA, 384 bp, Homo sapiens
ttggaaaacgtgagttggttttccaaaaatttttatgtctcaaactaccaaattctgttaaaaacatcaaggctcatcacagaaaagcatgacatacaatcattactgttgttctttttttagtgtaagcatgaaggaaagggaggccattggtaaaaccacctgacactaataaaatggaaacttaaaatcaatggcaaatgagcgtgattaattattaacattcttaatggatgtagtacctggtatggtactttgtagtattaggtactcgatacgtgtttatggaaatggcaaaggaacaatcctaacaatagtgactgttgattgaatttatattctgtgccaagcactatgctagagaccttacatcattattccgtc

SEQ ID NO: 140936 - DNA, 308 bp, Homo sapiens
ggcatttatggtttagtatactggttgcaagacaaaggagacaaggcaggacttaggcttcaagctgtggaaaagtctattgatcttggccaggcgcattggctcacccctgtaatcccagcactttgggaggccaaggcaggaggatcatgaggtcaggagattgagaccatcctggctctctatgaaaccctgtctctattaaaaatacaaaaattagctgggcatggtggcacgtgcctgtaatcccagctactcgggaggctgaggcaggagaatcgcctgaaccagggagtcggaggttgtag

SEQ ID NO: 140937 - DNA, 581 bp, Homo sapiens
tagatggtatggcccatacatctgttccaataagattcagtttggtatgttgaacattttatcagttaactcatgaaaaataaatgcttttgttttatctatatgttgagtatcctttgcttgcatatggtttgtctaccagtagtataagttggttatgtttagactgaagtagatcacgatgtggttcttggactagttcatagaaacctgatcttataactgtattaccttaatatctgcaatgaaaaacacttgagaacaaactatacgtgttgttagcattgctgaccctcagctccatgttaaagaaatcctatttcatggattcaaaaattaaataaacttgagggactaaggtatgcaatgctgttcagtaggggagaaataaaatgtcaaaaaacataaattgagcagctgcaaagtatattattacacacagtgctagaaatgaatgaagtggcttgatccttacctttcatgagcctataatcggaaggggaacctgagaagtaaagcaacagttatgcaacagggttatttatggtatgatcaatttcacttatcgcctgccttgttac

SEQ ID NO: 140938 - DNA, 102 bp, Homo sapiens
gtgaagatgacatgaaataatattcacaaagcccagacgtcatagtgttctagacaaaacactgatttggagagttcaacagatacacaagtttgacggttg

SEQ ID NO: 140939 - DNA, 310 bp, Homo sapiens
tctactgaatgttttctatctctcttacctcaaaaatagtatccgtgttaaattgcacaccctcaactcctcaaattagtatgtagtgcttttcttttcatcattagtacaaatcagaggtttttttaccctctaaaaatccatacatccttctctttctctttggttctccatttctggctttagagaatcctgggaggatgcatgagttcttctctttccttccttccagcaggactggcaaggcaatccatgtagtatcagccattggggcatactgattacttgctggttctgatcaacacagtgg

SEQ ID NO: 140940 - DNA, 262 bp, Homo sapiens
gctatcacttgcatagttttgacttttaaaccatgaagatattttacatatttgaaaaataaaatttaaagcaagctgactacaaaataaatctacttgtataccaaattgctaaccacaaggaaaattttaatttgaataacttttgaacaaagtcctgccactggatggctttgataggatatatcctaagaacaaaaataaattttgactttggtgagtttgttggtagaggtggtatattggtgtagcaattttggaa

SEQ ID NO: 140941 - DNA, 318 bp, Homo sapiens
tctttgagatccttattcataaggatatctttttagaagtcttctctgaactccccagtttaagtgaactgcttctatctccttactaccagtatttcccttgccaacttttctcagttatcgttcctaaataggacttattctgtccatttctactgctgttaccttagttcaaagctttgtcattttttgcttagataaccatagtagtctctgaattgatttctctgcttccagtctggcttccttccagtagagtccatacactgcaagcctcagtgggttttttgtttgttttgttttattttaattttcctt

SEQ ID NO: 140942 - DNA, 501 bp, Homo sapiens
agtgcaagtagagaacgctcacctgaaacttcccattcctaccagtgtgcatatgtgcatgtgtgtattagcatgaaataagcacgtagacaagcttagctcactgcctggcacagagtgggtttcaagaaatgttaattcctttgccctcattttatgtgtttgacctggctgctgcctccctcttcaaagcccttcacccatccaaattccacctgccttctcacttggtaggatcccaggaatgcctggaggaaatgctccttctcccgaattcttctagcacttgctctctggattatgtgatttaggactgaattacaccctgccttgcatggtcctctaattgtttctcatgtttgtgttacgtctctcctctacccccgaccccactatgagttcataagcacccctgaccgtaacggggagatgaactggagccacaatgccttggctcagtcctgaccctgccatgtactgaataaatcatttaatctctca

SEQ ID NO: 140943 - DNA, 239 bp, Homo sapiens
tacagcctgaatgttcttcctaaaatatagctcagatcctctcacagctcagaatctttaatggtctctactatctacaggatatggtccaaatgacttagtctgcatttctaattgagtcttactttctgtccaattatacaacacccacgaacagccataaaacctacagacttacttatacacacacacacacacacacacacacacacacacacacacacacacacaaacttacg

SEQ ID NO: 140944 - DNA, 572 bp, Homo sapiens
tggtcaaggcttagagacttgactgaggcctgtggaggtggatgtggctaaaatttgaccgggcagcctgtgggcgtggctgaagagcatgggggtgtggtcagagctggaggtgtggccgaagagtgtgggggcgtggccagggcgcctggtcttagacaagcccctggatgggagtgccaccaacatgtttccagcactggagccgtccttctcttctgtaagtgggctggtttgtcctctcccttcctccatctcttttttcccttccatgtgcagtgccctaatctgcattctgggaacactgccccatgtgaatagtaactgcacccctccattcctgactgcccccccatcagggcacctcgcccacctccacccccactgtcctctgaactcagagcagcttcagcctcagagaacgtctgcgtgatcctgctctccccagctccagatcctccatggctccctcacgccctttggaaaaactcactcttctcccccatgaccgccagacccctgggctcctgcattcactccatccagtcacagagctctgcaaacatgctgag

SEQ ID NO: 140945 - DNA, 253 bp, Homo sapiens
tactgggattacaggcgtgagccttgttggcccagccctcttggagtcttaggaaggggcgcaggttgcctgggtttccctccttgcctcttcctgcccccagagagcaccatgaagcccaatgaaggtggatatggggcaggagctcgctggggctctggtgtgcaggaaggtttccctgtttgtcttcaaaactgattttgtaagtgctgagagccgtgttttgtttctctacctctatggcctcatctgc

SEQ ID NO: 140946 - DNA, 445 bp, Homo sapiens
acaaagggaaagtcagggaagaagcaaaccattttcaagggaagcaacatttttcctggcaccatttgctggatgacatttcacatacggatttatttttgaaaaggatttaatggattttgacccaaagaaaaaattttacagaagatgttaaagtacattaatatggttatttcccaaggtaccttggtttgtaagccaaagacacaccaccttggcaaattcagggaaaatctaaaaccatgggaaccaaatttataatctaacttagtggttttcatatatttaaactgccaccttcaacttaaaaaatatgttttacattgcttttacaatgcacaaacacatctcaaacaaatatttctccaaaaagtatttcccttacaataagcaaagcatgttgatatgttctctatattgtacttcatttttcaaaatgtttttg

SEQ ID NO: 140947 - DNA, 214 bp, Homo sapiens
tcaaaggatccgtccttcactgcacttaacaaagcaaatatgttccaacacttcccaggcaacgttccatacttgatccttggtctataggtattcttgaaagggcacagcctatttcccacctcacacctgattgatggttctcactgcccgaagctcgtgagctgtcagagatcagctgtaatgagcgtccacacagaagttctcatggatg

SEQ ID NO: 140948 - DNA, 284 bp, Homo sapiens
aggcgacagtgacagataactgcaaacacccacggtgccatccccgcgctggcacaccacacagcttccactcaaaaaaaacggagtccctttcttcattatagtcatatagcacacaaaaatcaattcaccttgtattttaaaactcaatttccaaataaagccttcaggtagagtcctgttttcttctcaggcacacccagcctgggaccagaagccccaggtgggggtagagggtgggccaagaagtctagcagtcctgctgtgccatatacaggtgagag

SEQ ID NO: 140949 - DNA, 474 bp, Homo sapiens
tcaagggttcccccaaaccagctcaacccctccatttacattataatgcaaaagctcttccctgtgggtctcagggcctgtggggaaaatggaatctggctcaaacccaagatccaaagctaaagtgcccccaggttgggctgcctgacagttttatagatatggcattgagtggcctcctggcagtttggaattgtgaaggttcactcattcatttttcaacaaatattttgaacacctgccacatgctgggaacggttcttggtgttgggcatagaaagccttaaaaactccctgctcttgtggcaccccctttctagctggggagagacagaagatgcaccaataaatatgtgaattatatagtatggcaagagaagatcaaactgcctgcacgaaaataaggtggggaagaggggtaaggggtgcatggtgaccaggcttttaaataggataattagggaaggcccaatg

SEQ ID NO: 140950 - DNA, 205 bp, Homo sapiens
gagtgagccaggtatctgtctgcaaggggctctgagccccttctcttgggggtgcccgtccagaatcccgaccccacatgctgtcacctccaatcctgctccccaccaaaggtggggctctgtacccccagagctgggtacacagtaggtgcttcctctgtgcttaggggatgagggagggaaccagtgcatgagtgggtggcca

SEQ ID NO: 140951 - DNA, 500 bp, Homo sapiens
gtcttgaactcctgacctcagacgatccacccgtctcagcctcccaaagtgttaaaattgcagacacgagccactgtgccttgccggttttctcatctttaaaatggctatgactatgtgatgttattgtgcagttgttgcaaagatgaaatgaaatatgtaagtgagagccagtggtacctggtaaatgtgggttttcttcttctgtccctcttttcctccccccagcccgccctttcttctttccttccttcctggtcgacatctctgattacaatgtcagagaaccaggagctgtaggacaaagaagatagggcgacaatctcctccaggggactcagggatggaaaacgcttctcagactgttgcagcaggtgacagtcatctgctctgcccagaatctcctggcctctcccctgctggataactggccccatgccggccccatcagggcatcaggcccctggactgagatagaaagtggatcccaggaagcatat

SEQ ID NO: 140952 - DNA, 108 bp, Homo sapiens
taacctttatacccttcttcacctgattagccaatctacttttattcaagtgagtgctatgaaaatccatggtgcccagtgcggtggctcacacctataatcccagca

SEQ ID NO: 140953 - DNA, 315 bp, Homo sapiens
taggctctgacatattctgaaatccaggaatattggttcctgtttgactagaaagaataggtggtgagcataatctttacagtaatgcctgcctttcaaagtttatatcctttcttttgcatggttactacttactgaactcacagtactctatactttctattgcttgtatgctgctttcttacaatatgcttgtaatttttaccatgaagttagcctagaaaaacagtgattcccacagtatcttgtaaggtatttaagttaagcactccttcctggctcctcctcagcatcggtagacatcttcccaagtta

SEQ ID NO: 140954 - DNA, 288 bp, Homo sapiens
ctgcctcagcttcccaaagtgctaggattataggtgtgagccaccacatccagcctaaaacttttttcatgcttctactcttatctcatttgtgtttttatatttaaagtgagtcacttgtagacaacttatagttgggtttccttttagacctagtttgacaacctctgccttttagtcggagtgttgcatccatttacactgaacataattatcagtatggtgaggttgaagtctaccatcttgctacttattttctacctgtcacatctggctttttattcatct

SEQ ID NO: 140955 - DNA, 324 bp, Homo sapiens
gccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtca

SEQ ID NO: 140956 - DNA, 680 bp, Homo sapiens
caatgattaataatgtttatactaatgactgataatgtccatgataatctctgtatcgaatttgtattataactattcttattctagctattttcttcattatactgaaaccgtttgtgccttcagtctcttgcctcggcacctgagtaatcctttgcccacaagcttccccagtcttcacatcaccatgctgtgtttcagtcagttctcctttgctttttgcttctaagcttgctttcacatgctgttgaatggaagaaacaagttggagaacaataatacagtatatgaaaaaaatatcgtatttcctagggtatatacatatgtgggttggtttttttttgtttttttgtttttttttttgagacggagtctctctctgtcgcccaggctgtgcagtggcacgatctcggctcgctgcaacctccacctcctgggttgaagggcttcttctgcctcagccttctgagtagctgggactacaggtgcccaccactattcctggctaatttttgtatttttcgtagagatggggttttaccataatggctaggctggtctccagcttctgaccttgtaatctgcctgcctcggcttcccaaagtgctgggattacaggtgtgagccactacacccagccaaatacagtttcctcttaaatgcataaatgagcaaaaaaa

SEQ ID NO: 140957 - DNA, 506 bp, Homo sapiens
gctgtttataaaaatgacgtgaacagcagtttcagcctcaggaggctccataggaatgataaagaagaggattacagaagctaaagcttttgtttaaagagagattacaaagcatttatttcggatcaagtcagcctgaagcttagcagctaaaacttgcccttttttctgctccgtgatgagttttgctcttaaactgagtgctcaaatgagaagatgaagatgaggctttatttggaatgacctcaaatgaggccgttggtttttcactcttttgttaatatgaattcaggaaacacgaagattagtaaagattctaatcaattgcccaacattagtttttctagtaacaagggcaaatgtgctttttaagtacttgaaggtgaaaagaaaatcagacagcaagaaaggggatgcaacaaggttaatgcctcagagcttttcataaattgtggtttctgtgttggaaattgttcaaagtaaacactgcccatgttgggaaggta

SEQ ID NO: 140958 - DNA, 1460 bp, Homo sapiens
agcggaagaaaaaagagtcattcgatgtaacaataatgcaataagtagaggagaatctatatttcaattgagagaagataaaagttaaattaaggataattttggtcactttttcaagacagaaaaaggaaatatagaaagggatcaaaaatgacttcctgagaacaatataaatacaaaagtaaaataaaattaaaaaggaaagggagcaagagtgaaatgtgcatttaaagtagcttcttttttctgtgagaagtaatcttacaaataaaggttcaaaaaaatatgaatctgtagaaaatgaaagagaactggaataccaaagagatgaagaatatggatagaggagtaagctatgagcagaggtttgaacacatctgtgagaaatatgttctatttaattatataatccaaatatcacaaacacctctggtcacacatccacaatggttcttaattataaatattatttataatttttattactaatgatgatgtatgatatgttatctatttactatcattttaaaaatttggactctttttataaaattggaaaaattggaaaaataggcaaggtgcagtggctcacacttgtaatcccagcactttgggaggccgaggcaggcaggttacatgagcctgggagtatggtggtgtgtgcctgtagtcccagctacttgtgaggctgaggtggaaggattgcttgagtccagtaggcacaggtggcaatgagccaaattcgccccactgcactccaggctgggatacacagtgagactccatctcaaaaaatggaaaaataaaaaaacaactatcggcaatattgtttttgtaaatgtatgcaaaagcctaggactcagattccactgaagtcactgtgatgtgtatatacatcacagtgtatatatacatatatatatacacacatatatatatgctcaaatttttttaaatgctcagatttttaaaatcttattaaaataatttccagattttaaaatctgttaatacttatgagactacatttgtaaaaatgtattttaagaatatggtttactgacaaacataacaaaaatgctgacacaaattttttttaagaaacaaagaatattggttagaatttggagaaaaggaaacccttgcacatcgttagtaggaatagaaattagagccgccattattaaaacctatatgacagtttctcaaaagaattaaagatagaactagctgggtgcagtggctcacgcctgtaatcccagcactttgggaggccaaggcgggcagatcacgaagtcagtagatcgagaccatcctggctgacacggtgaaaccccgtctctactaaaaatacaaaaaattagccaggtgtggtggcgggcacctgtagtcccagctactcgggaggctgaggcaggagaatggcatgaacccgggagtcggagcttgcagtgagccga

SEQ ID NO: 140959 - DNA, 346 bp, Homo sapiens
tcagaaaggagagagaaaccatcgccttacctgagccatggttttgagatatgaaagagatgaccagtccttcctttggagtcctctttagaaaagaggcagttcctaaggaggcaaagccgagacaaaaaaagccacatgagaccacatgtgcctcacagctcttataattctattaaaattgcctccatttcccttgtattgatccttgtccactctgaacatgccacataaatatagatgggacaaccagctaggcaaattctgttttatccccaaggccagagatacaggcttttggggcagcaggatggattttgggcaagctcctctcccctcaagcact

SEQ ID NO: 140960 - DNA, 190 bp, Homo sapiens
tggcatctggcaaataatcaagaaatctttatggaataaacagaaaaaggtgatataaatgtaaaaggaaaaaatttctcagcactcctgtgcatgtagaggaggcaggtgaattccacatttatggcgatggataacctgtgcttagagtggacctaaatccctgaccaagaaaagaagtttggaaatg

SEQ ID NO: 140961 - DNA, 166 bp, Homo sapiens
catgtgtcccaaagggctcatgtctctgttgtactcaaagttcaaatggagcccagcaagccagatctcctttacttctaggttccctcaacagtttctcctctgctttagagactgccttgaaaatattcttgtcctgctgttgtgttttggctttggaatgatg

SEQ ID NO: 140962 - DNA, 507 bp, Homo sapiens
aaaaggcatctccctgctgtggaggaatgtagcatcaggttgaaaaatagattctgggagatcccaggatgcaaagaagcccagaagctgccatggggagctcagatgtcctccaaaagggtgggtcaccgactgagccttaaaggagtaagtaggactggtgaagtgcatggggctggcattccaaacagaacacaggacttgagcagaggcttgccagagactggggagcacaccaggctggctggggcttcatttgggtatggggaaagtttagttagaagagcagatcaaggttggattatgggaggcactgaatggtaaatttaagggggctggatttgcctgcaggcattggggagcttccaagggaaccagagataggacgaagctcttgggtaaaaatatgaagcaatattaggtaatatgatttgggtcagagtaggggccatagaaacgggaaggaaggaatgaaaggcatgaagaaagaatctgcaggattgagtg

SEQ ID NO: 140963 - DNA, 237 bp, Homo sapiens
ccactgcctctaacaattacttcatcattttcctcagtccagtccctgagatgttcttgtaaggtgggccccatcttcctggggtcgcctgtgcctcttgggcttcatggaagcccaccccacccctccacgcctgccagtgcttcctcacagcagccctaggcctgctgcatgcacagccccacagtgacggacagcaacagaaggggtgggaccaacatggaagggggcagggac

SEQ ID NO: 140964 - DNA, 318 bp, Homo sapiens
aaaaggaaatataggtaagtgggaaaatcacaagcttaggtatgaaaagattctgggttcaaatccacattctccttctgtatgatcttaagttatttcctatctgaaactcagtttccttgcatatacaaaagaactaattgccacatgagttattgtttacttactacttattcttctctagtcttcagagtatcttattttattgtagcaggtgaagatgctcccaagagatttaaaaaaatgtttttcaaaatatttttctttatatgaaaaaaactttttcttaaaataaaaaacagcatatctatctgaact

SEQ ID NO: 140965 - DNA, 239 bp, Homo sapiens
cccaccagccttctgggagattccagcaaagtggctctcctttcctgattttgattttgtgtagttgcccagtctggctcacactaacatcgacctgtgtttgtcaaagattctcctctggtaattcaaaatagcgcaaggagaagtgtgtgcgtgttcgagtgaagcaagattggcctagagctagttaagcaagaaggtttccaagctcaagtacctggagaagtgcgcatgcctag

SEQ ID NO: 140966 - DNA, 406 bp, Homo sapiens
ctaacatattttgtgtaatttctcaacaccatccttttgtatttgatattttcctgcaaggagagtgaaaataaatgctgtttcatttagaatttttccattgcttagtacaaatatctgtatataaatgtaggaacggctgggcgcggtggctcacacctgtaatcccagcactttgggaggccgaggtgggtggatcgggaggtcaggagattgagaccacagtgaaaccccatctctactaaaaatacaaaaaattggccagatgcggtggcaggcgcctgtagtcccagctgctcgggaggctgaggcaggagaatggcgtgaacctgggaggtggagcttgcagtgagccgaggtggcgccactgccctccagcctgggcgacagagcgagactccgtctc

SEQ ID NO: 140967 - DNA, 210 bp, Homo sapiens
cactgctggtgtcttctcttcaatgcagggaagctggtggcaatgttaaccagtggcagtggcctgaagccatgtttcagttgtacattaattagaatggtctaactgctgaaacagacatcaacgctcagtggcttatagtgatttgtatctcactcatcacactatccagggtgatttggtggggggctaatgaagggcagtgggctt

SEQ ID NO: 140968 - DNA, 264 bp, Homo sapiens
agtagaaacagggtttcaccaggttggccaggctggcctcaaactcctgaccttaggtgatccaccctcctcggcctcccaaaatgctgggactacaggcgtgagccaccgtgctccggccacagcgttatttttaataatgtagctagaaggttgcatatcagctcagaggaggaggtgagactggttgaaggtagtcgtggaagtataggaatcctgtgattcttgtgtgcctatgtgtgaaactgttgaaaccaaacagcc

SEQ ID NO: 140969 - DNA, 267 bp, Homo sapiens
ttagagtggaggtgtgcaggggccggttttgaaggaagaggtaaccaaacccagctcacagtgactcccctgggtccatagacccaaccaggagccctttccccagcctccaaatgtagaattcaaactgacttttgaaattggtaaaactgccacattagttcctaggagtcggtggtaggaactaccaccatggggaagttcaagtggaggccccccactcccagacacacacatcaatgcaggaaatcaaaaataatatcacat

SEQ ID NO: 140970 - DNA, 444 bp, Homo sapiens
ctgggggctctccctccagcccatagtgtcggtggcagggtgagggtggccgacagccctgatgggactcctttccatctgggagcatgactacttccagccttgctgagtctgtgtaggaactggcagaagcttcctcttgcttagaggatggaagaagatcagggtgggtgttttgcgcccactgtgtcaggaggagagaagtgagcgggggtgtttcactaccttgcctgggctttaaatggggaggggcggggagaagctggcaatggaccctcacttgacgggcccttctgtgagctgggggctttggctttcatggcatggtcccccgcacttggtataaagcgcaaggctcctgtgggtcctaggactcagtgctgctaatcagatgttcttaattagaatctgattttgtgtaattttcagtaagaattttagaca

SEQ ID NO: 140971 - DNA, 146 bp, Homo sapiens
tgtttttttgcattttgtattccaagcccatgcatgcagaaagacaattaccactctacctcaagctcaggagtatgcaatcaagactcattattctcctgcttctcatttcattcacaccctttatgtctcagaacaataatgaa

SEQ ID NO: 140972 - DNA, 567 bp, Homo sapiens
ccaggttcaagctgttcttctgcttcagcctcccgagtaactgggattacacgcgggtgtcaccacgcctggctaattttttgtatttttagtagagacaaggtttcaccatgttggccaggctggtctccaactcctgacctcaagtgattccccctgcctccttcccaaagtgctggggttataggtgtgagtcaccgtgcctggccccaatgttgtcttttaaaattggttaattgaaatttagaattctttctcaaagtccgggcatggtggctcacacctgtaatcctagcacgttgggaggctgaggcaggtggattgcctgagctcaggagtttgagaccagcctgggcaatatgacgaaacctctctccactaaaaaatacaaaaaataaactgggcatggcagcatgtgcctgactcccagctattcaggaggctgaggcaggagaatggcttgaaccctgggaggcagaagttacagtgagccgagatcacgccattgaactccagcctgggtgacagagcgagactccgtctcaaaaaaaaaaaaaattctttctc

SEQ ID NO: 140973 - DNA, 271 bp, Homo sapiens
cctcctgagaggtgggacacgggtgtgcgccatcacgcccagctaatttttgtatttttagtagagacgggggttttaccatgttggtcaggctggtcttgaactccggacctcaggtgatccacccgccttggcctcccaaagtggtgggattttcaggcctggccaacagcaactatcttaataagaacattcattgactcaagtaattgcaagtccagaagtagacaggtttgggattatttgggtgcacccattctgaaccagtcat

SEQ ID NO: 140974 - DNA, 168 bp, Homo sapiens
tccctgcatattctgggaacattcttttagattttgatttgtagtgtaatgcttttatttcggggaaataagttccttgagtttcctttaaccaagagcagtacttaagcaatgatatttaatgactacataactgagactcctaaatcacatattgaaatctgactg

SEQ ID NO: 140975 - DNA, 639 bp, Homo sapiens
ctttctctcttttttaccactcccatgtccaggtatgctcgtgtatggagagacaacattctacttaggttaaatgatctccttttcaaaaatgtggagtgtatttccacaaatctcagacactgagtaggtaggatattagagttgcaagaatgtttggacagtagcaactttaaatattgcttttctgtttgtggttctttgagacatatccaaacaactaatggaaacaattttttttctaagttttaagtaagctctgttgctttggtgtcagcagcctctactgctgcctcttgccagctttccacttggtagaagatgcttcctaaagatgcactttgtgaagtctctgcagaaccagcatagaccaagccaaatcatgatgaaaattcttgttgtctgctccttctcccagtgcagtcctgtgtttccacttgttggaaatatatctgcctgtcaatgtctgagaacgccagcaccttttcgatgttacgaactcacagtgctcctcttccagaatgccagcattcataatttttaagcctcaaactttcaagaaatggaagcaattgaattacactgcatttaaaagtagaaatggtactattacatagctagaaatttctgtcaggtatg

SEQ ID NO: 140976 - DNA, 245 bp, Homo sapiens
cagaatggaaaaatcctccttttcccaccaagcaaagacacttgatcatgatgtgaaatatactgtatatgagacttggtaacttcattctgataataatcttgggaagaagccagtgaagaacactgcagtaataaagctattgcagggacacaaggttcctcactctgtagtagtattaaaagaattgtatattattatgtacgggcctgttcagctgattaactgcatataaaaatagaagt

SEQ ID NO: 140977 - DNA, 607 bp, Homo sapiens
cacaccacctgagtcttcatttgtatttatttatttgagtggtattttcatttcctttgagtaaaaggagaaaggaagaagagttgctgacgctgtcatgactgaaggggtaagattaggcattgtggcacctctcagccagggctgcttccttacaggaagtgctccagagctgcggagatgggagtgatttagcagctgcctcccccttgattgaccgcatcaggctttaaaaatatcaatggattcatcagcatcaaccctttgcagaactctcttgaagactatcgtaatggaaacatgtgagagcttttatgagtgcactccaagatatgatttatgggaaatagtcgcaacaagtgtttgcttgaagtctgttagagtcattcctctgaactctaggcactatcagaacatcaataaagcatgaattttgagtaaagaccaaggcagataaataagtattggcgttggtatttctggaaatttttctggaacatttatcaaggacaatttgctagaagaaatggatagtaacctgatgcttaaaagttgaagagggagggagggaggagggaaggaagagataatacatttgactaggttg

SEQ ID NO: 140978 - DNA, 337 bp, Homo sapiens
tgtgtgtactggaatgggaacagagagcaggactgttaagtcagatgtctacaaatcacagtccatggccatcactgacttgtttctgtctctaaacaaagcatgtaaaaactgtttgcctctgccatgaggcaaaagcatgcgcttggcatttttctgaggtcatgatgccctaggatgtggcagttcacgtgccactgaatattgtttaccaactagctattcaggacacggggtccctcctggaggagtgcttactgctggcgtcgggccagtgtgctgataacctagttctctaagagattgaaaactctgactgtgtggcccctgccaattt

SEQ ID NO: 140979 - DNA, 884 bp, Homo sapiens
agggtgggcactgcacaaagatactcagccaggcagtcaagtgaggctgaagtacagcttactctcacttgaccagccatgtgtctggtgcatgtggcttaatttatctggggaaaatggtgctttttccttatttgcacagaggcgctatatgggctagtggtgtctctaaccagtgtggaataaataaacaactccatggttctctgagactctgcaccaagctggacaggagtctaggtgttcagattagtttccctgttcacctagggctagtggagatttaacaggtgtttgtgcgtgacacagggacccccctgggcttctattctctggagtaccatcagtgtctgggggtggggatggggaagtgttagatagaaagctgaatgcatggacctcatcttgtagcagccagtggttgctgggacccagagtactgttgcccccaagaaaggaaacatggccctggagaagctctggagagggaatcaggccaacaggggagcctctgtggggcaggcttttggggaaaggctcataggaattacagacccaggctctcagagggccagaccctgggcatgctgaaaggagcctcttcgggagaatcacttgaacccgggagggggagtttgcagtgagccgagatcatgccactgcactccagcttgggtgacagagcgagactccatcaaaaaaaaacacggagaaaacgaaacgcagggacacagggacgcgcgcgaaagcgaagggcaggcaacggccccggcacggcgaggggccaagccgcgcgacagacaacacacaccacccccgcgggagaaagaacaccggcgcaacaccaccagagaccagcaagcaaacaaccccacaccgcgaac

SEQ ID NO: 140980 - DNA, 310 bp, Homo sapiens
ctgatactaccaaaaaaaaaaatttagatgacatattatctcgatctgcccatcaaatcctcacagttgttactctgcatcacttcaacctgaccaccaatttgaaaagcaattctggagttctgaaggtacatatctatctaacatgatcccttcataatctggccaaattgtaaatttttataacaatgttgctgcgattcagcttttgtttttgctgagtattatttactcttgtaaaccttagaaactgtaaacatgcatctttttttctggtttataaaaggaggacatatgtcttacaaaaaaa

SEQ ID NO: 140981 - DNA, 222 bp, Homo sapiens
gaggcctccatcgttttacatacagtgcatatactgtatgctcctttctcaatgtatcagggggacaattatccatcttctccccttgaatatatgagtaggctgcagaggatttagtttgcttgtgctgcttctcagcttatcttcttctgatggttaatcattttaaacaattagttttagttctcttagctacctctagtcattgcaagacggctctca

SEQ ID NO: 140982 - DNA, 429 bp, Homo sapiens
tgttctagatttggaattagaaggcctggattcaagtgatgactagctctgtgaccttgtccactcaggtaaatgcaacatttagaattttggaggactgcagaaactgtttcatctttatcttcctcaacaatgctgtaaaactcattaataagatttccaatgctacttaagatactgaactttttaacctaagtatgcctggaaaaatatatctggaatgctacagctggctaataaaatacatgtcagcactgtgtagcagcaggctgatgggatgtccatggtgggtgattaatatagtatatcatcagtgttactactatcttacatgatgctagtactctatagtttccaaggtgatttcgtatctaatacctcattgaatttttccagcaccatgaaacaagtgggagtagatagcaatat

SEQ ID NO: 140983 - DNA, 433 bp, Homo sapiens
tcacatcttcatgggttcaggctcaggtctctgtggtcgcacagtgtgtctttttaccaaaaggaacacctcatgcacttttccaaaaggagaaaagtaaaggtttgaatggatttttagttctcggcatttttgaacagaaataatcaggtattaagttgctcaaagatgcccacaagctttcataggagaaacatctaattcataaccaagagtttatgttattaagtaagctttcctttaacaggatcaatgaatgaagagtttaaatactcgctctaatccccattcagtcatctggtatactctctgtgagatatactctcagtcatctggtatactctctgcgtatgccagatgattaaatggaaattattgcaccactaaacaccagtactgcaaactcttatttaaaaaatcaacacctaggaca

SEQ ID NO: 140984 - DNA, 348 bp, Homo sapiens
gtaataatttgagccgaggggtgggtcgttgttacttgtaaaacagggtctctagaagacagcagatggactgatcttgttcttttatccaacttgcaactctgtgccttttcaatggagcatttagactgtttacattcaaggttataattaatatgtgaggctttggtgctatcgtgaagttgttagctggttgctttgtagtttctatagtgtcattggtttatagtatctgtggctatatattcaagggtatgtcagttgttagaaggtgatcctttttgtctcttcactggggctttttgagtgacatgctggctcaagggaaagatccacagcaagggaaga

SEQ ID NO: 140985 - DNA, 364 bp, Homo sapiens
tttttgatacagagtctcactctgtcgacaggttggagtgcagtggtgtgatctcggctcactgcaaccaggctcgagcggttcttcttcctcggctcctgagtagctgggattgcaggcgtgcgcaccatgcctggctaagttttgtgttttgtgtagagacggggttcaccattttggccgggctggtctcaaactcctaggctcaggtgatccttctgcctgagcctcccaaggtgctgggattatagatgtgagtcaccacacccggcattaagctttgaactttggccagtggtatccaagagaaatacaatgtgtgctgcaaatgcaagccacatacataattttacattttcgaatt

SEQ ID NO: 140986 - DNA, 117 bp, Homo sapiens
acaggttatctttaccagctgcagcctccggagacccagtcaagggcaaaacgtattccaagtatgagctggagctctggggaacagggggatccactctcccgttccctgtcctgg

SEQ ID NO: 140987 - DNA, 411 bp, Homo sapiens
gacatggtttgtcacttgacctgaaaaatagcccgtgttggctatgttctgggaaataaatatgctcataaatgaccaacggaaagtaaaccggcacagctcttctggagggcaattagtcacttgtatcaaaaacttactggcttacactttgaatgtgcaattccacttctagaaattaaagaatgtgtgcccagacttaccaataaaatgttcattacaatgttgcataaaaatcacaaaatgattggaaatggcaaagacgtacaacaacaaggcagagatcaaatcagttctagtgtatgcatatactggaatgctacgtcgttattcaaatgatactgcagaggtaggattatgagttggaaaagtgttcatgacatattattgtattcattttctattgctgcg

SEQ ID NO: 140988 - DNA, 205 bp, Homo sapiens
ctctggtgcatttcggtaaagtactgattttcatttcataaaataaattttgctttaattaattctacacatcagccgaagcacttaaatttgcagttttacccaaacccagacagttggtttcagttgaagccttagtgtggaaggactggattgtggcaggagaaattgagttttgtcacagagactaaataactgtgtatgg

SEQ ID NO: 140989 - DNA, 778 bp, Homo sapiens
cttgcttagaacgctcttaggaatgtagcaacaaagtccatctccttgaagtgaatggggaaattgtttcctttggtgtgttatagcttgtctattcagaattcacttggcacagtatatcagagaagaatgactgtcttcatccttccttgggggacaaagttggcagacaaggctggtatggacgggcaataattaaattgccacggatagtgtctaatgtaactgagactaagaacttgtgcacatgtaccccaaacaaagcactgtgtcacacagaggatccccggagcctttgaaccctttctttaccatattatgagaagcaatatcttaacattagaaaacactttgaatagctaaaagtggacaaatgcgttgcaagaaagaaaacaagagtctctttctgcttagcagttttgaaaagcaaaaactgacaggcttaatttctcacttctttttccaattttgaagaaaatgaaatggaaacattttatataagattgaaggaaaaaagcagggtttttacctttgcttattaaaaatagtatcttaaaagccctcatttttatgttttgctaaggactgggggatgaggaagaggcaattcagaaaatgctaaaagcagtaaatgtaggtagtttcaaaattttaaacaggctttgccttctgtgtttttttaagatcagtggtgttaacagagcatattgcaatcacagataaatgggttgttcatctctttcctttgtgttgccacagaactttgaacttgtgttag

SEQ ID NO: 140990 - DNA, 325 bp, Homo sapiens
agtcagttgtgtctaaactccaaagcggtaagggtataatgaggtgtgtctgcccccatcccccacattatggcctgaactagttatgtaggtttctttagggtccccttggccaagaggcagttcacattccaagctgcagggcttagaatgctatttttggtttacaattctaatgtcaaaacacataagtttatcaaacacccaaaacaaccctaatatcagggccaagcaaaatgtgttcactggctagagagcagagtggtaaaatgtgttttggaagatggtttgacaacttgtatcaaaaatattaaacaaaacaaaa

SEQ ID NO: 140991 - DNA, 394 bp, Homo sapiens
accggggttcattcccttaacgagtcacaaaggactccaccaagaggcggattttgatcaatgggagttttacttggcacaagaaaggaagacactgggcgtattctcccaagtagtgtgtcccccagagaaagagacaggagggttttataaggtgatggagaaaggagagggtgcatgactgcatgtagagtaggggtcccagtgagtcatgatgctagcacataggctgcataggttgcataggttatagtcgtgaagctatagcttctcccggggtgaagactttagcatggtaatgaggagagttaacttgggttcatctacaagtaacctggggtcacttaggagctgatttaaacaaacagggtgacctcattccgcccagggttgg

SEQ ID NO: 140992 - DNA, 291 bp, Homo sapiens
tttccattgcaggctggactgagcggtttaccacattgaccctggagacacagaggccccaaataaggaaagccaactgtgactaaacttcctgacccagcagaaacaaagcacattcctgacattgactggcagatgtgagcccagcagaagtgcagacctctgggtcctttcctggggagcctgtctgaagcaggacaggcaacatgaataagtttcgagaaagccatcctcagtgaaacatttaagataggtctggggttagcctgggctgaaaaaaaactatatata

SEQ ID NO: 140993 - DNA, 182 bp, Homo sapiens
ttgctttggagtttggatattcagggatttaaatcctggctttcttgttgaattacatatgagaacgtgggaaaattatttaatctctcaaatgtgaatgtttttgtaaaatggggaaataattcctatcttgtaaggttttatcatttgtaactttagagctaatatggataaaatatctc

SEQ ID NO: 140994 - DNA, 705 bp, Homo sapiens
ggggccagaagtctgagatcatcttatggggcaaaatcaaggctgtggtccttctggtgtctctgcggggagaatccgcttccttgtctcttctggctgctggaagctgctcacggtccttggcccaaggctcccaggcagctgtcttgtcactcagcctccctctcccctccctcgctcctgctgcctagtgtgggcccttgtgatgacagtgggcccacctgggtgatccagcatcctctctgccgcttaacttaatcttatcacatctacagaatccctttgccatgggagaccatatttacaggctctgcggactcgtatgtggctttgtgggggccattgttctgtctgccacagccacagccacagccacctaggggtgtgctggctcccgggccataagctgggcatccctgggtgggtgggcccaggaagggctgccactcctgtctgccaggtggggtgctcctttgtgccttgcgttctgcccactggcttgcacccctggcttgcccaggcacctgaccaagtccaggctaggcagacatgagattaaggtagcacagatttttgcgcccaagtcaggcatattgcactccagtgcccagaaggcagcagtcgggggcttggccctggggctgcaggaactcttcagccctggctgtgtggggtcaaccctaaggtgtctctgggacaggcagg

SEQ ID NO: 140995 - DNA, 309 bp, Homo sapiens
gtgaaccgcaatgcttgggtagacaaaaagttctaaagatgagggaaagttatgtaattcagacttgaaccaatggtgtgtgtgtggcctagtggttttcgttaatttttttttttttttttttggggcggttttcaactttgaaacccaggcgggggggcaggagcaaagcctgggttttttgaaattccaatccctggggttaaggcatttttcctccctaagttttttggggggctaaaatggcggtttttgggcccccgggcccaaattcgaaaccagggccatggctttttcctggggaaaatt

SEQ ID NO: 140996 - DNA, 504 bp, Homo sapiens
cgtgaacgtgttaaccgtggcgactccgaaacttgatgtaacaccgcatcgcgaaaatatagtgatagacgtgtcagcgaatgactagatactctgcttcatttggaaatgatggttaaaacaactagttaccactacatacctgttactttgacgcacgcgtcaaagtacctggacaagactggcgatggagaagttagttttgaagaattccaagtattagtaaaaaagatatcccagtgcaggagaaaacaaaatagaaccctgagcactggaggaagagcgcctgtgctgtgctcttatcattgagtaatcctactccaggaagttgcaccttatttattttttggctgctcttacccgtaatgttttgtcatccatcctagttggataaacacatgtgtagcaaagttaattcttcaggtactaccttattatttttgtgggctatttttctagactgattcaactgaagaactataatctgtaaacagaatagcccag

SEQ ID NO: 140997 - DNA, 397 bp, Homo sapiens
tgcctccaagctgttgcacaagctgtcccttggaacactcaccccacatcctgcttctccttaacccgcttccgcagtcctcagcctgggtggcaccctctcctgcaggtccctgtagtaccctgcactttccctatgttagtatttatcaagttactgtaattctctgtttacctatccatgttcctagtatggatcatcatcaggtggtggcatcatctttttatctccagtgattaacgcagttacctaacacatatgaggctctcaataaacatctctgctgaacaaatgtagtgtttataagtcatatcaagcttttagagatgaaaagccccaagagtaaaatagttcattaaccttttcctttggctagattcccttcagtcagttacca

SEQ ID NO: 140998 - DNA, 166 bp, Homo sapiens
ggatgtagggaaagaagaagggtcatgagaaaagaaggagaggaatggtggacagagggaggaggaatgctgagagacatggagctgtgttcatttgtaagaatgaagatgaagtctttatttttgtgagttcttagtaagctcccaccccagttctcccccaaca

SEQ ID NO: 140999 - DNA, 348 bp, Homo sapiens
ttgggaaaaataacacctaaaatcttaaaataaaaaaatctaaattaagaaaacatttgaagattcactgacaccaagtgccaaactcaaacccaagatcccagttagagactttaatattagactctcttattgcagttagttttcccatatgataaatacaacactgtctgtttattgataaaggcctagcaagatattctatccctgaccaagagggtgtggtcttgctgactctagtgatcaagctgagaaccagaagagtatttctcacctgacaaaggaaccaaatatatgcacacaccggagcttaaccttagacccgagcatgggatcgccttctcctat

SEQ ID NO: 141000 - DNA, 326 bp, Homo sapiens
atgtatatttttactctcctcttattccctccaaccttcacccaagtctgtttcctggcaatttgagaagtgagaaatgcctgcgtgggggaaaaagtggaggcacatgttgtgttgtaattttaacggggaaacattgcccaatgacaaaaccagggaccgtcttgtgatgttgctttctgcccacgctaccttttcctcttctgagcccgctctcgtcccaccgaaggctgcaaggctgcctcgcatccagaggctgtgacctgctttaaatcaacaaagcatgatgatcttagtttgaagagttgggaggacaaccatatgga

SEQ ID NO: 141001 - DNA, 813 bp, Homo sapiens
tgctactgaagacagggaaggataaaaccttgcatgtcttgcacttacattaatattcccagctgtacctcgaaaaaaaaagcaggttatagaacacctgtggagacaaaatgacccatcttggatgctagtccaccatgttacttctgatttgcccctgttcaatgaatgccttctgatctctcatttatttactgtccttagtgtaaaatcatgtcaacctgggtgttaccacaaaaattacaggctatgagacaggtagtcctcctggattttctgccttcttctttaatttttcagatcctttggcatttgagagttgctttgtgtatacggccctttaatggagcaaatggccagccaggaaaccaaagtatggacaaggggaaagaagcatctgtggaggaagttttacaagcgaccctcctcatccatgtgggtggtgttgcccatatgctacatgtctgtggaccactatgtgtgtttaaagctttttagtaaaacgttactaaaaactatgactcactgtggtgaaaaaggtgggaaaacagtgacaacagtgagtttgctgctgttattatctatgtgagtggtcacaaaagcacaggtagcagctgaggcaagggtagggaagctaggaaaagaatcgcagtgagaaagggatgagaacttccatgtctgtgttaatgtctggttttatgataaacttgaaactcaagaggcacagttggaaattgtaccttgccactttgtgtggctgagagagagaaaaatgtgctagctgaatgtgtggactgtctttgccagtggagg

SEQ ID NO: 141002 - DNA, 672 bp, Homo sapiens
taaaaagctctaaaacaatggacaagactagaatctaacaacagggtctcaagccacccaggctggagtgcagtggcacaattatggctcactgtagcctcaccttcctgggatcaagcaatcctctttctgcagcctccagaggagctgggactgcatatcctttggcatttgagagttgctttgtgtatacggccctttaatggagcaaatggccagccaggaaaccaaagtatggacaaggggaaagaagcatctgtggaggaagttttacaagcgaccctcctcatccatgtgggtggtgttgcccatatgctacatgtctgtggaccactatgtgtgtttaaagctttttagtaaaacgttactaaaaactatgactcactgtggtgaaaaaggtgggaaaacagtgacaacagtgagtttgctgctgttattatctatgtgagtggtcacaaaagcacaggtagcagctgaggcaagggtagggaagctaggaaaagaatcgcagtgagaaagggatgagaacttccatgtctgtgttaatgtctggttttatgataaacttgaaactcaagaggcacagttggaaattgtaccttgccactttgtgtggctgagagagagaaaaatgtgctagctgaatgtgtggactgtctttgccagtggagg

SEQ ID NO: 141003 - DNA, 663 bp, Homo sapiens
aatgcatttaaatgttctattgagtgactgtggttctcagtataagcttccacctacagagaaagttattcaaggatgctggtctccccttagaaatcagtttcttaaagtattgctgaaaggttggtcttctggagcctcccagtgtggatcctttggcatttgagagttgctttgtgtatacggccctttaatggagcaaatggccagccaggaaaccaaagtatggacaaggggaaagaagcatctgtggaggaagttttacaagcgaccctcctcatccatgtgggtggtgttgcccatatgctacatgtctgtggaccactatgtgtgtttaaagctttttagtaaaacgttactaaaaactatgactcactgtggtgaaaaaggtgggaaaacagtgacaacagtgagtttgctgctgttattatctatgtgagtggtcacaaaagcacaggtagcagctgaggcaagggtagggaagctaggaaaagaatcgcagtgagaaagggatgagaacttccatgtctgtgttaatgtctggttttatgataaacttgaaactcaagaggcacagttggaaattgtaccttgccactttgtgtggctgagagagagaaaaatgtgctagctgaatgtgtggactgtctttgccagtggagg

SEQ ID NO: 141004 - DNA, 808 bp, Homo sapiens
ttgacttgatgggccagctcatggctggaaatgcctgttaaccctgaagtgacagaaaataccatgcgcagtcaagagctcatgataattagagatagaggctcctgatcctggggtctggagatggtgtagctcctgacccctcaggctgcttagacctccacaggacagaggacagggagttcttggatgatgaaatcttgcccggttttatgggaggcacctaagtggtgtaaaatgggctggtttgaatttcagctcctttatgttcccctgcccacctcctggtactgccactaatgatcagtaaaatggctaaaaaggaggaggagaaagagcaccagcagcagtgaggctgcacgtggtctgctcagggccagacggcctgacaagcaccctcactgaacaccggcccagccctggggttccaacaggggtgttggtgtcctgccccaggtgacttggtaagcaggccctggagtacagtcacatccaggactttgtgttgtgtccctgtgggtgggagtggggtcatcagatttcatttttcccagtgggaaacacctgcaaggatggttattcacttgactcagtgtccccccaacacaaaaaaataacattgtcttttaagatcctctgcaggcccaatccaccaggagaaaaaaaggggtttgtctctcagcctcgctgatttgaattgggaacttatttctaagcactatgaccaagttagctgaatgaaaaaaaacaggtgatttcttagtcttgttaccaatgtcaggcaggaacttgggtctcaatatttttt

SEQ ID NO: 141005 - DNA, 400 bp, Homo sapiens
atgggcagatgagcaagggagtgatagatataaagccagcaatctaagaacaatgcttacaagaagtagacaaactgtgtctgaagcaaaatcacaaaacatttctaagaacaggaaagaacccttgggaaaatggagaggaaatccatgacataggagagtacaagtaaatactgccaaggtgctccttctctccatcaatttatggacttcacatacaatcaaccccataaagggcctctgggtctgtgttttccttttcctttgcttccctttttctttcttggaacttagctacagtttttaaacttttggaagcataaacaaagcaaggatgcttttgaaaaatgaaaaagaagaattactctggaggatacatttacagtcttttttttttttt

SEQ ID NO: 141006 - DNA, 378 bp, Homo sapiens
tcactatgtgcttgggcaggtcccgtcaactccctgagctgtacttaaagcagggattgtcacgtatccccttcatgtgctgcagcccggagaacatccgggtggtaatgaggccagcttctgcaggctgcaggctctgggcttggaacttttgcacttgctgtcatcttgttgtcacaagcctgcaaagtagggactctcctcattttaggaaaccagttccacgaggctggtgggaggcctgagccagggtttgaatgcaggctgctgtgattcagggacctgagtcctgccctaacccctgtggccttgtaggtagtggcctcccattgactcccacttttaaacattggggcatatttaaacattggggtcatt

SEQ ID NO: 141007 - DNA, 486 bp, Homo sapiens
  misc_feature (351)..(351): n is a, c, g, or t
  misc_feature (420)..(420): n is a, c, g, or t
  misc_feature (459)..(459): n is a, c, g, or t
  misc_feature (479)..(479): n is a, c, g, or t
tgtagtcccagctactcaggacgctgaggcaagagaatcacttcaacccaggaggcagaggttgcagtgaaccaagatcgcaccactgcaccccagcctgggcaacagagcaagatggtgcctcaaaaacaaaagaggggacagggagtaccaagtcaaaggctatgccagcttatgaaggaaaactgttgcagaaacagaaaaccaaacaccgcatggtctcacttataggtgggagctgaacaatgagaacacatggacacagggaggggaacaacacacactggggcctattgagggtggggaggggggagagtgagagcatcagcaaaaatagctaatgcatgctgngtttaatacttaggtaacgagatgatttgtacagcaaaccaccatgacacacattcacctatgtagcanacctgcacatcccgcacatgtaccttggaacttaaaatnttaaaaaaaagaaagcatangaaaaaa

SEQ ID NO: 141008 - DNA, 571 bp, Homo sapiens
aggcgcccaccaccacgcccagctaattttttgtaattttagtagagacggggtttcactgtgttagccaggatggtctcgatctcctgacctcgtgatccacccgccttggcctcccaaagtgctgggattacaggcgtgagccaccacgcccagcctatggtatgggcctcttcatggtgtgggctgccatgggaagggcatgacctgtagcaaggcagcccctgaaggaattgatgttctgctgaccacattccctgctgctgctggcagcaagtccttccttgaagaggagatctaggtggcatgtctccctgtccacacactttcctaagaataagaaaatatttcctggaaatcatccatcagatgtgccctcacatctaagtattagattacattctgtgtcagagattcatggttacacatcatagcctttttctacttctctagtaaaaagaattctgattttttgatgggtacatgatcatctgggataacggctgcatttttcagccttcctctacttgtagacatgtcagtaacttctggctaatcgaatgtaagttga

SEQ ID NO: 141009 - DNA, 339 bp, Homo sapiens
gctggtctactgttggaggtaaaagacgctcggcaacttcactcttccagtcacctaagccaaaactcttggccttgctttgatctctttctttctctcacatgccacatctgcccaccttcacatcacctctacacttctaccttcagcctggctaccaccatcttttacctggtccactgcagtagcctcctaccagtctacctgcttctatctcggcccctcccctccagtaccccgtagtaccctcaccactttagccagtggctccttttgtcatcccaatggctcacaaggcccagtaggaactgcttcctctccctccatttctctgacctc

SEQ ID NO: 141010 - DNA, 332 bp, Homo sapiens
gaagaatagaatgtgactcccttgtttctaggttagaggagtaagctggtggtgccgtttcctaaagtagcaaaggagcatgtattttacaaatggcagtatgttcttcaaagggtgttgtctagcaagtgaacctgggagagagttgaactggggatggttagatatcagagtcatctgtctgcaggtgatatagtcccaggtaagtatggtaacatgaagtgaaaggggcaggtgaatgagaatatagagattaagtttatatatggaggagattcatctatgaacaagaacgccatttcactaatttttaaggtgaagatactgtgttg

SEQ ID NO: 141011 - DNA, 550 bp, Homo sapiens
caagacagacactctgggcaagacagacactctggggctctcagaggctgggaagcgggagggtggccaggctagtcaaggttaatgatcctttacatcttaacaaaattatccactaccctgactattcctggactacagccacatctcagtgccgcccttctccccaacctaaagcctccttcacgtcttcctcttgtatcccccaaccttaacccacaagtatgggacacttttactccctccctggcaaccaatcacacgcccgttactatcccattaaaacctaatcatccttaccccgacgtgctgcagaggacacagcagagacataatagcgggccatgtgccatcactgggaacacagattgtcctcaggccttgatgactcagagagtcagggctgggttggggacgcgtaaaggcttgggagcccacagtggttgcctcacccagcctggaaggccagcgatgtcttctaggagaagaagacatttgagctactatttcaagaatgaatgagaactgtgcctgtttcgacaaagctgaa

SEQ ID NO: 141012 - DNA, 115 bp, Homo sapiens
tgaactctaaacttgagttccctcttctttattacaaggggcttaaactagtggctgctaaaactttttccagagctgagtacagtggctgtgcctataatcccagctgaggctg

SEQ ID NO: 141013 - DNA, 176 bp, Homo sapiens
cctaaaagtcactgaatcaaatgtctttcagactaaaataagatgcctgtgtcatgtaatttagtgaattaattgaaaacagaaggataagcaaggggagaggaatggtgtaggttaacctacacctaggctagggtcaagcagaatggaaggactgcagtatttgagttcataca

SEQ ID NO: 141014 - DNA, 504 bp, Homo sapiens
tcaagaagcaagggggccggtggggtctgtttgtggcccccggagaccctgccccccaccctcctgggagcccaggttggcagctgtgcccagaaggctttcggggacagaaagtttggagacaagttcaggcctgactgagtccttgtcccctagagttggggtcagctctgtacctgctgagccgaagtgctgatggctgccgtccacaggccccggccaaagcctggctcaggagggagctaagagatgagactcccgtgtgcagagacaggtggccccggggaaggaagaggccactcggaggctccgagaacggaggcagcgcgggggcttcctggggcccgtgcatcggaggaacaaggccaagcggagggaagcagcaggaaccaggacccctgcagatggtggaggcaagaggctttatctgagcctttgggaccctggccacctgcccagctccatctgcatgggagaacctaggggaggggctggttctggtac

SEQ ID NO: 141015 - DNA, 298 bp, Homo sapiens
caactagtgctcagctttgccagttatgatgatgtgagactatgggcctaagactctctgatttttagagaagccagaaatctagatttttatatgtgcaatctgattttaaatatgggcaagtcactcacaaattttttaggtgccaaacacttgtagggtaaacttagcctttgagttgtcactttacagtctctggcttacaccagtaggacaggcagtccatttagtttctaggtagtcaagaagctagatctatctacaacaatccagaccaccagctctgagggctgagacg

SEQ ID NO: 141016 - DNA, 281 bp, Homo sapiens
catacttgcagcgccaggctcacctcgacctcctagagttaggcctcctcctcaggccaggccttagaggtcatgatacaggctgaggaaagagaggtccaggccagcatccatggaatctgtcccattagctcagagaaaacaaaaaggggacagatccagagggtggggggactggcaatgcaggacacaggaaaagctagactgaaagatcccgggcaccgggagatcaaagggccaaagcaagcagcagccagccctcagaccaaagactccccagc

SEQ ID NO: 141017 - DNA, 275 bp, Homo sapiens
gtctaggctgccggcccatgccctctggagcttgccaagcccagctgtgcatctgccgcgggccctgcctgaccttgcgcctgtggggctgatggaactcagctcgtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtc

SEQ ID NO: 141018 - DNA, 441 bp, Homo sapiens
gcctgatggcacagagaagggtgggcactgcaggcggagggaagcgcgtggccccaggtgtggagcaaagccagtcgtgggtttggcacttggtctgggggccagggctgctggaggtggccaggagagcctgctgaccactgtccaggcggagacctttcagcagcagggacctgctgggaagcacgaggaggtgaggggagtggctccagggctcaaaactgagaagaggctgggcgcggtggctcatgcctgtgatctcagcactttgggaggccgaggcaggcgggtcatgaggtcaggagattgagaccatcctggctaacagggtgaaaccccatctctactaaaaatacaaaaaaaattagccgggcatggtggtgggcacctgtaatcccagctactccggaggctgaggcaggaaaatggcgtgaacctggg

SEQ ID NO: 141019 - DNA, 359 bp, Homo sapiens
ggaaggactgagggggtgaggggcacggtaacacctggcatttggctgcagtgccagatggatcccagagtgggccacaggcccaggctggacaggaaggggagtcatgaaatgtggccttcttggggacagcgtggccaagcagatgtcagcacagagcccacagcgccctctcttaggcctggataaggcactgtgggtgccaggttgcaggccctgcacagcagccccaaagcctggagccatcctgagtccttcctttcctcctcccaactcccacccttcaaatcttaccccagatagaagcccttccccacatccacttcctctaccttcctcatcctaagggcccgtcctcc

SEQ ID NO: 141020 - DNA, 564 bp, Homo sapiens
gtaactttcatttcagaaacggccacctgtggtaaaaagttatgccagtttatgtgagcagatgaaaatgatacacctcatcaatttttaaaattagggtactgacaatatagtcctccatgctgtccttttattgttgaaaacaaaggaaaactgagtatcagtggatcagtaagaaatgagtgttcccttttgtaagtggaatctgaccagctttgtctggaatttgactggttgtatggaaaaggttcctaaataggctggacacgcctgtaatcctagcactttgggaggcctaggtgggtggatctcttgagcccaggagtttaagaccagcctgagcaacaaggtgaaatcccatctctacaaaaaaataccaaaaaaaaaaaagaaacaagaaaagttgctaaataaaaactatgtttatcaagtaaatgaccatctttttcactgctaaagttttaatcatttttttccaattactatgacgaaggcttgccaatttacttgggtactatacatgtaaaataatggctaacatttattgatcacttgctacatgtc

SEQ ID NO: 141021 - DNA, 546 bp, Homo sapiens
aagataaactttttctttttaaaaaagaggtatgggtataaaggactccatttactattataaagaaggaatggaatatcaacattcagagatagctttctggcagctgccaggcacctctggtgcctgacagctggcaaactcaatacaggattctttctgagatttgacattttgctttcctttagtgcttatacttcctactgggaaaacagaccatggagtagaaatatgatctctgaaattaagaggaaaattttgttagctaatattcttaattcaatggtaattatttaatagtacagtattagaaataaaggcaagtttataaccattagaattaaaaacatgattgtacatttttgttgctaatgtaaatatttgattttcttcatagctaatttatacttgaactaataggtaaagcattcatatgtgaacttccatgaaatctcaattaactagactcctgccatttccaagtttaaattttatttataatctgccccctttcgttttacagcacatgaaatgttagaaactctg

SEQ ID NO: 141022 - DNA, 2516 bp, Homo sapiens
  misc_feature (1636)..(1636): n is a, c, g, or t
  misc_feature (1654)..(1654): n is a, c, g, or t
  misc_feature (1667)..(1667): n is a, c, g, or t
  misc_feature (1673)..(1673): n is a, c, g, or t
  misc_feature (1675)..(1675): n is a, c, g, or t
accatgccgactgtcagcgtgaagcgtgatctgctcttccaagccctgggccgcacctacactgacgaagaatttgatgaactatgttttgaatttggtctggagcttgatgaaattgtatgtattggatatttgtctatttttcaaagattgtgtgcataagcttatttttcagggttatactgtatttcatctttgttaccttatagttagactaaggtgataatgtttgtgggccatgatttctgtgttcagagggctaagctccatgtctgtctgttgccttgactaaaatctcaaaaggagttcatgccttattccatctacaatcaccttgttaccaggctcatgcctataataccagcactttgggaggctgaggtggatggattacctgaagttgggagtttgagactagcctgaccaacatggagaaaccttctctctactaaaaatacaaaattaattggatgtggtgagtagctgggattacaggaaggattccctatcttggacctgaggctgctttcttgaagaaaacttgactttatttcatttagtgggaagagcagcagcccagctattaagttctaatatgcaataggctgcaggctgtgaagttctgaagctaaggagctgagggcttaacaagtttctagaagctgccatcaacatgccaagtcagtaaaactgatagttgatcagatttcaaggtctggggaggatatccactgtgtactgggtcttgagctctagagagctaggccttgctaaaataaaagaattaccttacctaccatctttgttcaagtctcaatggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaaggtaaaacatagggcagaagaagtcaagtctgaatttgagcaacttaggttatttctccaaaatgagcaagagactgttcttaggcaattacaagatgaagagatggatattttagcacaactaaatgaaagcctaacaaaattttcagattatacctcctcattaaaatatctactaaaggagatagagagcatatatgtgaagtcagaactggaattactggcaaatgttaaggatatctatcacagatataagaatttaaaattccctgagctgtttttattcaaattaaaanaatatggttaccatctgnctccacaatattntggccnanacaaaattatcaagcgatttcaagtagatgtaattctagatcctgaaacagcacatcgtaaacttatagtctcagaagatagaaaaactgtgcgctatggaaatacaacacaaaatgtacctcataacccaagaagattttatctcctcccagctgttctgggttctaagggatatagttgtggcaggcagtactgggaagtagaagtgaaagacaagcctgaatggattcttggtgtctgtaatgactgtcttcccagaaggaggaagagtcaaccaattttagtacaggatggattatggggaatttggcgatctagtcagaataattatattgtattgggccacaaggaaattattctgctgccacaagtaattcctagtaagattggcatttttttagactatgaaatgaatgaagtttccttttataatttgaatgatagatctcttctctatacttttaatgataattttacaggagcactttggccttatttttatactggaactgactcaaaacctcttaaaatttctacagtaacagattctgaattttctttcacctagtagacataactgagccagtgaatctagttttggctattctgtattttgtccagtttttcccataagaaagcaatatttttttatctcagtttcagcaacttccaaaaaatgtgattatgggacctactttatattaaattatggggtcagtgacaaggtactttagaaattctacagtaaaatacttgaaacatatattactgaagaaatgtattatgtaagaaaatctattacttttgtaattgccaataaaagcccagtaatttttttct

SEQ ID NO: 141023 - DNA, 2279 bp, Homo sapiens
  misc_feature (1314)..(1314): n is a, c, g, or t
  misc_feature (1332)..(1332): n is a, c, g, or t
  misc_feature (1345)..(1345): n is a, c, g, or t
  misc_feature (1351)..(1351): n is a, c, g, or t
  misc_feature (1353)..(1353): n is a, c, g, or t
aataagtaatgtatggcgtgaatctctgcaatatgagaatcttgtttttccaagaacttccaccccatgattttagcattcattgatgattcttgtgtgaacgtttaatacatttgtgattatggaattttaacgtggtgtcttttcttactcataggaaggattccctatcttggacctgaggctgctttcttgaagaaaacttgactttatttcatttagtgggaagagcagcagcccagctattaagttctaatatgcaataggctgcaggctgtgaagtgttcgtggcagtagactctgaagctaaggagctgagggcttaacaagtttctagaagctgccatcaacatgccaagtcagtaaaactgatagttgatcagatttcaaggtctggggaggatatccactgtgtactgggtcttgagctctagagagctaggccttgctaaaataaaagaattaccttacctaccatctttgttcaagtctcaatggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaaggtaaaacatagggcagaagaagtcaagtctgaatttgagcaacttaggttatttctccaaaatgagcaagagactgttcttaggcaattacaagatgaagagatggatattttagcacaactaaatgaaagcctaacaaaattttcagattatacctcctcattaaaatatctactaaaggagatagagagcatatatgtgaagtcagaactggaattactggcaaatgttaaggatatctatcacagatataagaatttaaaattccctgagctgtttttattcaaattaaaanaatatggttaccatctgnctccacaatattntggccnanacaaaattatcaagcgatttcaagtagatgtaattctagatcctgaaacagcacatcgtaaacttatagtctcagaagatagaaaaactgtgcgctatggaaatacaacacaaaatgtacctcataacccaagaagattttatctcctcccagctgttctgggttctaagggatatagttgtggcaggcagtactgggaagtagaagtgaaagacaagcctgaatggattcttggtgtctgtaatgactgtcttcccagaaggaggaagagtcaaccaattttagtacaggatggattatggggaatttggcgatctagtcagaataattatattgtattgggccacaaggaaattattctgctgccacaagtaattcctagtaagattggcatttttttagactatgaaatgaatgaagtttccttttataatttgaatgatagatctcttctctatacttttaatgataattttacaggagcactttggccttatttttatactggaactgactcaaaacctcttaaaatttctacagtaacagattctgaatgaattattagaagactcagtttctttcacctagtagacataactgagccagtgaatctagttttggctattctgtattttgtccagtttttcccataagaaagcaatatttttttatctcagtttcagcaacttccaaaaaatgtgattatgggacctactttatattaaattatggggtcagtgacaaggtactttagaaattctacagtaaaatacttgaaacatatattactgaagaaatgtattatgtaagaaaatctattacttttgtaattgccaataaaagcccagtaatttttttctgtatttcttatatacttttcctttaagaaagattaagtctttattaaaggcattcatcattactaa

SEQ ID NO: 141024 - DNA, 2213 bp, Homo sapiens
  misc_feature (1314)..(1314): n is a, c, g, or t
  misc_feature (1332)..(1332): n is a, c, g, or t
  misc_feature (1345)..(1345): n is a, c, g, or t
  misc_feature (1351)..(1351): n is a, c, g, or t
  misc_feature (1353)..(1353): n is a, c, g, or t
aataagtaatgtatggcgtgaatctctgcaatatgagaatcttgtttttccaagaacttccaccccatgattttagcattcattgatgattcttgtgtgaacgtttaatacatttgtgattatggaattttaacgtggtgtcttttcttactcataggaaggattccctatcttggacctgaggctgctttcttgaagaaaacttgactttatttcatttagtgggaagagcagcagcccagctattaagttctaatatgcaataggctgcaggctgtgaagtgttcgtggcagtagactctgaagctaaggagctgagggcttaacaagtttctagaagctgccatcaacatgccaagtcagtaaaactgatagttgatcagatttcaaggtctggggaggatatccactgtgtactgggtcttgagctctagagagctaggccttgctaaaataaaagaattaccttacctaccatctttgttcaagtctcaatggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaaggtaaaacatagggcagaagaagtcaagtctgaatttgagcaacttaggttatttctccaaaatgagcaagagactgttcttaggcaattacaagatgaagagatggatattttagcacaactaaatgaaagcctaacaaaattttcagattatacctcctcattaaaatatctactaaaggagatagagagcatatatgtgaagtcagaactggaattactggcaaatgttaaggatatctatcacagatataagaatttaaaattccctgagctgtttttattcaaattaaaanaatatggttaccatctgnctccacaatattntggccnanacaaaattatcaagcgatttcaagtagatgtaattctagatcctgaaacagcacatcgtaaacttatagtctcagaagatagaaaaactgtgcgctatggaaatacaacacaaaatgtacctcataacccaagaagattttatctcctcccagctgttctgggttctaagggatatagttgtggcaggcagtactgggaagtagaagtgaaagacaagcctgaatggattcttggtgtctgtaatgactgtcttcccagaaggaggaagagtcaaccaattttagtacaggatggattatggggaatttggcgatctagtcagaataattatattgtattgggccacaaggaaattattctgctgccacaagtaattcctagtaagattggcatttttttagactatgaaatgaatgaagtttccttttataatttgaatgatagatctcttctctatacttttaatgataattttacaggagcactttggccttatttttatactggaactgactcaaaacctcttaaaatttctacagtaacagattctgaatgaattattagaagactcagtttctttcacctagtagacataactgagccagtgaatctagttttggctattctgtattttgtccagtttttcccataagaaagcaatatttttttatctcagtttcagcaacttccaaaaaatgtgattatgggacctactttatattaaattatggggtcagtgacaaggtactttagaaattctacagtaaaatacttgaaacatatattactgaagaaatgtattatgtaagaaaatctattacttttgtaattgccaataaaagcccagtaatttttttct

SEQ ID NO: 141025 - DNA, 415 bp, Homo sapiens
aaaaggcaccttccacaacacttaagttaatacttccacaatggcggggacatgccaagattattaactgccatcactctctttttaaatatctctaccccttgtttctcacatcaaattctatgcatatttcaagaaaaagcttatattcatgtcctctagaaatctttggcaataatgaattccgcgcgtgcactgtagctcttaagggacgtgccaactcaattacatcatcccagacaagtatatgctcttgatgaactcctcagatatactgtcataaaaatggcttttctggtctgggtgtggtggctcacacctgtaatcccagcacttttggaggccaaggcgggaggatcatgaggtcaggagttcaagaccagcctggccaacatggtgaaaccccgtctctaga

SEQ ID NO: 141026 - DNA, 395 bp, Homo sapiens
ctcttccccttggtgagctctatgatttaggaatctgtcttatctgccccaaacctggctcagtgcctggttcccactgtacactcagcaaattgtgatgatggagtgaggggctaaaggctgggcctcagggcatagcactgagggagggagactgtggcacagccgcttattgttgcacaggttgtgcactgcatacttctatgatacaaatggccttctctaaagttctgcatcaccttcacataggcagtagccctcggagacacagctcagtggctagagtcatggaaatcctggcctggccctgcagtcaagtgacagtgtgaggaaatgaagtgttttgaggccaagggtgtagtagattcctcacttcctcagctcctcccgtcctc

SEQ ID NO: 141027 - DNA, 448 bp, Homo sapiens
tactcatgaagttggtttactgaaaggaggagaaaacgcgaatggaaacagtggtgttatggctatgttagtgaaaccacgagagccaagatttcaaagacaaatgcacttagttacaactagatctgtactgtttgttgtattgggtagtttttctggcctcaattgtccaatcactatactcatgcaagccaagatctataaattgataatctgaaccatttgtcccaaggagacttgtgtcattgggtagtcacaagcctcctctcatgagttacacccttcatgaaatcgtagtttggaagcagcccaggaagtcatccactgtatttcctctggatagaataattccctccatgatttactcctcaaatgggattcccaacctgtaatgaagggagctcactagtcttctaggcacctgctacattttatgttaaactctggt

SEQ ID NO: 141028 - DNA, 562 bp, Homo sapiens
ctgtttctgactcttgcggtttcccgcatggctcccagcgagacgatcccgtccgggatcccatccggctcccatccggaggcgatcccgtgaaaggatcgcgtccaaaataaaagggcccgagacctatgcttatgtaattcctaatccgtgatcttttctaggggctgaactcccctccagcacagcctgttaccaggtgcttttcacaaacgccactggcggctgagttttcccccccacttccatttctactttacaagttgataacgtgggacgattacctaccaaatttcacatcatggcccagacatcgggtggattttgaggctctgtgatcgatttatacctatgctaaagttatcggtctgagaaagtagattagtggttgcctagggctaaggagtgggtttgggggtggggaatagaaaatgactgcttatgggtataggctttctcgtagcagcataaacatagtttaaaattagatcgtgttggcggttgcaccaccctatgaactgtatggtttgtgaattatatcttcataaagctgtttaaaaag

SEQ ID NO: 141029 - DNA, 168 bp, Homo sapiens
cttaaatgtaaattccagcatataaaagaagagcactgcactagaagtccagataactgccttctagtacttgggtttgccagcatcctgcacacaatgcctggcaccaggaaggtgctcagtaagatgtgcatgaatgtgtacataaaatttatatgtgagagaatg

SEQ ID NO: 141030 - DNA, 338 bp, Homo sapiens
aggttctatccaaaaaattagagtgaggaaaagttaaatgttaaaatacactgccttctatttaattacagagtaagcttcatcagctgtcttcaagaaaaaattagtgatagattccatttctctaaagtaggtacatttctatggtcaagtctctttattcacgataacactgataaaagagaatgtctattgagccttttctcatcattaaagacataagcaaatttggagactatttctcagccaatatcatgtgattgataataagttgtaaaagtgttcctatttctccacatcctctccagcagcatgtaccctaaaacttaaagtataat

SEQ ID NO: 141031 - DNA, 327 bp, Homo sapiens
ttccctgccttcctccctctgctctattatccagatggatttttggcggtggctgtttttgggaacatataggacctgatctgcctgggtatacttctgcatttgtaggcaaatgcccagtcattgcaaactgacatacttactgggtggaggcagagaacctaaacagctaaactgggttgggtaagggtcagctgaaaagcagtctcagtgctgtggagacagtaggaatgatggggactctagcgaactctgcagcacctgctccatctaaagcggggagctgcccacagatttagctcattactacagggcaggaaagagggc

SEQ ID NO: 141032 - DNA, 776 bp, Homo sapiens
ctaaggaagggtgacttgcgagtggcgcattcggaggcacggggtgggcagctgttgagcaagggaccagggctgggacaggctgccaggacccccacaaccccaggggaggaaaggggactcagccatcatcatgcctgactcccaggctcccggatgaggagcctgctagccagggcttgaagccctccagtgacagggggtgcattacttcctaagaagccatttccttggttcagaaacatttatccaaagactgagccgaaatctaccacctcacttaatgtttttggcacctggttatgacccagacctgcacagaataatttaactcttctgaaatagacttccagatatttggaagtggccaagtcaggtttaagagctcaggtctcccatttgacaagatttccatctcctcgctgtctgaacaggtttcagctgtggttatccaatccctcattcttgatgacacacaccaggctgaatggtctttagagttcccctcaagccgccaagcgctctgagacaggtttactagctttggtgagatgctgacactcctcacatgcacgtgcccctcccaactactcaagtgagttcgtggcaaatctctcatctgatctgcataaacggattatatcttaggcggtgccattgtctgcattttacaaataaggaaactgagcctcagggaggtgaagtcatttgcccaaaatcacagagccaggaaacgagagagccaagatccagaccccgcaagatccagaccccac

SEQ ID NO: 141033 - DNA, 527 bp, Homo sapiens
ccctcctttttactttcactctctttagaaaatgtatctcattgactcatagaaactgaattaattgtcctttaaaagtctcaatactattataaataacaaaaattattaaattaaaaaaaaggactaaccctggtgtttgaggcttaactttaaacttcagcaagtcagattatcactttggtattggaatgttctttgaagtatctggcatacagtccagtccagtgaaccataaaaacttcctacttggcacacatattgcacgttgtttaataagaatgcttattgcacattaataagaaggcttgtgcttagtgttttttgtttgtttgtttggagatatagctttgctcttgtcacccaggctagagtgcaatggtgcgatcacagctcactgcaacctctgcctcctgggttcaagcaattctcctgccccagcctcccaagtagctgggattacaggcacacaccaccatgtccagctaatttttgtatttttagtagagacggggtttcaccatgtt

SEQ ID NO: 141034 - DNA, 173 bp, Homo sapiens
tctatgaacaattttatgacatcaaattaaataacttgaaaaatacaaatacattcaacacaaattaccaaaactaactcaggaagaaatgcaataaatagaaaatctaacagaaatttaacaagataccgaatcaggaatcttgcctcaaagaaaagcccaagcccagcttg

SEQ ID NO: 141035 - DNA, 685 bp, Homo sapiens
agctccatgagtgcagagaacacttctattgtgttctctgttgcatctccagctcctggttcagggcttatcacatagtaggtcccattcatgtctgtttaatggatggatatgaacatcccactgagcctcagcgaatgtcaagtgggagccataatctcatccttatggtgctgtgaaatcattaaatgatttttggcacacagtaggtgtttgacgaatgagatacctattctcccattcctttcaattaaggaaaagttagaagcaggcatataggtagcttaaaggacagcatgttcatggataggaacccccaatattgtctagatgtcagtttttaccaacttgatttatagatttaatgcaaccccaatcaaaattccagcaagttattttgtggatataagcaaactgattatgaagtttatatggagagcaaaagacccagaataaccaacacaatattgagggagaagagcaaagttggcagactgacactacccaactttaagacttactataaagctacagtaattaatatggtattggtgaaacaataaacagagtaatggaacagaatccagaatccagagataaatcgacataaatacagtcaagttgtttttgacaaaagggcaaagtcaatacaatggagaaaaattcttttcagcaaatggtgctg

SEQ ID NO: 141036 - DNA, 402 bp, Homo sapiens
gagggcacacaggcaggcaagcatgagcagcgagaccagccgcatgtgaatccccaacaagcaaggaagagaaaaacaagctctgaccaaagtcagagccagcatgtcccgcctggcaggaccccttcgttcttcctgaggcccttgctcagatgtggttctgggcgctcctgctccaagggggcgatcagggcaaaactcatgggtttgaccagcccaaccctatcccagccaggtcccctctgtggggctgcgacatggggcccagaagacaggcaaggatgccaagtcctgtaagtttcacagggctgggcatgtgtaagaggctgggtgtccacatctggacatcagaatgggcataagctccggactgagaactcccagggcaaggaggacacagat

SEQ ID NO: 141037 - DNA, 340 bp, Homo sapiens
cttttttccaaataaggctggccacatccacaggttctgggatgtttacatattttttgtggtgggagccaccattcaactcactacaaaggccttggaaatacatcctaagagcttaacttctaggcgtcatagcatgttaagtccacgtaccaggtgaacacatcacctcatttgtctgtctgaccaaggttcacgggaatgactcattcgaggcatttcaggacaactaaagggatagaggacctggccgggtgagtggcagaggtggggaacctgttgtagtacacccctgctgtggggggtggagggagagatggccaggctggcatcatcatgt

SEQ ID NO: 141038 - DNA, 171 bp, Homo sapiens
aaacagtgctaagaaaagttactcaaagctggtaaaatagcacacttccctcaagtatcggttttattaaaacatttcagggaacaaaaacattaaaaaaaaatttttataatcctaagtttttgtccatacctgtgcaaaagatactaaaaatatctcttgaagaaaggt

SEQ ID NO: 141039 - DNA, 409 bp, Homo sapiens
gaacaaaccaaacgtacataagcagaaggaaagaaataataaagatcagagcagaaatatgtgaaatagacactagaaaaaaatacaaaagattctcaaaatgattgattggtttttgaaaagataaacaaaattgaaaacctttagctaaactaaagtgggcacaaaatcagaaatggaaaaggaaacattataattgataccacagaaatacaaaaaaatatagtggactactatgaacaattatgcactaaaaaattaaataacccagaagaaataaatttctagacacatataacctactaagactaaatcatgaagaagtaggtctcaatagagatttcccataacaagcaaggaaattaaatcagtgataaaatgtctaccttcaaagaaaagcccaggacct

SEQ ID NO: 141040 - DNA, 190 bp, Homo sapiens
taacaggaacaggtgccaggactagattttctagattttctgaaagttgaggagaagaacctttccactccacgcatctgtctaggtaggatgagtgaccatggcttgtggacatgggaaaacaaggcaacttctagagggttctgacaaggtcctagctcattcttgtgcaaaggggactcaggagtct

SEQ ID NO: 141041 - DNA, 181 bp, Homo sapiens
acaacgaaccaccccacattcaccacctccgccactgccaactaacacacactcagtaatcgctttcttctcaccatacatttactcatcaaatctcatcacagtctgagaggtaggtatgctgatcaatgcaatgtgaggaaaaagaaactggagcacaaagaaaggataacttgcctga

SEQ ID NO: 141042 - DNA, 167 bp, Homo sapiens
gaaccattcttcgtcctgctagatcctcactcttaccttgaaacgagaggaaataaaacaagaggcttttatgaaagaaccaactctgcaatgaccacggctgagctgggaaatggggcttcacctgctgccaggttgctcaggtcgctttttctctcttaattatg

SEQ ID NO: 141043 - DNA, 338 bp, Homo sapiens
cagtgagccacgatcgtgccattgcactctggcctgggggacaagagcgagactctgtctcaaaaaaaaaaatattttcaaaaattcccaaaccacttctgaaataagtactttaaaatatgagaataagggaaagcaagtactaggggtgggttcttagaataaaacacaaccataactagggagcttgacaaaattcagtaactgatatgaatcttggaagattctgatagtgaagagaatgaaccacacaagtcatagtaaatctgtaagttggatgtctgttaaaaatgtaaagaaaaggccgggcacagtggctcacgcctgtattcccagca

SEQ ID NO: 141044 - DNA, 119 bp, Homo sapiens
gtctggccgcagggtccctgcagcatggagccagtttacagccacgtctgcgcctgggctctcggcagtgtctgggtgggcatggagctctgggcgtctggccgagaaaggtggggcct

SEQ ID NO: 141045 - DNA, 304 bp, Homo sapiens
gctacatgggaggctgaggcaggaggatcacttgagtgcaggaggcagaggttgcagtgagctgagattgcgtcactgcactccagacttcactttctgacacctctcatcctttcatacaaagagaagaaattattcatttagccttcgtgttgtcttgtatgagctcttgtattgtcaaggacaagagaaatgtgcagttgcttttaaggttagatattccttctcattgctgggacttgagattttttaaatggattctcattcccaaaaggtaatgttaactggagagttcagttccaag

SEQ ID NO: 141046 - DNA, 455 bp, Homo sapiens
agtgcctgtagacgtagagcgggatgtggggggagaggtcaggagcctgtggggagctcactagtcaccatgaaggctctggcttttatctggagtgcaacaggagcagcacagaaaggccatgagtagagaagtgactggatctgacttgtgttctcagcagggacactctggctgctacaggagagcagagcatagcgggcaaagctcagcagccaggagacctggcttaggtttgttacaggaaccaggcgagagccggccctgactagggtagcagcagtggatgtggtgacagcagtgtgagctctgaacttgttttggaggatcggctgctggacagatgctgggctggagaaagaagaggatgactgtgtgggtgtggtcacagcaaactgaagcctggggctgcctgttcactgagaaagggaagattgtggagtctacggctaggg

SEQ ID NO: 141047 - DNA, 551 bp, Homo sapiens
ctcgttcctctgccatatgtggactaaaaaaggagagtctcctttccctttgcttaggcctgattcatgcaactctgaacactcttctggctcaaatactcccttggtcaaaagactgagccaaagctcatgcccaagaaaacccaatgggaacagactctgctcccgacctgggctgttccactctcactcaagagcgtgccaaagggaccgtcacaaaaaagcgggtccagatcagctcaagagaagtggccctggcttaaatatggatgactcaatcaccagaaatagatcactcctgagagtctaccaattaggttaccttccacatggtttctccaaaccctgagtataatcctttgccaagtaacccatacactggatgcagagaactaaggcccaagagatcctgctcccagctaaggaagaatcaccttcaaaatgacttccccccttaacactaggcgcttcgaacaggattcatgcagggaaaagtaccccttctgggggaagactgcttggctagcctgcgggaagcataacaggctgac

SEQ ID NO: 141048 - DNA, 250 bp, Homo sapiens
tcttcttgaaagaagaaagaagtatacccgactctggctaagaaacctctgaaacaactgaaaagtatacttgctagaaatctctagacccatgtttcagtcctggggcttccaataagttattatacgacagacaaaattccttaacttgtgtaggcttcatgttcttcttctgtaaataggccataataagctgcatgatgtgaaaaataaaaccctttctactcaaataattacaaatataaagagg

SEQ ID NO: 141049 - DNA, 289 bp, Homo sapiens
catttacaataataaaaaacttataaaatatccgggaataaactcaacaaaggaaacattcaaaatatataatgaaataaacaaaaaactacaaaaatattaaataactaaataaaattcaagtaaagaagacagacaccctttttcaggatgaaaagcctaaatgttatacaggtatcaatttacaaataatgcaattccaattaaaatcttaaaggattttcatggaacttgtcaagctgactctaaaatttatctgaatccccggaaccaagaacagtgcccagca

SEQ ID NO: 141050 - DNA, 108 bp, Homo sapiens
tcaactcaaaaatttcctgactcagccgggcatggtggctcacacctgtaatcccaacacttctgagaggtcgaggagggcggacctcttgagctcaggaattcaaga

SEQ ID NO: 141051 - DNA, 773 bp, Homo sapiens
ggcatttttaaaaagtgaagatagtctctgtatgtttagcttgtaaaaatttgttttaaatacctatttatcaaggatgatgatcttgaataattttctgttaaatatacttatctgtcagaaacaataccaataaaatgtcaatagagacattcgtatttatatacacacttatatacgtacacacataaaactaacaaaaatagaaatttcaatagaaatttggtattttcttcatgatttcattattaatcatctcttcttcagaaaatatagttcagaagattatttcatagtttaggtaataactggttcaaaagatgaaatgttaatgtactgctagtaattatctgtcggtgagatttggggactttttgatacatttctaaaatgttttcattttgaaagataaaatggtaatgataaatgcaatagtaatcacagaagatgggattattcaacaaacagtgctttttgaaaaacttacaattttgataaataggattaagattaatagattaaggtaaaagttatatatcaagaaggaattctgaaagcagagacaaggagttcaacctggttgaattaaagatgtattttgagaacatttgataataaagtatgaatattagaaagtcataatatataaagtttatttggtatttacaaagtgccagaaactactatcactgtacagttaccttgctatacaaatatttctcaattttcacatgagtcctgtgtgatatttttattatctcattttaccataa

SEQ ID NO: 141052 - DNA, 390 bp, Homo sapiens
aggagaggaagggcagaggaaggagagaaaagagggctagcagcaaggaatttccagagtgcttcctgcctcaagcaaaacaggaactgggaggggaggcatggaagagggggctggaacaatacgtgaggaagagagaggggcttcctttctcggtaggggaagaccccggcccactgcgagcgggcgctgacagctgcctcccccttgcatgcatgccttctccctgagctgcgttgctagggggtcaggcggagggacggagcacagcccacaaaggccaatggatatttattccttaattactgaatgcttttaagaagctggccactgtaaatcccgcatgcggggaggaggaggcagtggacaaggatttatgctagtggggca

SEQ ID NO: 141053 - DNA, 324 bp, Homo sapiens
actctttcattcactctctcatttactcattcattcactcactcattcattcactcactcatttactcatgcattcagtcactcatccattcatttatatactccttcattcactcactcattcattcactcattcactgacttgctaactcatttactcacaaattcaatcattcattcacttactcaattactcacatattcaaccattcattcactcactcatttacttatccatttggtcacttacttattcattcactcactcaacacatttcctcagtagcccttatgtgcaaagccctgtggcctacaggagctctg

SEQ ID NO: 141054 - DNA, 327 bp, Homo sapiens
aaaataccgtaagctggatggcttgtaaacaaaaatttatttctcatagttcctgaggatgcaaaggctgcatctttagatcaagatgtaagtagaggccaagtgcagttggctcacgtctttaatcccagctctttgggaggctgggtcggacggatcacctgaggtcaggagttcgagaccagcctggccagcatggtgaaacccggtctcttctaaaaatacaaaaattagccgggtgtttagtgcacatctgtaatcccagctacttgggaggctgaggcacgagaatcgcttgaacccgggaggcagaggttgtagtgagct

SEQ ID NO: 141055 - DNA, 197 bp, Homo sapiens
tgctgttgtctcatccttcactgccaaactataaaataaggatacatgaggtagccagaataaattgctggaggacatgattctgtcattgggtaacagtcaataacattaattggtgatgttgatcagcttcctgttgacaggcatggagaaaggctttctgcagaccttccctgctcttactgggaggcacaatg

SEQ ID NO: 141056 - DNA, 342 bp, Homo sapiens
tcaggacagggacttcaagtggagtaatcagagaataaagagattgggtcacaggtgatgatctataccaagacaggcagaaacgcactggaatgtagtcaaaagggctcaggtcccacaggactatcagaaaaggaagttgcaccagggtgtggggcaacaagtgagactgcccaggaggaggaggagatcctgggggcagggccaatgtattacattccttgccaagtgtgttcttttaacggggcagcctctctcagagcaatccgtacatatcagtgataacgatgataatttattgagcacttactctgttccagccatgactgtaagcactttact

SEQ ID NO: 141057 - DNA, 510 bp, Homo sapiens
cttcactatcttctttctcttatagtttcaattcctagcagtagatgtactcataaaggaatcactgagaatagagttttaaaatgcattacaattttttcaaatcctgagatttagttcttttctaattgtcacatattgtgaaatgagagaaagaagctttgagcaaatgaaataagggaagggctaattttgattaaggaaaattacatgattccttaaatctgtaatatgaggcctccaggggatgtcatcttgtagaattttatagcaagcactgggtaattttacagcaacctgaacatattgaaagctgaaaataatgttgagttgttcactagggtgctgaaaagatgaataagaagcaaaaaattaaattaaacttatgtaatttactaggatgacatagtttttatatacatccaatggattagttttttttttacaaaggtttatctactttgtgtttggaaaatcatgggaagaaccttttcagtttctggctgaaaa

SEQ ID NO: 141058 - DNA, 360 bp, Homo sapiens
cccactgaatcaagatgaaaaggaatcttagaataattcagacatccttattacattttatatctgtactaagtttaatcttaattctatttaatcttcctaagaatcacatatatgctttcacttatttatgtcttctttgaaggacataagacttctccttcaaaagagttttaagattttttttatagatgctcacactatttctaaatattttgccctttcattcctttataaatagaactgtttcttacattattatcttttctagtcactggtaagaaagctactgatggccggtcatggtggctcatgcctgtaatcccagcacttggggaggccgaggtgggaggagaggaa

SEQ ID NO: 141059 - DNA, 430 bp, Homo sapiens
agcctagtcatatcagagattctcatctaccccgtacctgtgtacaggaaaaactgggaagtgatcctgttggacattaaattaaggttgggctggtccacagtaataaaggcttaactgtgaagacgctgtctctagtcaaggaccacaactggaaaataaagcaggtcagcaaaaaggggaagacaaaaattacaatcaggctgggtacagtggctcatgcctataatccctttggattactttgggaggccaagagttcgagaccagcctgaagtacaaaaatgagccaggtgttgtgccgcacaactgtagtcccagctactcaggaggctgaggcacaagaattgcttgaacccaggaggtggaggttgaagtgagtggagatcatgtcactgtactccaccctgggcaacggagtgaggctctg

SEQ ID NO: 141060 - DNA, 362 bp, Homo sapiens
atgcctctgtaaaataagattgctgccctactcctgtagtttctgcacttctctttttagtactggaatgagtattctcagattaaatcttatttaaagcctagaggggagggggagaaatcacaccagtaggtggatggcatcattaaaatggaggtttaacattcttcactataaagttttaacatacattttccagaaataaaatagtccaactagtaaatgaaaaattctatgtatttcttagcaacaaaatacatttatctaattttctagcagtagctgcaaatgtttatttatcttttttttttgagaccgggttatgagactggctaatttttgtatttttggtagagatgagg

SEQ ID NO: 141061 - DNA, 473 bp, Homo sapiens
cttttttgcacaaataacttctctgtcaccttcattaaccatgttattgtaccttctaagaactgcttaaaactcacttccatgaagccatcccagtttactaccacctttctctagttactttatttcagaaactttcaacatcatattaatatttctgtgtagtgcaaaaaaaaaaagcctgtttatattaccctataaactatacattaaaacattcagagattatgaccttttctttcctaactaactctccacagcaaccagattagtgctttgtatttagggtatttttacagatactcttctatgtgattatttctaaaataactttaattttatatatctgtcatagattcctcaaggtgtacatcttaaaggtaaagcaagacaaaaaatcctaaaacaacctcttccagacaattctcaagaagttgctactgaggaccataactatagtttaaagacacctt

SEQ ID NO: 141062 - DNA, 623 bp, Homo sapiens
taagtgggttgctaaacattgcgtacacgtacacacacacacacacacacaccccatgttcttacaagtgagagctaaacattgcatacacacacatacacacacacacacacacacacacaccccatgttcttattctaagtggaggagaatcgcttgaacccaggaggcataggttgcagtgagccaaggtcgcgccactgtactccagcctggacgacggagtgagactatgtctcaaaaaaaaaaaaaaaaaaagaaaaagaaaaaaatatatatatatacacacacacacccatacataaaaaaacttaaacattatagaaaaaacattgcaagatataaaacaagccataaaaagaaattcatccttcaataaagaaaaatatctaaacgttgaaaaacttaagtattatggaaaacattgcaaaataaagcttttaggaatccaattctgttatttattttagtactgatgagactttgggtaaggaggcaacatcgtatcctggaaacaaaatgggtttgggagccagatgaacatagacccggcttcatcacttctcagatgtgttatctaaggccagcacttcctaaacattttgatctcaggactcttcact

SEQ ID NO: 141063 - DNA, 620 bp, Homo sapiens
ctctggcgagaattgatctaaatgaagccctcactcagcccgtctatgaccagatcgaccctgtttttggaagcatttttaggacggggaagcccactggttcagctctgatgcctcacatagatgcttttaagcagtccctaggagaatcgcttgaacccaggaggcataggttgcagtgagccaaggtcgcgccactgtactccagcctggacgacggagtgagactatgtctcaaaaaaaaaaaaaaaaaaagaaaaagaaaaaaatatatatatatacacacacacacccatacataaaaaaacttaaacattatagaaaaaacattgcaagatataaaacaagccataaaaagaaattcatccttcaataaagaaaaatatctaaacgttgaaaaacttaagtattatggaaaacattgcaaaataaagcttttaggaatccaattctgttatttattttagtactgatgagactttgggtaaggaggcaacatcgtatcctggaaacaaaatgggtttgggagccagatgaacatagacccggcttcatcacttctcagatgtgttatctaaggccagcacttcctaaacattttgatctcaggactcttcact

SEQ ID NO: 141064 - DNA, 319 bp, Homo sapiens
acatatgcagacagaacataaaggtagacattatttttagctatagacctttgtttaaatcccaatggtagggaggaggaagatctattaagaacccaaaagggaccataagatttgtctacattatttcaagtagatgcagataatttaaaacctatgaatatgtaatgcataacttaaaaggtttcaaatgtaagacgtaaatacattgtaataggcctatgcctcagaagacagaggaaaatattacaaggcctttagtgcatgttgataactctgcttctattaccgttagatcataactgcaaaaacccataca

SEQ ID NO: 141065 - DNA, 803 bp, Homo sapiens
  misc_feature (584)..(584): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (635)..(635): n is a, c, g, or t
  misc_feature (639)..(639): n is a, c, g, or t
  misc_feature (641)..(641): n is a, c, g, or t
  misc_feature (644)..(644): n is a, c, g, or t
  misc_feature (648)..(650): n is a, c, g, or t
  misc_feature (652)..(652): n is a, c, g, or t
  misc_feature (655)..(655): n is a, c, g, or t
  misc_feature (665)..(667): n is a, c, g, or t
  misc_feature (674)..(674): n is a, c, g, or t
  misc_feature (683)..(683): n is a, c, g, or t
  misc_feature (694)..(694): n is a, c, g, or t
  misc_feature (697)..(697): n is a, c, g, or t
  misc_feature (699)..(701): n is a, c, g, or t
  misc_feature (704)..(704): n is a, c, g, or t
  misc_feature (716)..(716): n is a, c, g, or t
  misc_feature (720)..(720): n is a, c, g, or t
  misc_feature (737)..(737): n is a, c, g, or t
  misc_feature (752)..(752): n is a, c, g, or t
  misc_feature (755)..(756): n is a, c, g, or t
ggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaacaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaantatgcattctgaagcaaagacaaggatcaaaaattgatantgngagctngnaggngngtntcgnnntnacngctgggagtnnnatctatnctttacatnggatgcacaangtntnnntcnagaagaggcatncggnatcgaaccatagatgancatgatgcaccattnagnnaatccatggaccacagatgccataccgactgacgctgcctactcctc

SEQ ID NO: 141066 - DNA, 806 bp, Homo sapiens
ccacttgcccaatattactcagcaaaataagtggcagtgctggggcctccacccagtaggcaaccctgcctcttaaacacacatcttcagagagggggtgggtgggtccgatttagagcctcccacaatacctctcaatgattcttgtttttaattagcagaatctctggccatccctataaagctgtgacctaggaatacaggcaaatgaggatcctggttgtcactgctaccattggctgagggcttccaatgagttaccaaaagggcccaaagaccactcagagcaaaagctcctagtgtcctccctccaggatcagaagacctcttcaaaaaggaagccaaaatgcatgagactatcactcacagggggtaggagaaaagcaggcaggaactgcacaagctttgaaattcattcttgaccttctaattctcatgcttaggattaccaggagtctacatccccatttttacaaatgaagaaaccaaagttcagaaagatacaggcatgcaagtctctgaacaagaaatacaagtggccaataaacctatgaaaattatgcctggggccaggtgtggttggcttacgcctataatcccagcagtttggcaggccgaggtgggcagatcgtctgaggtcaggaattcaagaccagcctggccaacatggtgaaaccccatctgtactaaaaatacaaaaaaagcatccagatgtggtagcatgcgccagtagtcccagatccccgggaggctgaggcagaagaattgcttgaacccagaggggaggttgcagtgagcttgaggga

SEQ ID NO: 141067 - DNA, 471 bp, Homo sapiens
gggttctgatacggtttggttctgcgtccccacccaatctcctgtcgaattgtaatctccagtgttggaggtgggaggtgattgtatcacgggggcgaatttctcatgaatggtttagtgccatcccccttggcactgtcctcgagatagcgagttctcatgagatctggttgtttaaaagcgtgtggcacctcccctcattctctctcttgctccagctcctgccacgtaggacgtggctgctccctcttaaccttctgctgtgttcataagtttcctgaggcatccccagaagtcaagcggatgccagcatcatgcttcctgcccagcctgtagatccaattgaacctttggttttattctttataaattacccagtctcgggtatttcgttatagcagtgcaagaatggcctcattcacattcataaggcccgagtcctgcatctcttagggagcctctccctgtcca

SEQ ID NO: 141068 - DNA, 333 bp, Homo sapiens
attaataaggatgctttgaatgttcttatacaagtctttgcatggacatgtgttttcatttctcttggctacctatctgagaatacaattgttcagtaatagagtagatatatgtttaactttattagaaacatggcatatgtattttacgtactccctctataagaaaaacacaaaaacaagacatgtaattgttgcacaatactgaagtggcccaagaattagggttccttaaaggaagccttcttccacctgtattgatcatccatggtattgatcatccatggctcctcaccaggcatcattctttgggtcagctaggcagaatgactt

SEQ ID NO: 141069 - DNA, 588 bp, Homo sapiens
caggcaccaaaaattaaaaaatacattaccatttacaattgcccaataaaatgaaatacttagatataaatctaataaacatttacaggacacatatgctgaaaacagcaatggcgatgcaaaaagtcatagatctaaataaatggagagatttattgtgttcatgattggaagactcagcacagtaaggatatcaattctccccaaatcaatatacatgtttaacacactccttatcaaacttttttagacagagacagggttattctagattgaaaggcaaaaaaactagaataacaaaccattttggaaaagaataaagtgggaagaatttttctacctgattttaagacttacatagctacagtaatcactactctgtggtattggcagagagatagaacattgaaacaaaatagagaaccccaaaatatacccacactagtatgcccaacagctttttgacaaagatgaaaaagcagttcaccagagggaggatagcctcaacaaatggtgctgaagcaattggacatccttaggttaaaaatgaagctctactcaattctcatcccttataccaaaaaaaaa

SEQ ID NO: 141070 - DNA, 157 bp, Homo sapiens
tcaagtgacatttatatccagccaaggatgcaaccttctgtgataggatatcaataacaagaatttaaaacacacacacaccctcatagagaagaggaagagcttgaatctatgatgcctattataaaattgaaagagcattctaggatttatggta

SEQ ID NO: 141071 - DNA, 177 bp, Homo sapiens
tagaaaggttgacatcttctctctaatcctttctatgctaaacagctgtctcaccatgagtttggagaaaaaattaccaccagtcatgttacactatggtgtcatgcaggagactaaaattcagtaagctttaagcacttaggatgcaaaaaagaacagatgcctgaaataactaca

SEQ ID NO: 141072 - DNA, 306 bp, Homo sapiens
gtattttgctatttatctcacacttaaagattatacaatccattttcctagggcaagcacaaatggtcagttttataaatcttgatggactaagtcaagtaaaaaagcccactagttaagagtccagatatcgagagacacaaatctgaggaacgatcaattaggacaccgtggtagcttgtctccaagatgtccatcatcagctctttccttccctgcatgtttgtgctgttctctagttgaacggtggcgtctattcactcccttaaaactggactggactgtgacttctctgaacaacagtga

SEQ ID NO: 141073 - DNA, 657 bp, Homo sapiens
ataccactgctccttacccctgtacacaccttcgaatctcagttttgatacaaataggttctcagttttgggtgtgaagaaaactggttgatatttttttttaatctactaaatgttggccagagctgaaattgcctgaaagggaacttgatttagcagaattccttcttttcagaaagaaggacttagactaaattatatgaacgggaggagcctgtttttatctgagatggttgattggaaaaagaatagataaactaaggtggagagttgatttgaaaaaaggaaaaaagatagtcctgtctagtggtcagtcctaacagtgtggttaaaggggagctaaatttcaactttcaggggtcagctgagacaaccacctagattttccaagttagttccaatttcaagtacaataatcctttgacaacatagaaaagaattatagttagcaaaattgcaattgtcacagtcaaggtcttgttggtaatagagggttggggaaaaagttaaaacagcattaaatgaatatatttttaacataacaaaagttcccagaagacatccacttcaaattcaagccatattcatcaatgttaaaaaccttactcttctccctgatagtgtgaggaaaaataaaataaacttaaaataaaaaac

SEQ ID NO: 141074 - DNA, 207 bp, Homo sapiens
tttaacctggtgtctgacaggttttatctgcagcttgtcctgctacagttttaagccattaagtttgggaataatttgttacacaacaaaagacaactaatacagacctactgggaggggaggagccacagtattttgcagttcttccaatcaggaggtgaagtctacagtctagctctccactctagaatttggatttggctgatg

SEQ ID NO: 141075 - DNA, 201 bp, Homo sapiens
tagatacggggtcttgctatgttacccaggttggtttcgagctcctggactcaagcaatccgcccacctcagcctcccaaagtgtgggattagaggcatgagccaccactcctggtcagtggtgttttagtgtcaaatcctctccaaaggctcccaaccccccagcctctaacttcacagcacatttcacagagcaagaaa

SEQ ID NO: 141076 - DNA, 592 bp, Homo sapiens
tataatatgatctatgtgaaaaaatgtgagcctgaaagggccggtctttcaagttggatcccaagtggctaactgggcctaaatttaaaatagagcctagcaaccatttgctgactagaggtcattcacatactcttagttcctgaaaactcacacctctgcttaactttaggtatcactaattgaagagaagcagtccaaggtttttatttttaccttaaataattgagaaaacttttatttgttgttttagttataagttttataatttacatcatgtttgctatagactttaggaagcactgaaaatagtttctttgaggaatgccatgattttatcataaatattcctgattcttccaacttggtaaccaattctatacattattttggactagtaaacttaatgacaaaaactatagtttatttttcttttccctcaaaaaaaaaatagtttactcttttttttttgagacggagtcttgctctgtctcccaggctggagtgcagtggcacaatctcagctcactgcaacctccgcctcccgggttccagcgattctcctgcctcagcctcctgagtagctggggtt

SEQ ID NO: 141077 - DNA, 790 bp, Homo sapiens
gcttggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgggaaaaaaaaaaaaaaaaaaaaaaaaaaaaaaaaaacgcggggggtttttgggggggggggaaaagagggataaaaaagggagggtattggttttcgggcccttttttgtgaaaggggaatagggggggcccaagagaggggggatatagagaagccggggctgaaatgagagac

SEQ ID NO: 141078 - DNA, 555 bp, Homo sapiens
tgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttggtaataaacttttaccagacatagccatgctcatctgttaatgtactgtctacgactgcttt

SEQ ID NO: 141079 - DNA, 320 bp, Homo sapiens
ttttccactgaggaaggcctagaaggagcagtatccttttagcatatcaagtactcagatcttgatttctaaatgccactctactgaaagaaacagggcttcttggaggaatggctgatctcaggactgggacaaggaaagaacaaatgaacataaatcatctgattgtgccaggaagtaatgaagtgctgaaagaataatgagaacatgtcaaaagtacacagaagccaacctggaaaagggcttactcctactggtcaaatctatttttatttatttatttttatttttattttttttgagcatcaaaagaaatgatg

SEQ ID NO: 141080 - DNA, 162 bp, Homo sapiens
tatcatgcttcagaatgtgagttttgagatgcctgcaataaaatatagggttaaatgcctgaatgagatagtatagtcataaagttaagaaaaaagttaattttaaggcaaagatatgaaaaacatcatgaacgtagcaatatggaatttaggaagatgata

SEQ ID NO: 141081 - DNA, 122 bp, Homo sapiens
acagttcattgtgaaaatctttttaggatgcactcgtatgaaaagcataatgcaaaatgaaaattcatctataaacaaacagggcaaacagcatctatttgcggttttctttgcacaggtag

SEQ ID NO: 141082 - DNA, 286 bp, Homo sapiens
gacctggggcaggtcctctaacaccaagcccacccaggccccatctaacagtatgccgcattctacatgacctcagagttctttcggaattccagctgaaaagctgaaaagcaatactatatagttgtggtttccagctggcccatgttagtatgtatagcttttcttcctcgccatgaaagcactatgggagaacgaagcccgatgctgggcatgctttgccaggtgggtgctgctgaatcacagacctcagcaactgtgttccgcctccacagaggccggagat

SEQ ID NO: 141083 - DNA, 348 bp, Homo sapiens
actcccaaaccgtacgtcccacacttgccctctccagtgccaaccagctgcctagagggcatctcttttttgactatgccacaagcacctcaaactccacatctcaaccttctctgcctaaaccagctcctcctcacaggggaggcatctgtaacccaccagttcctcgagcctgaaacccgcgatctagcctagatttctccttgtcccctgtctgcattccaaggcaccgaggctgctgactacgcctgctcattgcttctccctctccccactgccttagtcctcctgcggcccccaaccaccaccaaaagagctttttagccgctctccctgcctgaagtctca

SEQ ID NO: 141084 - DNA, 522 bp, Homo sapiens
gattgaattccagcattccaggaaaccttggccccattgtagctgtgtgaataggagtagaagagtagatggagcagagaggcccctgagtgccaggctgagggctaggggctctgatgtaggcagggcctggcatcggcacacactgtcacaggctgggtgagataaagccaccacttcctgtgtaggcctcttggagcgaagcaaatttagtcctggctaagaaagcaggaagggcagggaagctgaggacgttacacctgtctgctttcctttggggttcttccacggacactgcttgtctgggcccacagcgtgtaccacccacttgtccccacctctactagagagcatgggacagccctgcctgaactctgaagaagcttagagccttcttagatcggagggtcccaccccttgtctttataacatgtgccagaggccaggggtcacttcacagatctggtcttgtcatccctgattcttggatttttcacctcaatggtatctgcaactcagctt

SEQ ID NO: 141085 - DNA, 300 bp, Homo sapiens
cctgctgtcctctcagccacagtgcttatccccagatgaaataaaaacaaggcgattattatgggtgtttggggattcagagcatcccctcggagactacatcaactggtggcaggaaaggatctttaagagagtaagaatgagagaggcttaaaaaaaaacccagcttgtcagcagtaatcggctcctgcttggccctctctctgctggggtccaggccaccttgcagggagatattttccctctaagaggctttatgatgctacagttctgaacacaggtgcccgctgccttaacttg

SEQ ID NO: 141086 - DNA, 380 bp, Homo sapiens
cagtggcatgtctgttaaaggagtgaatgaacttggaatgaacgagggatgctgtttctggccagctctgtctcagcgcctaactcttgcagcagcactctctccacctgcctggcaggaccaccctggctgttctgcctcccatcgggggctcacatcccagatccggagactgaggcccatcatgggatcatgtccaccatcccgtgacctcttagaggctggcgtccaggcctcccgagcctcccaccagcccgcctctcctgccacgtggaaagaagcctcaaatgatacaattgaacagcaacaacaaaacagctcctccaccctcaccttcatagtccacttccatattaattgtcgtatgcaggcccagtgag

SEQ ID NO: 141087 - DNA, 295 bp, Homo sapiens
ggaggaaagcggtcatacacttcaggaactcgagcacgtcgtcgggggaccaagatcaccggcgcctctggtgaatgtctgtgggaatgacgtctaacacggcctcccaagtgctgggattacaggtgtgagccaccacacccggcacattcttgatttttaaagcaagcctagaatatcagtgtagctcttttcatttatggagcagctcagaaatagatacaaactatcaacattttatgtagtttataatgaacataactaataaaaattgtcagtgtataaaaaaaccgat

SEQ ID NO: 141088 - DNA, 299 bp, Homo sapiens
gcaaaaatcatgagctagagaggtgtggagagagggatggctggtattggggacagattcagaagcagtagaagcagtgactgtgttgggggagcagtgaatgaagcagtgtcagagcacctgagtcatgggaatggtgcagcacccgaaggagataataacatggtccttatttttcagacatgacacaggcacgcctgttcattctctgcagcagcttctgaatcctgaacaataaatactattatggttccctatgacactagacattttgttgtggaacagttttcttgtcctgc

SEQ ID NO: 141089 - DNA, 351 bp, Homo sapiens
tgactgtgttcctttgtgtgttcctaaccctcaggcctttcttggccctgtgtgagtaaagagaaggagatctgtcagccaccatcaacttgaatacccagtctcaccctcggactggctttccctgagtccatgcatatgtgagagcttctgcccaggaactctctttccccccactgcaggaacagcagtgccctttgacttagttaatgccctcatgaccccttttttgcttattccccacttctttagaggagggtaaggagaaggccccagcctgtgcctctatgcccacttcctgacagtgcccggcatgtggcagtggcttcatcagtgtttttgaatgaatga

SEQ ID NO: 141090 - DNA, 216 bp, Homo sapiens
ggatttgctggtgcagtacaactaggcttaatagggacatgggctggataatgctctttggcccttagagacactgggcagctgagagaactcacaggggctgtctgcaacaacagtagccccatccaagcagcacattttgttcctgaagtccaacgaggtcttctcccaaccagagccacagagaggccacacagttccatagggccaaaacca

SEQ ID NO: 141091 - DNA, 167 bp, Homo sapiens
gatttgctggtgcagtacaactaggcttaatagggacatgagcaacaggctggccagtgcccaccgttaccatcagcagccacgacgaatccatcactcaagttctgaaactgatgagacgggagctccctccttcagcacaaaagccactgcatagctcacacaga

SEQ ID NO: 141092 - DNA, 429 bp, Homo sapiens
aacaactctaagagtagatatcattagcaccctcattttacagatgaggacacccgggcacagagaggtgatgtgacttgtctggggtcacactgctagtaagagacaaagctggctccggaggccaagcccttgacctcttctgtgtcagatgggttaggagctccagaacggagccaaggtttgagtgccacatctgccacgtatttgctgtgggactgctggcctgtgcctcagtttccccttctcagagaaagtaaaattatcaggaatagacagctccaagaaaaggaagctcaagatggctttcaacaacacaaagctgtcccactttgctctgattaaaatcagaaccatgatgagactgtttgtcacctatctgactggcaaaggtgagaatgtcaggtgacacccgtctattccagcaag

SEQ ID NO: 141093 - DNA, 355 bp, Homo sapiens
ctacccttcaacagaagcccaactcaggtttcatcaggggactcctccaccttccaatgtcctcaccaaccatcattcaggtgctcttggcccaattgctcggtgtcaacactgcaggactttcacactgtttgttcacccagaaagataatgctctccaccatatacaaattactgtgcaggagacaaagatcaatcaatacggagcctaccttaaaggagtttaccaagggagaaaacagattataaacaggactttttaaaaagtagcccggcacactggctcatgccagtaatctcagcactttgggaggccgatgtaggggaattgctcaagcccaggagttcaagacca

SEQ ID NO: 141094 - DNA, 239 bp, Homo sapiens
cagcggcccaagaacgacattccaatgtcactctccccaggcagacagacgggactcattccttccccgtgagaggaactaagttatgcaaatcaatgcacccatcaatcgagcatctcaaaatctcaataaacaggaggcaacgggaacacctaaaagagggcaataaaggagtgcaatttagttgtattctgtgttgcaacagagaagagcctcgggatcatcaaaccccaaatctg

SEQ ID NO: 141095 - DNA, 190 bp, Homo sapiens
atggggtgtctggggcatcagggagctcccttgcctggccctcagtggcctgatggagtaagagcgtttggttgagtgattcagatctggtcactatggtaggagaacaaaaatgcatattgtgtcatatcgtgtacagctccaaaaagaggcactagtcatgagtgccgaaggtgcgggcccacagaag

SEQ ID NO: 141096 - DNA, 243 bp, Homo sapiens
ctgcctctgccttccaaagtgctggggttataggtatgcaccaccatgcctggtcccctgaagtttcttgtaggcaacagatcattgagtcttgctttttaaaaatatatatacgtggagagtttggtctgtttaccttccgcattattagtgagtgtttgtttcatttacctgtagcattattattgataagtaaggacttactcctgccatatattatttgcttcctggttgtatagtgga

SEQ ID NO: 141097 - DNA, 478 bp, Homo sapiens
cttaacttcaatttaagctcttatcaaatagtctaaagacccatgtcattgtcactaggcttacattcaagcttgcagtattattgattctgcctatccactcagaatttattttgttaagtagtcactttatttaaaatattcagagctaaaaaaattagacagagctgttcctgtttaaatctgtaaagaagggaaagttttagaaacctgttatattgcactgcctaccctgacagcccccacccgtagtgccccctcttcaccttagggtattgctgtcaactctctaggttggaaaccaatttgatcaactaatccctgagataaaatgttatcccagtatgggtttaggagtgattcctccaggcatatttacattttaataagaggcccttaaagtcccaaatctgctaagatgtgaatgtgtctatctgtaccatgcccagcaggataggttgtggggaaaatcatctca

SEQ ID NO: 141098 - DNA, 382 bp, Homo sapiens
agctgggactacagctgtgtaccaccatgctcggatagtttcttttatcagacggggtctctctgtgttgcctgggctagtcatgaattcttgggctcaagcaatcctcctgcctcagcattccacagtgttgggattataagtgtgagccactgtgcccggccccaaatattttcgtaatgtttttctagttgaccacatctggaaagaatccatcatactctcacaccccatgatgggtatttttccatgccaggcttgtttacactgatcctgcactgctttgtaatccggcccttatttacaaaccctacgtccccacattgttccctagctggttgagggcatggatttattttatgaaggttgcatctcctatgat

SEQ ID NO: 141099 - DNA, 466 bp, Homo sapiens
tggggccgggcacgggggctcacgcctgtaatcccagcactttgggaagccaaggcaggtggatcacctgaggtcaggagttcaagaccagcctggccaacacggcgaaaccttaaaaattagcccggtgtggtggcacaggcctgtaatcccagctacttgggagcctgaggcaggcgaatcgcttgagcctgggaggcagaggttgcagtgagctgagattgtgccactgcattccatcctgggcgagagagtgaggctctgtctcaaaacaaaagaaaacaaaacaaaagcatgaggttggggtagggtccgggtttgaccctttccagctgtgtgggctgggccaagttacctggtctctctgtgactccttttcttcatctttaaatggagatagtagttcctgcctcagagggttgctgtgaggattcagtgagttaatacatgtcaaatattcagaaca

SEQ ID NO: 141100 - DNA, 393 bp, Homo sapiens
cacccggctcactgccttggacacacacatcactggcttgaatgtgaattattaaccctcttggggaaagaatttctaactaagcccatcttgcagatgagggagctgaggttcaaagaggtaaagtaacttgtctaaggtcacagagctagcaagcagggagctgggactcaaagctagtccagtctctaaagcagcgtgtctcagcctagaatgtgcataccaatcacctgggcatcttattaacatgcagaagctggttccgcaggcgagggctggggcagacagctccccagtgatgctgggctacagatggcactgagtggccaggctctgaagaccacacaacccagcccctccacctcacctctcccttcctgccccgagttctgc

SEQ ID NO: 141101 - DNA, 260 bp, Homo sapiens
actagtccacgtgttgtgctgctggcgaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccaaccgtggactagtagccaaccgtggactagtg

SEQ ID NO: 141102 - DNA, 309 bp, Homo sapiens
ctccacccgacggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccaaccgtggactagtagccaaccgtggactagtg

SEQ ID NO: 141103 - DNA, 185 bp, Homo sapiens
gggcttcccaaggccaggcagaagcgtggggcagaccacacaacaactggttaaaagcaagggagctagccgggcgcggtggctcacgcctgtaatcccagcactttgggaggccgaggcaggcagatcacgaggtcaggagatcgagaccatcctggctaacagggtgaaaccccgtctctact

SEQ ID NO: 141104 - DNA, 244 bp, Homo sapiens
tagagaattttagaaaaggaaaagagaaacaacatagaagaaaagaaaaaagtatcacaagtaggggtccaaatatcttatttactgtgcataaaaactatcctcaagaaggaactatctaaaaaatgcatatactggccaggcacagtggctcgtgcttgtaatcctagcagtatgggaggccgaggcaggcggactgcttgagctcaggactttgagaccagcctgggcaacacggcgaaac

SEQ ID NO: 141105 - DNA, 405 bp, Homo sapiens
tgcttgtgtttttcagtaagtggttattagggttatatattctgggaatttagtatgtgtgtgtctgatagagagatgaggttctctttttatacaggagagtgggagagttgaatttatatgtattagaggtatgtgatatggttattggttagtacttggcaatgtgggagctggttcatactagattgggataatttgggattgggaactgtttttatgggtatttataaatgatatgctggagatatttctgtgcatcttgggtgtgtatactggtttgtgtgtatatttatcagcagatagatgaattatctaagtctgtttatagaatacgggattgttagtatttaaagtgtatttctttggagaatgctaggatgttcgtacatgtgtttgggcatg

SEQ ID NO: 141106 - DNA, 412 bp, Homo sapiens
cctatggagcacttttaaaactacatattttgacctatacatgggttttgattaccagtttttttaatgatatagaactaaaatcatcacacattaggcttcttattgattagtgaaacctttgtattatgtgtgtgtgtatttatacacatgtgcacacatgtcacacttgtatgcatatggcatgtcatgccaggttatgtcatataagcgtgtatgccaggtcatgatgttaaaatgtatttcttatcatggattgtggttaaaaaaaatactgatctctgggtatccccaactccaatctgaaatcattgtgattctctcgccttctcaatgtgactagtctttttaaagttccttttgatcttcccaaatggcatccctgtgtccactttacccacttccaccgcct

SEQ ID NO: 141107 - DNA, 651 bp, Homo sapiens
gttagacatttctgggttctatattcagcatcccaaccaccagcacattggagtgacacacacagtaggcgttcaacaatactttagttgtccctggacacacacttctcttcctagaaagggggcaggaatgttaacaacagggaattgactgagtcccaagtataagctgggtgtttgttttatttttccattttcctcactcactactttcatatgtagtaaagagagtacactgatgtatgaaggctttcagctgtatgtgcgaggaggtgagcttgtcttgccatcagctgttcaatgtaccaccatggccaagatttaggaggtttttctgaagcccttacacatacaaccctttctccctacatgcctcctttcttgcagtgagggattcagttggtcccagatttcaccattatctctaatggtccagtgctgttcaacaaaggttggtctgatttccttaaaggatggcttttctcactctggtccatgacatgactctaggatgacacaaacatcttcagaaaaccatcttggaaggcccaccaagtaaaccagcaaaagcccttaccttcaaaccaaagaaaatactaaatccatgaaatcacttaagccacccttccaaagagaaggagattcaaaatg

SEQ ID NO: 141108 - DNA, 593 bp, Homo sapiens
agagaattgaaataatcatgaagattgtcattagaaagcatggcaggatgacaacaatttcaatgaagatggcagatacggaagttatgcatcaaaggagcagcatgtgagcatctgtgtccttgagatggagaagagaaaataatggaacagataaagaacactcagagatacagaaaaatatttcctgaaatgaaacatttgccaaaccttcaaacatgagaagcttttacatccacgtatgtaaatggagtaaaagagatcccttgatctgacatgaatcttagctccattctttagtagctgtgactctgggcaggtttgtcaggctgattttttaatctgcaaagtgtgactattaaaaatcccagcttcatggtttgttgtgaatgggaatgaaatgaggtaatatatgtcatgtacttcggtgagttactggtacagaggatattcttttcaagtatcagctattgtttgtatcttggtaaagttcctgaacattatcgggggaagaaagaatcctgtacgaggaaaaaaaaacaaaagttgcattgcattcaaacttctacactgcatcagttagtgccagaaga

SEQ ID NO: 141109 - DNA, 126 bp, Homo sapiens
gtcatttattgaactaaggaaaatgcaaaagaagtaaatttggattaaacaagatgaaaagtacagatatagttatcaagcacctagtaaacagtcggatatgtgaatctggaattcaggagaaag

SEQ ID NO: 141110 - DNA, 345 bp, Homo sapiens
ggtaagataaaaacaaaagtctcagtctcctgaagcccattgtgagtttggaggaagccagcgctctggccaccctgtgctcctggcacttgctctgtgtggctcctatcaggaaccccacacacgttccttggccgaatgaatgaaaggatgaatggggaaggagggtggggggaagattgcaggccagtgtggaaagaggggaggttggatctgagccactgtgggatggcagagctggggtgcatggtgaggcatgctatctactccacctgccaggctgggcccccgggctgatgattttgtgcttctgcaatgttgaagcagctgccagtattttgaaaa

SEQ ID NO: 141111 - DNA, 353 bp, Homo sapiens
aggacacaggcctacttgggtaaaccacttgaagtgggtggaagtggtgagaccttccaaacatgttttgcttgagtaacagcaggtaagcactgccccctgacctgggaatgtcgatcaggttaattggaggggaggtaggaaagtctgggccagagctgacagcttgggcaaggaaggtgagaagctggaccctgcagaattttccatctcagcctttccctcacagggctcagtcttatctttaaatggcacagaatgtttgactgaagaggcatctaattatcaggcccccaggatccttgagacctggtctggctatgtggctgcctcagttccccagtccccatcac

SEQ ID NO: 141112 - DNA, 203 bp, Homo sapiens
tgtgtctcagatgcaacaacacttcctgcctctgagcctttgcattcactgttccctctgcctggaatgctctctgcacagcctgtcacaaatgtcagctccccaggggccatccctgacctctccatctctagtgatctccgtgcgaactcaattcctgaagaaggtggtccatgcaggtcctaagacctgagcaagccagg

SEQ ID NO: 141113 - DNA, 787 bp, Homo sapiens
ttgcccatctttgacagctctgctgctgtgtcccgggggaggcaggtttccaacataactgctactctgcctttgcctggtgagtgctgagatggagaggcaggctggtatctgtttgatctgatactccagaaaaatcgtaattttacattgtttttttcctgatttctaaacacatgaaaccagattcttctggagaaacatagagtgccttaattttgcctagttaggggctgttgggggtggtttttctaagcacccttctgtgtctagccaaccagtagaacctgatttttgggaggtgaattagccagggttctctagagggacaaaactaataggatagatgtatttataaaggggagtttattaaggagtattgactcacacggtcatggaactatgtgaggtcccacatagtccatctgcaggttgaggagcaggaaagccagtccgagtcccacagctgaagaacttggagtctgatgttcgagggcaggaagcatccagcacaggagaaagatgtaggctggaaggctaaggaagtctagtctattcacattcttctgcctgctttttattctggctacaatggcagcagattagatggtgcccacccagattaagggtgggtctgccttccccagcccactgactcaaatgttaatctcctttggcaacaccctcacagacacgcccaggatcaatactttgcatccttcaatccaatcaagttgacactccgtattagccatcacaggggcatgctaagcaagaattgtgtcta

SEQ ID NO: 141114 - DNA, 536 bp, Homo sapiens
cttacatgcatgtcattcacctttatgtaaaaccttttacctcctatctttacctatgagaatcctacctgaattttaagagtctgatcaaatgtcacttccacagaaaggccttctttggttgtaactggaactaatttttaaatctcagtctaaggcaaataagcacattagaaagcaataaataaataaatggtggccccattttgcagaggaggaagctgggcctcggggtggagtcattgttccagggcaccaggttggacctagacctgaagctgggtttggtgcagccctgcaccccaacccactggtgtgaggtggtcatgcaggaggggccagttggcgctttgctgtgctcctgggctcccggggtgggcctgagccggctccgttctgtgatcccctcgtgtgggcttcatctgctgatggtgctggtgcccggaggggtctcctggtgcacagaaatctgtgcttagtggcagttccaggggtgctgcggtacttcctgggctgatacaggctttgtgggagtg

SEQ ID NO: 141115 - DNA, 463 bp, Homo sapiens
gatggtaaatgtactttttttcataatttgtttttaaattacaaatagaaggcttattttaaaaaaacataaaagtatataaagcaaaaagtgaaaatcctctatcccagtgtttacttcgcaaaggaaactagtatcagattcctgtgcgtctgtacagaattttcccatgcacatatacatagatacatacatgcatacataatttttgatagtttctaaaaagtgaactcaaactattcatgctattttaaaattttctttttttcaagttataggttggtgcaaacctctacccagaaaacgttaaagtgaatcattgccccttcccgaatggaaagggttcagtgtagtcaatttgccaccaaatggccagttggtctcctggagggatggtgtcaaattgaggaccagttttggtctgtgttggaagcagattggatgttcagcatcagcatcagct

SEQ ID NO: 141116 - DNA, 179 bp, Homo sapiens
gaggtgaggaccgcatctgtgattctgtggcccgtgagagcagctggtgcgccctgcagggctgacagggccgaggatagaacgtgccgctttctaatcaccggtcagaagcgtgggccggaacagagggtcacgagccctgagcccacgcgcacacaccgccaaaagcttctagggtg

SEQ ID NO: 141117 - DNA, 667 bp, Homo sapiens
aatgagataatcagcaacacagtaatagtgggggacttcagtactccactgacagcactagagaggtctttaagacagaaagtcaacaaagaaacaatggatttaactggatttaaactgtaccttggaacaaatggacttaacagatgtaaacagaacatttcatcgaacaactgcagaatacacatcctattcaacagcacatggaactttctccaagatagaccatctgataggccataaaatgagcctgaataaatttaagaaaattgaaattatatcaagccctctgtcagactgcagtggaataaaactggaaatcaactccaaaaggaaccttcagaatcacacaaatacatggaagttaaataacctgctcctgaatgagcatcaggtcaaaaatgaaatcaagatggaaatttaaaaattgtttgaactgaatgacagtaatgacacaacctacccaaacctctggaatacagctaaggcagtgccaagaggaaagttgatggccctaaacacctacatcaaaaagtctgaaagagcacaaacagacaatctaaggtcacacctcaaggaactagagaaacaagaataaaccaaacccagcagaagaaaggaaataaccgagatcagagcagaactaaatgaaatttgaacaaaaaga

SEQ ID NO: 141118 - DNA, 284 bp, Homo sapiens
gactgctccctcttcacatcctcattgtccccagaagagtcagtagcacctggggatcttgctgtgccttcttatgctatcgctcagtgtagcagagtctgggtaggatatagaatttggcatccactgtgaaggaatgagcctcgggagttgtctcaacaaaatactctcactggaagagagggccagggaaggggcaggagtccagagacactttgtctgaagagggaggcggcagggggatcgcgcatgagcagtcgagctgactaggcattagaagcgta

SEQ ID NO: 141119 - DNA, 281 bp, Homo sapiens
gcaatgatcactgtgtgggtggattcaagaaccccctgcaacaacctgaggctctattggggcttgatccccaagttgggaaacaattaatctataataagacaggagatgggaagggtagcaatcatctttctgtgtttcctggatacactgcattatagtaacctccacgtggtagtgtgttgttaattcaagttgcctggtgtaaaaacaaacacagaaacaaaatataatgtaatataaataacatttcttcttcaaagaaaaaaaacctgacatta

SEQ ID NO: 141120 - DNA, 250 bp, Homo sapiens
ttgtcagtcagctgggtcatagatggaaagttaaaatgacctcctaaggtcaaagtttatatggctgcataatgcagtaaatgggtcgaattggtacccacaacttctgtcagtagggtcacataaggagtgtgtctgtctcattgactataatttatttcattcaacagcaaagctatatttgcggtggcactgactgtctgaattttgacaacttcattttgggctttaatagaaatgtagtttgctg

SEQ ID NO: 141121 - DNA, 449 bp, Homo sapiens
gttggatgccaaggtttctatgatcaagactctagtccaactcttaaacaagtcagcagtgttggagaagaagctgctgggtatcctggccccaagtcttcaggaccttgaagttttcctttagacccacccatctggagaagatgcaattggtggtaagcctttaatccagaagagattttcaagcagggtaggtatgagatgctgggtttttaaaaaatctttttattataatatttttcaaacatacagcacagttaaaaggactttacattgaaaaaatatacaatcacagcataattctatcctttatgttgtcctataggtgttttatcacttaggtatctatatattcccttattgattaatgcattttatctttttgatgcatgtgaatgtaagtttcagatgtcagtgcaattccccctaaatatttcagtatgcatata

SEQ ID NO: 141122 - DNA, 527 bp, Homo sapiens
tctccacctatgctagacttagatctcgtttccccgcccctgaaaggccctcgatgtctccgactgtccaaattccacctgcccatcttttatggaatgggtctcaaatggtacttccttttgttctgggtgggaaaataatagggtttagactcaaacagattcaggtttgtggtcaggtttcatattgtcccgggggcttaacatagggcaagttacttatattccctgggcctcagtttcctcaactgggttctcccctacttggaaagactgagatgatcacagaacacaatgtgagaagagaagccagcactctcctggcacagaggaggggctccacagacagctgctcacgcccatctcccaggaccacgtcctcctctcattccccctgcgcaaggcctttagatcctagttctctcagagccctttccaggccctattattctagtaattagattactagtcctctctccaaactccatccaactgtaagcacctccttttgtttttcacctaacaaa

SEQ ID NO: 141123 - DNA, 260 bp, Homo sapiens
atattttctattgtttatttaaagcatgcagtatttcaattacatttggattaaataaggtttttgtaagctggtcttgaaacttaatcaccgtctgtagcaaagtgttatgaagaaatatgttctaagactaacaaattactctctacaatacagcctgttgtaaactgaaaagtgtttcttataacatcgattttcatgtgtgggttttgtacccagctttgttaaattatagtttcacccagaatgttgcttttcag

SEQ ID NO: 141124 - DNA, 192 bp, Homo sapiens
ctcatctgtaagatgagaataataaataccactttgctaggcattgggaggatgaaatgatttcacacatggaatactccagcactgtgataaattccatccattcattctgctgccacagatcaagaggagttgaatgatagtgagaccatcattcacttgagccaatccttcccctagtgctacgattct

SEQ ID NO: 141125 - DNA, 226 bp, Homo sapiens
gctattgattttataacatctttaaaatcaggaataaatcattgtttcatgaacaaagagacatgtttatttcaaatttgggatttttatatgatttatatgtcattaacatgatacgctctactttccaaacttgcaattttagtggccaagtagagacttctagttcaacataactacagcagataaattctattacccacattttttaatgtttaaaaagaaa

SEQ ID NO: 141126 - DNA, 428 bp, Homo sapiens
cagtttcaccatgctatgaatgagatcatcctgttagataccaggaagagagagttttattaagtatataagtagaggcatccaggtggcagtttgaatcatcgctgctctttagtttgggggacgtgtagtaaagctgctcaccatgagaactttagaatcacactgccatgagttctcattttggctctaaatctccctgtggccttagagaagttaattcctctgagcctccgtgttttgtgggcttgaattcgtatatattataaactgctgtgtgtggtgcttggcacgtggtagcgtgagaacatcactaggttacgggtgatagttacagtcagagtgtgggtaagagctggggagagctttggaatgagaatagacatagcctagaataccaccctgggcagcatggagcaggagggaca

SEQ ID NO: 141127 - DNA, 266 bp, Homo sapiens
agaagaaaagatccagacatttaaggaaatttctgtcaggttacaggctgaccagagacaataaaaagaccaagaacctcaggaatacagacttcgcaaaaataacttggaaaattcactacacaaatgaactgcagccctcaacaagtaacagaagcaatccctgaggagagggataatctgatttccagagctactgcagtgtcatattcaaactgtacagtcctcaacacaaaattacaaagcacacaaataaaatggaaaat

SEQ ID NO: 141128 - DNA, 253 bp, Homo sapiens
agaatataagacatatttggagaatggctgaccattagtgacttgagtctaaaaagaataggccaagaaggtttggaaagtgattaggggccagattgtggagagcttttaaaaccatgtttaggaatctggattttctgtgaactttattattttgtattctctttggaacggtgccttagataaatgcattattttaagggtcacccacttcatttggaataatatgtgcttaacgtttcataaggcttag

SEQ ID NO: 141129 - DNA, 1213 bp, Homo sapiens
ctgactgctgctcacactatgcctgtctctgaatgcttcagaagttcatagacaaaatctgtcagttccagcctctgttgctgatttttacttgaaaggccatcctcatcccctccatgcctctgatcttcacatccttccagacccagatcatgtcccatctcatgaatatttacagggccacttcctcttctcttttgttctgttgtctaaactcttatagtctttacaacatttatttatatattgtcttagaatatcatttgatatggggtagtcttttctcctcctcatttaaatatggttctaccatccccaccatggccatctccaactacagcttttattaaaccacttgtagagtgaatatccatgcaggacaggctctctgtatttttaatgtgttatatctaatacaacaaccttttggataatgattttatctaaagtgtgcaattgaggaaattgaggtttagaaaggttaatagtgagtccaagtaagaatcatctagtaagaatcagagctaagttcaaagggctaacttcaaaatccctgatcttcccagactaaactcatagatgacacagagactgagcaagggaagcttagttaccttgacttggtattaaatgaaataacagtattcccatagttactactaaggaatcttgtcctttcttaagatgactaaaccacattggtagggagacaaccatagaaaaactgagaatttgcatccacaaagaggagattatattacataggtctcaaaattggagttttccctccatcaagagccactggtacaaaaccattaatggaagtatttaagagatgccctctctgtcacatatctgctgtgggatttaaggaaggaattttctcttctaaacactcacacatccaaactagaaatccatgtggaatataagccacgttatgcccctatattgacatattagttcaaaactctgatggcatgcagttgtgagagcagcagggaggaaaattatataacctgatggcaacttgataatttatactttgagataacttattctggattttcctcacttgtatttctccacttggccacgtacaaagcaacagctgcagtggtcgttttggagttcctccaggatgtgaatgtgagacctgccaatcttccctcctcctttcctgcaggtacctacctgcagtgactctattggc

SEQ ID NO: 141130 - DNA, 308 bp, Homo sapiens
agatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttatttta

SEQ ID NO: 141131 - DNA, 281 bp, Homo sapiens
ggtgcagtcacaggtcactgtggcctcaaactcctgggctcaacctgtcctcctgcctcagcctcttgagtggctgggactaatgcaccactatgcctggctaattgtttggggggccaggggggtggagatgggatctcactgtattgactacactggtctggaactggcctcaagccatcatgccatctggcttcggcctctcaacgtgctggcattacaggtgggagccatcgtgcccagcccactgagcgtatttattaaggaacagaagttggatt

SEQ ID NO: 141132 - DNA, 541 bp, Homo sapiens
aggccgaggcgggcggatcacaaggtcaggagatcgagaccatcctggctaacacagtgaaaccctgtctctactaaaaatacaaaaaattagccgggtgtagtggcaggcgcctgtagtcccagctactggggacgctgaggcaggagaatggcatgaacccaggaggcagagcttgcagtaagctgagatcatgccactgcactccagccggggctacagagcgagactccgtctcaaacaaacaaacaaaaaaaagagttgcagggagcccagactgacatagggaaacccagggaaaggagatagggaatagattaaaagatggataaataaatgacggggagttgctgatccctcttgtagccattcctttttactgtgttctgttcatattttctctctgattctctgactactttccttttgttttttaagtttctcccttttgacatttccctttttagttgtctaaatttttttaaaaaaattgttttggatgtcacaccttcaaggctaatttctcccaagtaaagctctg

SEQ ID NO: 141133 - DNA, 459 bp, Homo sapiens
ctcctaatctaatttcctattttcttaccctgatgtattcatttcatttatattgcactgttttattgtatgtctttaccataagctgcctcaaatatttgtgaaacagatggtatataaataaagaacattggaatgtttgagaaagttgttgttgacaagaccgatgaagatgaaaatagtgtagttctgagaaaatgttggttgctgtggcatctgctctttttttctcccttgcactcttatctcctggggtggtccatcttcgttaccttcaactcccatgacacccctgctgtggctttggctgcattctggagtcttctctatctccgccctcaccctggattcacaaatgcagatctgtatttctgacttccttcctattggatagctccatctgaatgtccctaagtccctcaactcaacacgttcaaaacgaggctcagcatcctttcc

SEQ ID NO: 141134 - DNA, 138 bp, Homo sapiens
gcggccgcctactactactactgctcgaattcaagcttctaacgatgtacggggccatgctgttattttaaaaaaatgttattacagaagtagtacaaatactttgggaaagtttagaaaatatagttaagaaaaata

SEQ ID NO: 141135 - DNA, 165 bp, Homo sapiens
tccatttgagaagaaaattttttgcctttcaccatagcaatcaatatacactccattgtcataatgccacaccttcaacatgaatttaaaggcataaaaataagtgttgtggaatcaattagcacaatcttttgggactttgcaccaaaacacaattgcacattg

SEQ ID NO: 141136 - DNA, 190 bp, Homo sapiens
ctgctagagttctgatgtttaaaaccacaggcttgcgatcaaaataacctctttaattttagattatcatgcagattaatttcttcagtttctcaggcactattctgttttttttaaaaaaagggtggggtttcaaaagaaaactaatactcattttttccccgattaaattgctcaaccattaaaaagg

SEQ ID NO: 141137 - DNA, 265 bp, Homo sapiens
ccatctcaattaaaaaacaaaaaaattgtagagatggggcttactatgttgtcaactcctagtctcaagtgatctcctaccttggtctcccaaagtgctgggattataggcatgagccaccatacctggcctggattgtgtttctaaagcctggcccatgaggagcatcttgtgctttaacaattcataattatggtacctgacatgtgctttagtactggtcggcggacatgaatcagtagcttcttttggtattactcttatt

SEQ ID NO: 141138 - DNA, 625 bp, Homo sapiens
gaggtttaagacacacctttttgtaagcaagtcaacaaactaaaatatgttttaataaattacgtaagaaacatggaagagggccgggcgcggtggctcacacctgtaatcccagcactttgggaggatgaggcgggcagatgacgaggtcaggagttcgagagcagcccggccaacatagtgaaattctgtctctactaaaaatacaaaaaattagctgggcgtggtggcacacgcctgtagtcgcagctactcaggaggctgaggcaggagaatcgtttgaacctgggaggcggaggttgcagtgagccgagaccgcagcactgcactccagcctgggtgacagagtgagactccatctcaaaaaagaaacatggaagagagagcactttcagcacatgctggagactgtctcttcctgggtaaaaataataaaaattaaagaaacatatccatcatattgttataaaaattcaaacaatgcccttgggtctgtagaattaaatataatactcttcactgacaacctaatcctctcatctactgtcactaacttcccaaagaagtgttgacaagttaaagcatatgttctagtaagtaatttttctattaatttatatacata

SEQ ID NO: 141139 - DNA, 256 bp, Homo sapiens
cactccacagtgtcctatagaccacaaattccacagggtgcagacagtcaagggaatggggacatggataccaaatcttaatagacgtaaagtcatattttgcaagtgtgtgaatgaggaaggagagataatcaggactgtatctgcagcctaccacagaccctcccagccctctttgccaaggctgaggatatttatcacgccccctggtaatcccccaaccctctcctgtggggcaaagagccttgcatcattc

SEQ ID NO: 141140 - DNA, 352 bp, Homo sapiens
ctctgtcctagtaaaagtaatcatgaaagattcatataaagaaaaatctagccatccatctgcttaagaaacaaacaacaggtcttagtgcagtgccgtcatttcaggccaaagacagagtgtatgtgtgtgcatgtatatatgtccgtatacagccaaagaatctagatgcatatgctatctatgttctcttagtcagagccaggaaagaacttggattctcagtagcagttcagttcagctttgtaattattggcagagagagaggcaggaggagggaggagagagagaaaggttcctcacaaagccagacccatctatcttgttcttctttctcagaggcagcaactag

SEQ ID NO: 141141 - DNA, 916 bp, Homo sapiens
agcggcttgaccttccattttcctccctttcctggttgttctgcctgtgccctcctggcacatcagcagtcactgcaggcacatcgacaaaagacaccccaccgccacctgccttgattcacaaggagcacaacctcgtctgaaggactccaatccacagagttaggaaccctcatgggaccctgctcatcctgagcccccagctagcatgtgagttccctggggctctttatggcacttccctcaagtggttccatctacttaatgagcctcatgtcaccttatgaaccactgcctttaatataccctaccctacacacacacacacaaactccatatcttccatctctccctacccctaccacaacccctttccttccttgcagaattctgctgataatttactagatgccatccttggggcttggctcaattcaatccacatgaagttcacaaacatgtattaagacaatctatttttgaggtatagaaggtaccccaggtgactaacacaaagttcttgtagccaaggagctcagagaacctgaagataccttcactgtccttcacagttatctcaaccttcagcattcccccagagaaatgctgccctctaggaagttctctccaaggaatcccacccctgtcctgagtatttctttaatctacaactttcctgaggctgtgtattgcacagggggcgtgccaatgggttctgcacttgtgtccaacacccttggtaaatcgacctttccagaggactttggagcccttcgaggattctcagcatctgcatctcccaggagctcccagcatgcagttggcacttgatgactgtttgtagctaaggtacttaggctgattttatttaatctttagtatcaggctgatattttaaaaattccaatttaaataa

SEQ ID NO: 141142 - DNA, 321 bp, Homo sapiens
ttttagtagagacggggtttcaccgtgttagccaggatgggctcgatctcctgacctcgtgatctacccgcctcggcctcccaaagtgctgggattacaggtatgagccactgtgcctggcctgagtaagaccctgtttcaaagaaaaaaaattttttccttttgctttctagttggagaccaactaaaccaagcctgtatttaagagcatatggttgaaagattaactctggaagcagatggacatcagtttgaatccctatttgcctcttcttaaccgcgtgactgggccggcccggccgaccccatctcttaaaaaaa

SEQ ID NO: 141143 - DNA, 502 bp, Homo sapiens
  misc_feature (32)..(32): n is a, c, g, or t
  misc_feature (51)..(52): n is a, c, g, or t
  misc_feature (83)..(83): n is a, c, g, or t
actgcggtttctggtgtgtggtgactctagtnctgagcaggttgtataacnnatcctaatctctaaatttgggagatcccttnaatctttccacatgctcccctaattagactctggccagtacatggcacagaggggctttatggtttggtacaggcctgcttttttgttgttgttgttgaaaagagggagttttgccatgttggccaggctggtcttgaactcctggcctgcctcaagtggactgcccgcctcggcctcccaaagtgctgggattacaggtatgagccactgtgcctggcctgagtaagaccctgtttcaaagaaaaaaaattttttccttttgctttctagttggagaccaactaaaccaagcctgtatttaagagcatatggttgaaagattaactctggaagcagatggacatcagtttgaatccctatttgcctcttcttaaccgcgtgactgggccggcccggccgaccccatctcttaaaaaaa

SEQ ID NO: 141144 - DNA, 257 bp, Homo sapiens
cagactgccacttccttgctctgaatgaagctcctaactcacagttactgtgagaattaaatgagttatacatgtaactcagagctgggccacaggaagcattcgaggaatgttggctcttactatagtaaagcctttcaacgtgatccactgccttcacaagaggtcagactctgtggcttacacgaccctcatgatatggcccctgctaagatcttcagtccccttccttaactccagacatcctaatctactgg

SEQ ID NO: 141145 - DNA, 185 bp, Homo sapiens
tctctagaatttcaggctcttctgtaaatgaggctgttggacaagatgtggcaaagattccaggaggccagggttttaaatttgagattagaatcttagtggaattttttgaattatggtttctctggctcgctctctccctacctcccttcctctgtctcgctctgtccacacacatataaaca

SEQ ID NO: 141146 - DNA, 437 bp, Homo sapiens
tagcagtcttccctccagtagcacctagttgttgggtccctcttgctttatctctcactcttggacaataattcaatgatgaggctcagagactgaatgtttcctgaaactgcactgttctacctggcaccaaaggtgccaggttctaaatatggtgctcaaggtgtttgggttctaaatatggtgctctattcaaagtattcttatcactttgaaaccccactgctccttgctaatgtttctgaaatcactagtactctgggggagaccctggttttcttcaagtgaagctatgtatcactttaggtattcctgaagaggtctgttctctcctgctctctctccctaccttgaaattttacttaacttttacatatacattgaactcaatttcagattaccactccacacctcaccattcccctagaacctgtttt

SEQ ID NO: 141147 - DNA, 262 bp, Homo sapiens
tttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaat

SEQ ID NO: 141148 - DNA, 374 bp, Homo sapiens
caatcatatcacccatgggtggtgattttcttccctttcttctctcagtaatggcactgagaacacaatgttctgaacattgtaaggcagaacacatgaaaattcctagagagaagatctgttctatccacccctctcctccattcagcatgctgtgttcccactgtggttctgctgttggatagcaaagtctgttttgagagcttcaaggtaagagggtctcaaattgtggctagatgcccaggagtgattaagcaattagaacattcagacattgctaattgcctacaactcagcagcagcagcccatctcctgggccactcagctccctaacaaacgagacctttgcagagccaccagggttctctttttt

SEQ ID NO: 141149 - DNA, 130 bp, Homo sapiens
gggggaactagtgctggcctgctgccactttcattgcataaaagaccattttggggactcagagccctgccagctaattgatatggacactgttaactcctcaggaatggagcctgaaaatgtggggcac

SEQ ID NO: 141150 - DNA, 153 bp, Homo sapiens
gaccagccgagaaggctgccaagggaggtagagacggaggaggaccggaatgtcggccacggttcaacccaggggccagcccgcctcggaaagtcctggggcggaagggcgaactaatcgtccccctaaaacacagcgtagacccacgcggcg

SEQ ID NO: 141151 - DNA, 305 bp, Homo sapiens
ggacatgcagggctttcaggaagcatgctactgagtctcacctagatcctgtgggctgtagggacagacccacaggagggtcttcagcagaggagggagcagatgggattcccattgggctactgggtaagaaatgaactgtagggatggggaaggagagggaggagcaggccgacctccatagtagttgttacagctgtgcaggtgtgacctggaacaagaaggctggggaagtaccagagctgtctgtagaccatgcaaaggtagcatcctattggcagcaggtatggaggagaggagggaag

SEQ ID NO: 141152 - DNA, 805 bp, Homo sapiens
agacaatgtccctccctctaggtcttctaaaaaaaagaccagtacatgaaaaataattgtaaattatgatacaaaacaaggagcagaatagggaagaactaaagcttggggcagaaatgaggctggctactttaggtgggatggccaaggataacatctctctgacatttgtgttaagaattaaagccatataaagtgcttcccagggtgccagaccaatatggtatattcttcataaatatgctacatgaagagtgggaagagcaaaagagcagaagagcattccagctggaggagcaaacatttgcaaaagttcaagatgggaagatctcggccctttccaggacttgaaaaaaggcccctggctggagagtcatgagagaagggaagcagcttcagatgaattcggagaggtagaagcagccagatcctctagagccttgtaggccacagtaagggggttgagttgtaatgcaaggcagagttctcaagctctatcatgaatcagaatcacctggagattcaatagagattgctggaccccatccctagagatggggaccttctaataagtttgcatgtggtgccgatgctactgggccagagaccagactttgagaaccactgctgtaaggcagtgagaaccctaacagaaggatgtttcatataattaatttgcaggacttagtaactgatggagtgtagggttaaagagggaaaagaatcaaagataattctaaaggtacagtcctgtgtgatcaggaggtaaaacatataggaaaaattcttgttttttgagacggag

SEQ ID NO: 141153 - DNA, 186 bp, Homo sapiens
tgagaatcacttgaacctgagaggcggaggttgcagtgagccaagattaccacactgaactccagcctaggtgagactccatctcaaaaaataaaataaaataaaattctgagtttcattttgaggtgttatcttacattacccaataagcattcctgaaaagtgtatgttttatactctatcttt

SEQ ID NO: 141154 - DNA, 487 bp, Homo sapiens
catgccctcctcatacctctacatatgcactcacccacgcactgatgtacacatttatttcagaacaagcttcctgagtctgtgcaagctgtggattggccagtgctgctccaacttggggccaccccctcctctcatctcccctcagggaggggttgtctgggtgctctctcaaaagtcctgttctccttcctcctccagccttgccatcctgcagccaggtggccacagggcaatgacttcatcctcccaagcccgtgtttcctcaatctgtaaattggggctaatggttcccaccctgcttgcctcacaggggggcaccaagcattcccatgagataagggacagcagagtgttttgtaaactgcaaattgttttccaaacaggcaaatggtgctgttgttttcccagctatggaactcaagaattcctccacccacaagtaaaccctgtccttgggtggaaagggatatagtggtgatggtga

SEQ ID NO: 141155 - DNA, 465 bp, Homo sapiens
gctctccatacttccgcacctggagaccaggctgagggtggggtggggcatgaggctggggggctgaacttggctcaggcaccggcaaaggactcagtggccccttggaccctctgcgtgtcctccctgaggggcggggtccagtcgagtcagttatcactgagtttcagcctttggttcccaccggtcaaggaggctgccgccttcctgtgctgcctgcatccgcagttattcgtcatttcccatgacatcaatctactctttttctcttttctttagagacagggtcttgctctgtcgcccaagctggagcgctgtagtgcaatcacagctcactgcagcctcaaattcctgggatcaggcaatcctcccacctcagccacaggagcagatggaaccacaggcgcacaccatcatgcttggctaatttttaaattttctagagacaggggtctccctacgttg

SEQ ID NO: 141156 - DNA, 469 bp, Homo sapiens
ttcgataacaggatataaaggtcccaatgacatggggacattttgaggtttttgtttgtttgtttgtttttgaggtgatagtatagttaagtcagcattgaccagattttgaaatgattaatattatgatgactataaaatctgggaaaggaacaatctccctgagtatagaaagataaagcagagaatttgagccagaaattatgtccccattgagagggtagaaggagaaaaatgctctaatgaacagaaaaacacataaaaaaaccttttgttctgaaatgaaaacgtggactctccactgtcaggtatgccagagaagtaaaaatttcaagggcctgctcaataaagcccagtgctgtagcaaaaatccaaaggccattatggattctggaaaagcctttatttttctatcttcaatctcttttccaactttcatttaatttctattttattgagaaaccctgtg

SEQ ID NO: 141157 - DNA, 284 bp, Homo sapiens
agacaagagagctaagattcagagctgacaggtcagctccagaggtgacggctttgacccttgtgcccaatggcagggtgccagcaaaacaccatcatattttgtctcaaaaggttatgcagcatgttggtgataagtccctagaataatgtttcccaaagtactggatgcttactatggggcacacaagccaattttaccaaacagcactgaaacacacactgaaacactgttccttttaaactcctcttttagtcctgatttttgccaacaagaaagcctta

SEQ ID NO: 141158 - DNA, 1154 bp, Homo sapiens
cactgccatcattggaggagaaaaaaacagggacagaacacagaaaaacatctgttaagtctgtctttttaaataaggaaacagcaaccacattaaccaaaatccagtatgtttcatagtattctcttgagattggcttaggaaactgtcagaggaacaattagaaaatagtgtcttaggctacattcaaacagtttaaacatctgatggtgcttttctctttcttacctaaaagagctagggtacatctgaatttttagacttgactgcttttctgaatggcattttgtaaacttcatttaaatttcaaaaatctttttgagctttttcaaatgataggtttttaaaaatatttttctatgtgatgttctgttcttcaaaaaacaaatacattaaaaactattattgtgggaccatattggcctgaaaaaaaaatctttcttaattgagcataaacaggaataaagattaattcaaaatagtttttcctccttcttttggaatgtggcatccccatcacagttaatgatgtaagtttttcaaaactgagtcagggactagtttatcccacaatgcgacaatgtgggcagggtaattgtaggttgggctcagttttcttgccagagttctaatgctgtttgtgtaacttacctctaagtggaataatttaggtacctataaagtaagggctcaataacaataaccttaatgatggctaatatttattgaacatttactgtatgataggaatttggcaaagttttttcatgatcttcacatcaactttatgaggtagataatatccacattttatagctgaggaaactgaaatgtaatggttaaataacttaactaggctcacacggacagtaaataagctgtatgtccaagattacaatctagacagtttaactgtggagcctgcaccattaattgctatacagtatcataatcatcaccaccaccaccatccctactgtctctcagatcgatttttaggatattggttagatgaaacagagtacatgtgatatatagccaaagctctcttctctataatattagctctcacagccattggggtcttcaaccattcagagctgataagcaaagatatcagcgtactggaacacagaacagtgccttgcatacat

SEQ ID NO: 141159 - DNA, 343 bp, Homo sapiens
tttgaatatgtctttacagtccaaattaaattaaatgaattaatttaactatcagtggaagagatcttcttctcatataataagtctgtaatttcatactgtagagctgatgaaaagtaggcaagacactcatgattttgactctgatggaggtgctgatcaaaataaaaattatttataggcagataacaggaaggagaaagaataaaaagcatgaaaagctaaaaaaaaataataagcctgcataattagctcctaagtaaggggcagactatacagtgtagttttgaaaatagttatcttagttgacctctggtattctggataaatgtcctaggggaat

SEQ ID NO: 141160 - DNA, 573 bp, Homo sapiens
ggaatgggtggttgaagtggaagtgcacacagatttgaaaaaaatcaaggccttgtaaggccaattgtaaggccatacttgaaaacattcagggtggcagaatttgggatgaagactgcaaagcagaattgaggcctcagtgactcctgcatagtgactgtgagattgatagataacagagaactggtgaagtaaccagatggcatttgggccttctgaccctttccagacttcatggaagtggcagaaaactgtagccaacatcagggcctcaaattgtggttccaccagtgactagctacatggccttgggccagtcaatttaacctctctgtgcctcacttgccttatcagtaacatgaagacataatagtatcctcaagtaaagtgcttacaataaggccagccacatgtaccagagcactaaatgtcagcatcatgaccatttctcatttgaacaatgagggctttgttaacagtctctaaggcacagattcttaaatattttggtctcagaatctttttacattcttaaaaattgtcgaagacgccaaagaacctttttttttcttt

SEQ ID NO: 141161 - DNA, 330 bp, Homo sapiens
caggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggt

SEQ ID NO: 141162 - DNA, 191 bp, Homo sapiens
aaggtgtcacgccatgagaataattaatattttgatgagaattttctctttacaatgcatgtgcttctctaaaagtaaaagaaactgctctaaaagaaattttaggatcccatggagaaagctgggttcagggatgttgtgtgactagcacaggtcacataacaaagcaattcaaagcaaagaaccctgac

SEQ ID NO: 141163 - DNA, 419 bp, Homo sapiens
ctaaaattagtgggtgaaagttgaggaaaaacaggatatttatatgcctagcttacctcccccaaggtatttgtcaattacaaagggtaaattaggaccttacagtagagaaacctggtaggtcctgccctaaccaagtgatcaaggtcacgacataggaatgactatcagctcaagtatctcttgatatgatgtggagaggggcctatcgattctgtgttgttcttgccaaaaatacataactgcaatctaactgtgagaaaacatcaatcaaatccaaattgagggacatacaaagtaactgatcagtactcttcaaaagtctcaaggttatggccaggagcagtggctcacgcctataatcccaggattttgggaggctgaggcaggcagattgcttgagctcaggagtctgagac

SEQ ID NO: 141164 - DNA, 207 bp, Homo sapiens
aaagaatttgggtggaattcaagaaaagactctgggccaattacagttttagcaggtaaggtcccaaacaatgccagaccagacaaacagcttcaggctttgaaactaaagacagtggtctcaggttgtgtgacaaatagaattctatgcaatggcctgtctgtctatatagtctctcacacataagagcaatcattgccaataatg

SEQ ID NO: 141165 - DNA, 509 bp, Homo sapiens
tatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttactgcgggtggtgtgtgctggctgagaagccactgtgaattgattcttcttctgaagtttatgtttctactttttggaaatgaataaattacagccagtccatcaaggaaattgca

SEQ ID NO: 141166 - DNA, 416 bp, Homo sapiens
agcgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctc

SEQ ID NO: 141167 - DNA, 299 bp, Homo sapiens
tctacacacaacagaacaagttcgtgtggcccactcacaacacaatggcagctgcctcaacaacacgttcacaccaagcaaactacctgcttacaccattccaggtatggcttgctggaacccagaataagagttttcagtgttttgcttacatatatgtatttactatacaattgaatggcatcacatttttaataaagtggaaagctactcaaggcatgagattaagtgaaaaaggaaggatacatatagtctcacccctactatagtatagatacatatagtctcacccctactat

SEQ ID NO: 141168 - DNA, 322 bp, Homo sapiens
acattgcaggcacggaggctgggtgcagggccaggaggcagaaggtctcagtttcaggtttcaggcacaccctgaatgcactgggtgattcaatcatgtctctttccctctatagttttttaatttcctcatttgtactactcaccataatcccgaaacagtcttacttctgccccctggtatctgctcaccatctccttgcctagtacattctttcccactactctttgcctagctaattccttcccattctttaggtctctgctctttaggtcctattctttaggtctctgctgccttctggaaaccttctccagccact

SEQ ID NO: 141169 - DNA, 619 bp, Homo sapiens
agctgttctagaggataccttcccatttaatcctgcgagaagagccagaaacaatggcttcacaaggacctgcagccaagctgaacagcacagcacacacgaggaggtggtgtatttacaaataagcgaagaacgctgccgagagaaacacacagcaccggaagaccagtgtgcgtggaggccactgggccacacagccaggtgccaggagttgcaactcacctccacaatggcctgcctgctggcggggcaaccttacaaaatattattattatttactcataacaataacaattgctcggaaaataaaactcaaaacaggcaaaaccattggaacaccaagacgagacttctacaggttttattttaaacatatgtttctaaaacagtcagtggtgagtgccaaaaaacacagcatcaagtcgattttcctttttctgtgtacatgacttgctttggaaactgcctatacatgccctacatttttttctctcatcaaaaacaatcgaggaatggtacaaggagttctgaagcataacctagtcgtttcattcgagtggcgagagagggacgtgatgtgatgtgggtgccacgtaagtgtcgtgctgggggcagttgg

SEQ ID NO: 141170 - DNA, 335 bp, Homo sapiens
accacctagaaatggtgtttttaaatttcttaatatatctccttcttgtctttttctatatatctttatttcatagtcgagacaattttatactctgaatttttatcatataagtatctacccacattatcaggaatgctttgtaagcatcattttaatggcttcaaaatagtctatgatttagataacgatgatttggccatttttgtggtcacctaccacttattggagacatattatattctgagaatattatgccatttataggcattaattccaatatgcaaaagaactttgaaatgaaggcgttattattcccaattttacagatgctg

SEQ ID NO: 141171 - DNA, 616 bp, Homo sapiens
catggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttccttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaag

SEQ ID NO: 141172 - DNA, 299 bp, Homo sapiens
gtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctttaatcccagtgctttgagaggctgaggtgggaggatcac

SEQ ID NO: 141173 - DNA, 160 bp, Homo sapiens
aaggggggagactgcactgacagatggggtcctgcctctagaagtcaccaaaaggggccctgacagctgcccgtgaaccccagaagggccatcacagggaggcaggaaagctgaagtagctgtggggtggctacaaggagggcagcctcagaccacgtgg

SEQ ID NO: 141174 - DNA, 535 bp, Homo sapiens
acacaagccaccacaccagttgacttttgtattttttacttctactttttttattattattattttcatgtcttgagacagagtcttgctccatcggccaggctagagtgagcaatggtgtgatcttggctcaccacaacctctgcctaatgggttcaagtggttcttctgcctcagcctcctgagcagctaggactacaggcatgtcccactacaccaggctaatttttgtatttttaaatgtttgatggggaagtatgtgtaaagacagggttagaggttctgccatgttgcccaggctggtctcaacttcctctttttttttctcttctaatccaactttcagtttgtttccacagtacttagagtgacttgctattgttttaggttttacgttcttctctattttcctatgctcctttttgcatgctgaagtttacctttcagattttttctttttgtcacactccagccagagtgtgagagaaagagagaagattttaattgtgataattatcttttacctttgttcact

SEQ ID NO: 141175 - DNA, 718 bp, Homo sapiens
cacctcagcttcccaaaatgctggaattacaggcatgattctgattttaaatatttttgatacacagttggtcagattggtccgtgtggaactcagaaacagaaggccaaccatgcataacgaggcagaacttttggagatccttggtgacctcactgttgctgaataaactttagcccctcacctggtgataacaccaataccacctggttttcttccaggtatgtgcaaagtgtttcacttctgtgaacaaaaatatttgaaacaaaaaacaaatttacttcgttagcttgtagacatctgttgttattaaacagaccagtgccttccttcactgtccatgaacttttggtcctgttttttatgtaagcctatttctcctcatttattcactcttattttcaaagtagcatttgcccaacttttacgttgtcatgtattcagtattctccatcccaacctaacagtgaagagagcacattgtggcaggtgccttcctcttcttattgctgcatgattccaatccaatttcatggcttggtgcagggcctcttggtaaacgtggactccgttgttcaaatctagagcagacgccttctgggcggtcctacagatttacatcagtgaaagagatgagccggctgtgctgaccttttttgaggcttgcaatgtattcaaatgtgtgagatggttaatgcagctgtcaatattaatacta

SEQ ID NO: 141176 - DNA, 377 bp, Homo sapiens
caaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaact

SEQ ID NO: 141177 - DNA, 416 bp, Homo sapiens
cagtggtggcagggagagttatgggatcacctgtgaaacggaccaaggcagggatgggagccctctgtgcagcaaaagtggatgcaaggcctgcctagaagcaagaggatgaaggaacctagttgggtcctggtccactgcctgcctgtgttcacaggtcaaccagtaaaggaggtggggtagagaattcaatcgtgggctatctatccagagatgtgtttacaggtgtattatttcacatttgtgttcacgtttggtgtcaaaaacacatttatacatgcctatttcatgtttaagtattttcacattttagttaacccttaaatatcattgttgaatgcggttgtcattagacataaacttgcatattcactgaagcttttgtttttattttaatcaaatttataattgtgcac

SEQ ID NO: 141178 - DNA, 302 bp, Homo sapiens
tttttttctttactaataaaagaaacacactcccctgtgacagaagacaacccaaaagatgaggcttggaagtcaaaaagcatgtctgcatacttaaaacggtgactctgtcctggggccatgttgttattgtaaagggtcagcaaatgcattcgtacaccaagcaccagcagtaggcagaataaatgtcacagaataatatattatgatgcccctaaggtacagagaagctactatatttaataaaacacaagtttatttcagagagttaccgagttcataatcattctgtcacaacatat

SEQ ID NO: 141179 - DNA, 466 bp, Homo sapiens
agaaagtggaaggctcatcaagtttatagacaacagacgtgtggcctgtcccctggctctgctgcctttctctgagattagaggagtggaaaaaactgtccaaacccaggaaagaagatgagagccaggcttgccccctcacctaggtttgttctgctgttcaagtataacatggaaatatgttgccccatacagatctagctttttccagaaatagggcatgcttactaaattgagacaatattgacgtacatgtgttagcttgtaaagggaagcaaaatacttcacagtgaattgttgctaccactctggtgtgtatgcgtgtaaatgtttcatgcagctgtgtgtacactttaaaacaattgttaacataatggcaccatactctatatttggggcttagattggccttatccattttcaaaaaatagctttattaagatttgaagtgtataattcagtggtt

SEQ ID NO: 141180 - DNA, 426 bp, Homo sapiens
ctcaactaccagcccttaaggcttatattccagattttgaattctttgtggcacctggacatttcttgttctttctttaaagcttggctctattaaaacaaatttcgttctattttctcaatcttgtagtggaaggaggggttgtccatgtcattttaatctgctatcatacatgagtgcatctgtgtatatttttaagagatatgattctaagtcacgttcctcttgggtttcaatatcttacccatcatccttttcatcatatcttaaattacaaagaaatttatttggatgccccttcttttcttgccaaaacacatgataaaatgagaaaaattgaaaagaatctttaaataatccataccctctggatcattggcttctaaacaaaatgcagattttttctttttaattccattgcttgaa

SEQ ID NO: 141181 - DNA, 246 bp, Homo sapiens
gtccatggtgactcagccagtgtaagccatttcaattctggttagatcatcattcctaagaccatcagtttgatgtcatggaccctaagcctccttgctgtttcctttaggaaaggcagtggaaatttacaggcactgaaggaccctgtcaaaggcaccaggctttggatggagccctgaatgcaatgtgtcacagtgagtatttacacaccaaatggaaggcttttcaagaacagaaggtgcaga

SEQ ID NO: 141182 - DNA, 587 bp, Homo sapiens
aagaatatgtacagaatgcaaagcatgaaatcacaaagggacagaaatgttttaaaaatgaaaggaactataatatagttactacactgtgatttgagcttagatacctcttgacatctactaaaaactacattgttgtggacccacatagcttcacctgctctacgcggtagccttgtacacgtgggggaaaagtgcagccctacataatggtagagttcaccagccactataatggtggtattctccatagcactgtagtatccaaatgttgctgtgataccattatctttttaaaaaatgctgaattatctgcctctcaggatcaaaatcaacgacaattatttgatctacatgaaaataagttaagtatctggacagatttgtgcatgcctgcgacagtcacaatactacattgtagcactgtaaaacaatcttctattgaagtaataattccttctaaagttcaaatgataatgctgaagcccaaccaggtaatgctgcaaggaaacctctgtctgcgaaagatgaaattaaacaaacaaaagctggaactacttccttaaaacacaaaacatgcagatctt

SEQ ID NO: 141183 - DNA, 403 bp, Homo sapiens
ccttgagcagtggcactgagtcctgtggctggcagggagggaagtgagacagccagcagcacaaggacagaaagaggaaagagcaagtctgcagctctagaagggaggggcaggcagcctggctctgaggctccaggtatgccccctgtgtggagctggggcagcggggcaggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacg

SEQ ID NO: 141184 - DNA, 425 bp, Homo sapiens
tatatgcctttaagaaaaattaaaacacagagaactttaactggcatgattttgaaactgaccactacacacatatgtatattcctgttttatcagccgagattacatgacaaaataaaaataaatctattttctattctatttattctgatttttacactttttattaatctacttgctttgttttgaaaccctctactaactgaaaactaaatagtttgccttaaaggaagataatatattgagtcagagaagcagctacaggccatggggtagtaaaattcaaatctgatccaaagttaggtttttcttttcattatattctctaacagttcaatgactaatgtacttctcttctgaggaaaatctgccccgcaaaagaaggcctgctgcaagctgcattaagaaggctgtcttcccctggg

SEQ ID NO: 141185 - DNA, 202 bp, Homo sapiens
caatccccttgccctccaccccctagattattttaaaccacatttctgacttactgttttaaatgcaaatatttcagaatgtatcttccaggaagaagacataatgataataccattatcatatttaagaaaacattaattcaataatgccgcctaatatatacactccagattcctcaattgtctcaaaaaatgccttttt

SEQ ID NO: 141186 - DNA, 389 bp, Homo sapiens
cgcccaccccagcatcagagccatggcaattcccaagaaaatatgagatgcgtgaatatgacaaatggtgtgtatgataacaaaaatctcagagttggagggaggtatctttagagtcatccaattacaacaggccactttacagactgggaaagtgaaagggaatgaggcttatgagagcaagtagaaagcaccccaatggggagtgtggccactgacaccgacgctccagagatgtccagcgaggaaaatgagatgttctccatagggctcagcaacatgggggtccagagctttgcagagcctccctgaagagtactgtggggacaatcctggtggtgacaatacaaatccagggacacatatgctgctgtgggcattcccttaga

SEQ ID NO: 141187 - DNA, 442 bp, Homo sapiens
gtctccaactcctgaccttgtggtccgcctcggcttcccaaagtgctgggattacaggcgtgagtcaccgagccctgcctttagtatctctttaattgcttatctactaatgatgaattctcttagctttgatttgaacacatcttcatttttaaagaccattttcactaggctagaactgtcaggtttttctagcacatcagctcttaagaatgcccatatgttgtcttccagcttccactctcctactcaaaaatcagctgtcagcctttttcttgctcttttgaaagatattaagtcttttttcctctcagtttaaaatttttctctttgttcttagattttaatagcttgaatatgatgtgcctaggtgttagttatctttgcattatattgcttagaatttgctgagtttcttggatccatagttaaggttttttgt

SEQ ID NO: 141188 - DNA, 461 bp, Homo sapiens
ttccttctagcttagggaatctgtttcggtggctcagagaaggatctgttgccaatcagccgatgccaggtctccggtgctggggatggttactaggcaggagaaacaccagtcagaaaaccctggactttcagaactgtgcatcaggcgtcctggcaacctgttgggcaggactgtcaggtggaaagcgggctcgtggggttcgcccctttctgtcggcttcacacatgatctcagcggaccttgcgtgtctgcacggcattctcatttcctggtaagctgtgttttgttttgttttttaaaatttcttctctacctgaggaccctcgccttttgttactagctctggcccatatctgtttttttgtgacggtggttactgtcttttcacattctgtagggggacctgtcgcagtatgtaacattgaacaaaatagacagcaagtcccggggtggccatc

SEQ ID NO: 141189 - DNA, 353 bp, Homo sapiens
ccttgatagctcacaactgtctgtagaagaaagtgccgtctccttttccttctgtgggggctcaaggccttggcactctcaatcttatgtgtcatttcaatctttattcccttggctccctaatctggagttggcacttctgtcaaatttcatgctttgtctctgtacacagcccaaattctccatgtcacaaagacattgctcattctagttcctccatcaaaaattcctcctggtgaggtatggtgactcacatctgtaatcccagcactttgggaagctgaggcagacagattgcttgagcccaggagtttgggaccagcctgggcaacatggtgaaacttcatctctac

SEQ ID NO: 141190 - DNA, 519 bp, Homo sapiens
acggagagccaggcactgcccagggcccaggaccctctggcttcttgcagctcagggcaagtgctgcctgcctatctcatgaaaaatccaggcagctggggaaaccgaggactctgactctcaacagagcatggcctcgttcgtgaccaaggacggcatctctttgcctggaggtcggtcatgtgaagcaggatacacactcatctgtctcacacgatttacagagtcatccatagagtcacagaaggtgctggcagcaccacgtccactcaatactgtggatatcggatagggaacggaaaaggcgacagtcaccgagagtgaatggtcccttgtttctatgtagacagcatgtctcttggtcttatcttattagataactttggaatcatatcaatcacccatcatccaactatctaccatctaccttactgatctgtcatctatcacctagaatctaaacaatctatcgtctgttccttttctctcatacacactaagtaagcaggagacatatgt

SEQ ID NO: 141191 - DNA, 548 bp, Homo sapiens
cagagaggccaagagagttgtaggaagtcatcattaagaaggctcccagggatccctcctcctggtgtcgcccaatatgtaacacctttcctgtgaatgagggctgatcctgctttaagtgaacagaatatggtcaaagtgatagaatgtcacttctgagattaggttaaaaaagactatgaattctgtcttactgtccctccgttcctctcgcttgctgtcttagctcgagctgctataataaaatatcataaactgggtggtttaaataacaaacatttatttctcacagttgtggaggacggggagaccaaggtcaaggtgccacaggtgtctagcgatggcttgcttcctggtttgtagatggcagccttctcactgtgtccttacgtagcagagataggaaggaagctccctcaggactcttctaaggataccaaccctctccatgagggctacacccttagcacctcctgtaatcctgattacctcccaaagaccctgcctgctaatatcatcacattagggagtacagtttcaatatgtga

SEQ ID NO: 141192 - DNA, 312 bp, Homo sapiens
gttaaaagaatttgctagcactttaaatgttggattgctggcgagaatagaaaagcctgtctcccttcaggcaaggtcctgccctgtgcttttgtgtgtacccctctgccctgagaatagctgggctattggaggttcacacagtcaataaccactgaactgcacccgtgggtagctctccagtgctgcctgctcatttaacaggtccttatggagatgggcctgatacacaagtgctggcgatcttcaggacaaacccaataaaatgagagaacctaagcttggcttctaaccttcctgggaaaaggaagt

SEQ ID NO: 141193 - DNA, 392 bp, Homo sapiens
cttaaagcaaactcggtacaacgtgatctgcacttacaaaactaataacaaattaataacaaattagatctctgctcctgttaccaatgaccaatattctatgtgcaagagagcataagtagaaggagacagactttttccaaacaaacagatcccttgagcaaatgccctttaaagtttaaaataacaacccccttgggttgtgcaggcctttaacttttcagagagctttaagtaccttaactcttcttattttattaaaacacccaggtcatgggttggttttttttctttccaagttagttaaataaataagcaattatgacgcagcgccacatggccaacagcttttagcttataaacatagagtttgaaaagcagtacttagaggc

SEQ ID NO: 141194 - DNA, 250 bp, Homo sapiens
taggctcagacatctatctgatggtgtgtgtttctctagcttaccagttcatttagagggactgcctatttagcagaagggaatttcacctaatgacacttgcttccacgtttctcaggcctgatacatttcagtaatgtataattcttttttccaccattaaccatggttttggtgtgtcttttagcaacagaaatgctattagctactgatatccctgaagcagagtccttgaaggaaaacgtgtttg

SEQ ID NO: 141195 - DNA, 433 bp, Homo sapiens
gatcaatatcaatatttttaaaactgcaatgaaaaagaaaaaatgagccaggcacagtggttcatacctgtaatcccagcattttgggaggccaaggcaggtagatcacctgaggtcaggaattcgagaccagctcggccaacatggtgaagccccatctctactaaaaatacaaaaattagccaggggtgatggtgtgcacctgtaatctcagctacaggggtgctgaggcaaaagaattgcttgaacccaggaggcagaggttgcagtgagccaagattgtgccactgcattccagcctgggcaacagagcaagactgtctcagaaaaaaaaaagaaggaaaaagaaaaaaatgggtaaataacaaataagtcatccaaagaagaaacacgaatgaccaagaaaatggaaacagtaaaagaggcatgcaaa

SEQ ID NO: 141196 - DNA, 1250 bp, Homo sapiens
gtaaccacaatcaagttaactaacacatctgtcacctcacatgtttaccttttctgtgtgtgtggtgagaacaactgatagactcttagtaaattgcaagcacacaatacagtatcattagctacagtcaccatgctatcctttgcaccctcagaatatattcatcttatgaatgtttgtactctgactaatacctccccagttacctaccccttcgccccaggcaaccatcatctactctctgcttctatgagttcaacttttcattgcagcactgttcacaagagctaagatacagaaacaatttaagtgtgctgtgatggatgaatgatgagaatgttgtatatatacataatggaatacgattcagaactaaaaatgaaggaaatcctgccacttgcaacaatgtggatgaacctgcagaacattatgctaagtgaaataagccagacacagaaagacaaatgctataggatctcacttatatgtgaagccttaaaaagaaaatgaccaggtgatatggtttggctgtatccccacccaactctcatcatggattgtagttcccataatctccacgcgttgtgggaaggacctggtgggaggtaattgaattgtgagggcggttatccccgtgctgctgctgttgtgatcgtgagttctcatgagatctgatggtttctgatggttttataaggggcttccccctacttcgctttgcacttctttctctcgccgccttgtgaagaaggacgtgtttacttccccttccaccatgcttgtaagtttcctgaggcctcctcagccatgctgaactgcgggtccattaaacctctttcctttataaatcacccagtcttgggtatgtctttattagcagtgtgagaacagactaatacaccaggcaaatttccctacctcatacttgctttctgaagtttccagagatttccatttgaaaagaatgcctcttccaactctgcctcacctagtaaccttctcatctacaccacagtgacttctcctgtgaagcgaccttcactcagttatttcaaggatttaaaatataaaaatgttttctaatagttgacaggggggtgaactagaaatatccattgtaaatatcttttaaatatactggaaattattgcttacatcttaaagccatttgtcactgaatactaaaacatcaaaccattgatttttaactgcttcattaaaatataattcacatactataaaatgtatct

SEQ ID NO: 141197 - DNA, 1063 bp, Homo sapiens
atgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcc

SEQ ID NO: 141198 - DNA, 399 bp, Homo sapiens
gctcaatgaaccccaattgcaagaaacaggataaaaactacattaagaaatgttatgatcataatcaaattgtataaaaattcacataaagagaaccttaaaagcagcttgagggaagaaatcttccttatatacttaggtattttgcaaatacaaaagtgacagcatatttctcatgaaaacaatgcaagttgcaagacagtgcagcaaaatctttaaaatgctgaaaagaaaaactgtcatcctatattttatacccagtaaaaatacgttttaaaaatgaaggcaggctgggcgcagtgactcacacccataatcccagcactttggaaggccaagatgggcggatcacttgaggccaagagttcgagaccaaactggctaacatggtgaaagccc

SEQ ID NO: 141199 - DNA, 156 bp, Homo sapiens
atcacctaggagttaaagaccagcctgggcaatgtgctgagacccccgtctctaaaaaaattttaaaattataaaaattagctgggtgtggtggtacatgcccatagtcccagctgcttgggaggctgacatgggaagatcacttgagccgtaatt

SEQ ID NO: 141200 - DNA, 248 bp, Homo sapiens
tgagatcacagcactgcactccagcctaggcaacaacagtgaaactccacctcaaaaaacaacaacaacaacaacaacaaaaaaacagttaagagaatcgtggagctgtgtcctactcattgtatttactttcctaaaataaaacaacattatagaaaacattatgaccaggcgcagtggctcaaacctgtaatcccaactctttgggaggacgaggcagacggatcataatatcaggagtttcagac

SEQ ID NO: 141201 - DNA, 757 bp, Homo sapiens
gttgcctcctctgacgagttcctgtcactgtccctgagctccacggcaattcctagccaatgcccttggtaaagtggcacaaattcctctccatgggtctatgccccttcctgagagaagaacctgggtggtggtgccagatttaacttctgactgaattacattgattggacataaagccgctcctcctttcccctctgtgagcacctctggaatatctgcatcctaagggcggccgtgcgacgagccttcccagacgcgctcctcctaccctgaggagcccggccttcacctttaccgcactggccatcagactgctttcccgccaggctggctctatcttctcaccccgttagctccagggaaaaccgacactgtcctctgctgaaaagagcccagggggcctgctgcctcttgggaagcagtggaagggcaggaagtctcaccagggctccctctggcaggaataatgaagacatcaggtagacaaggagtcacctggtcccaggtcactaagagaaggtgaggaggttaccagctagacggaggaaagaggcgccaaacaccagcctccgcctgcacttctgtggctgggctggacgtcacccacagctccgtgccatcaggggaatggtggaaaggcctggcatcagcacgcggcctccctgcccaggtccagccctgtgggtctcgccgagcctgcagtcgccttcattctcaaggtggctatggcatcttcccaggcagacagcccttc

SEQ ID NO: 141202 - DNA, 316 bp, Homo sapiens
caaaaaataaatattaattctcactgtggcctcggtcccttagtgaagccatgcttactccaggaactgctgcgatgaagagtggtgaaaattctgaatgaaaagcagccctcaaaaacgttaaaacccatgctattaagctttacaccaaaaaataaattcgaatttttaaaaagtgagaaatggggaaaagaagaggaggcttaggatggtcaaggtggcacctttagcaccttgtacttaaccagataagttcaagactgtgtcttaggccgggcacggtggctcacacctataatcccagcactttgggaag

SEQ ID NO: 141203 - DNA, 210 bp, Homo sapiens
ggtagagatggggtgtattagtattttctcacgctgctaataaagacatactggagactgggtaatttataaatgcaaaagttttcattgactcacctttcacatagctttctctctctcccccactccctacacggcctccccgctttctctctctctctctccccaacaccccgcaaggcctccccaccccagctccccacagggcct

SEQ ID NO: 141204 - DNA, 477 bp, Homo sapiens
ccggtttgctgggtgtatcttatcacactgtcctccatatgtgaatcctaaaccttaaaaacaatgtttctttagatactttcatcaactcaactcgaaactaaaacaacaggctgggaggcagtgagtttcttgagggcagaggttgtgtcttactcatctctgaattccacatatttggcttaaaagaaacaggcaaaaatgttatttgaggataaagaccagagggaggttgagaaagggaagaaagaagccacaaccttctgtagcattatcttgtcaacgaaagttcatatattttcaataagcatctactaagccccgtaagagaaaaaggtttgttgtctgcttggtactaccttaaacattgggtgtttgatgcagacgctgcctttactgagtgggaaatagccttgagtaaagtgtgaagcaagacttcaataagtccttaacgacagtcacaaccatttgtaccct

SEQ ID NO: 141205 - DNA, 253 bp, Homo sapiens
tgggttttgaaaacactgtcctgagtgatattggtcaaacttccccttctctgcaaaattagcaggtgtgcactggtattcttagggcctgctgtgttactgacctgtagaatgtttgttaagtagaagagcaaatgaatgaataaagaaatcagtgaacagataggtggcactgtaccagttagaattgtacttggtgaaattgcagtgctgctgtttacttagccttgtcatctgtaaaatgggtacagca

SEQ ID NO: 141206 - DNA, 393 bp, Homo sapiens
agtgatctacccgtctcggcctcccaaagtgctgggattatagatgtgagccaccacgcctggctctctttttgtatactttcatgtgtattgactagttccctcttttgatgatctatttttgtaaaatgtcacatgaatttatcattggaagatgaggcaacacaactacatactttactgtctgtgcatgaatggaataacagctgcccagtgaccagtcactgacagacttagaaagaagtgacatacatgattggttgctgatcataatgcacgtcttactgacataatgatctatgtactgaagagctggtgttgttttaccaaatcatggtaactgaagtctgtgcctatcagagctatgcagaaatgaggaactgccagtgtgtg

SEQ ID NO: 141207 - DNA, 468 bp, Homo sapiens
ttaaaaggtgttctcaaagacccttgcctctcagtagccccatcccaaaaaggagacggaaatgtttgtatggccaggcagcaagtcctatccatcaggaaagccaggaactctcggattccccagaaaccttgtgtgccctcaggaaagactccactctgagactgggcaagagatgccaagttttcagttgtggatcttggcagctggcagggcactgtgattcaccagggtgcccactggaaatggcgccggggtttctgcacgctctgcagaggaaggcggtctggagagaaatctggaagctcgtgcccacaccagtctcagccaaggccctgggcaggccctgtacagacaagctggccctcccagggtcccgccgttattgcctacaggtagttcaaacaggaactgatttgtcaagatctgatcttaggaatgcactgtttgtatacagaacaccctctg

SEQ ID NO: 141208 - DNA, 589 bp, Homo sapiens
agtacaaacagcaggataatcatgcgttctaatgatgatgtacacttaaggaaacacgcatgtccgttttagaaactagtgtccgcatttccttcctcagagcatttccttccacttctttgggttgtttggactctaataaattcttctatgtgatctttattttattgagtgcagtggatagctttgtgcctgcagcagtaatactccgattgcaataaatcaaattcacttcacttagaatgcacctgtgaaaagttaatcaaaaaagcataaaatcttattttctttatagtaagtaaaatttcagattgtgtttaatatgatacttaacaggaagaagtccagttgtttacactgatgaggaggaaaagctgtctttttaccttaattaaatgtacctgaccaatgtacagcagcgctcccctttctaagacaaaccagacaatctccaattagaatgtgcccaatttccacttaacaatcattttctggaagttgagtgtccttgtcgtagatagcattcacacagaacaccatcctaactttctctttgaattggaatcaagtgctgctatctgctgattgg

SEQ ID NO: 141209 - DNA, 460 bp, Homo sapiens
aatgattatattaaggtgatggcattgttggaaaggaagttcctatttatttaaaattttttgtaatctggatattacctatacaataagaaatctggaataaaaccgtatttattagtctattgccgtgattgtttctgttctatataaaaacacgttttatttatctaataaagaaaaaaccacttttgaagatttccctgggtcacgttttcccgctgctgatcatggctttggcatcgttaaatgttttcctaccaattacaaataagcaatactctcagtatatgctttttacaatatattctcctcattgccccaaatttacctgatgctactcgaagtaatggctggatggtagccattactaactaatctgcaaagtaccatcagctctataattaaattccagcatctaacataaataaaaattagagcagatcaattccattctccccca

SEQ ID NO: 141210 - DNA, 471 bp, Homo sapiens
aaccagaacaatcaggcaagaaaaagaagtaaaaggcatccaaataggaagagaagaagtcaaactatatttgcagatgatataatgttataactagatcttggacaaggtagcataagaaaaagtaaatcgataaataaaaatacaaaatacaaaataattttatacctagaaaaccccatagtatctggccaaaagatcctagatcttataaacaacttcagtaaagtttcagggtgcaaaatcaatgtacaaatatcagtagcatttctatacaccaacagtatccaaactgagtgccaaatgaagagtatgatctcattcagaacagacacacacacgcacacacacacacacacacaaacaaaatacctaggaatacagctaatcagggaggtgaaagatctctacagcgagaattacaacactgctcaaagaaatcagagatgacacaaatggaaaaatactcta

SEQ ID NO: 141211 - DNA, 727 bp, Homo sapiens
gtctctagatgccaatgagtgcttacctcatcaggtcggggctctctctgcagacaaacctgggtcccatgaacctacatctttgaaatgaacacaatgggactgctggacttgtttctccttcccaatttccaccttgaaaaggcgcaatgagctggaggagccacaggacttggtaaaagcagaagcgcaagtgcctggaaactcaacactcttccggtcaaaggaggcgacgtggtctcgctctgtcacccaggatgcagtgcagtggtgccagcatggctcatggcaacctcgaactcctggactcaagagattctcctgccgcagcctccaagtagctgagaatacaggtgtgcaccaccaccaggcctggctaattttttttttttttttttttaataaagacgagatctggctatgtaacaaaaaaaaccacaaaaaaacacaaaaaccgtgtgcggccgccccgggccctgaaaaaagctgcaaacccaccagaggggccggggcccaagaggacagagacaggggccaacctggtcccagagaaaactccgggacaggaacaacggcgacgggaatacccacaacaaaaaaaaagcgcccgaggagaacaccgagacgttctgagaaaacacccacaaaaggagacacaagagagcacaaacaggcgactatacagcacgggggccacaaggaggcacatcacaaaacgcccacacgg

SEQ ID NO: 141212 - DNA, 558 bp, Homo sapiens
acagagttaggcaggtggccatgtgaggcaggctattacaatgtaagtctagtgagcagtggattccagcaggagaattatgtctatttgttttggggagagtgttttgagacaaggtctgatctgtcacccaggttggagtgcagtggtgtaatcacagctcacggcaacctcaacctcccaggctcaagcgatcctcccaccttagcctcccgagtagcacatgccactgtgtcgagccgtttgtttttttaaaatcctctggaaactgggaaattgactgaaaggtagtattcctccaagcccttgaatctaggctggccttgtgactactttgatcattacaaggcagtgggaaaggatgttctgggacttcaagcccaggcctcaataggactgccagcttctacttccttctcagaacactagctctgagcccaagctacatggagaggccatcgtcctagctgagaacctagccagctgccaccatgtgaatgaaccacggtgaacactcagcccattcaagcccacaaatgcccacagctccagccacat

SEQ ID NO: 141213 - DNA, 268 bp, Homo sapiens
ttgtgaatgaagagttgccttgtgttgagagggaattgtctctgaggaaatttaatgaaaggcattgagaagtgttcctgactttgagaaacttattttgaatgaagatttgccttgtgttgagagggaattgtctaaggcagatatggaattcaaatttgaaacttttctgttgaccaggttcaggattatcggtagcatggaattatcatgactcactgaactccatttaacctgaagttatagtcatttgaaacttgctgatatt

SEQ ID NO: 141214 - DNA, 249 bp, Homo sapiens
ttacagtttctgcctccaaatctgcctgagtcatctgtctccttgtacctcagtggccagaaacagctgaacactaggcaaggaagtgagcacaaaaaaagacaaatttggggagagaaggagactttgagagacaggctcaaggttgacaactctgggaagaccctcggccccctgtgcagaggctgttggtagggaggaggctggttcagtggagttgggtccccagtccatcctagaaaaccctgc

SEQ ID NO: 141215 - DNA, 381 bp, Homo sapiens
atcttaaccttggcaaaataaactttctaaattgactgagacctgtctcagatattttggggtcacacaaaggagataaaagtgaaatatgatccccagtgttgcaggtggggcctagtgggaggtgtctgagttatagggatggcttcgtgaatggcttcgtgccttcctggccgtaatgagcgggttgtttaaaacaactggttgttttaagagtgtgagatctggttaagagtgtggcacctttccctcctctcttgctcccttttttgccatgtgatacgatagctcctccttccaccatgattgtaagtttcctgaagccctcactagaagcagacgcctgcactatgcttcttgtacagcctgcagtaccatgag

SEQ ID NO: 141216 - DNA, 732 bp, Homo sapiens
cacacacacacacacacattcgtatatgctaagtactcaatgagtggtggagatgataatacagaagttcagaggaaggagacaactttgcaactgtgttggtttgagaatgttttataggctatgatgtcaatatgatactttcagtggtctcctaaatgagacagagcaatagaaaacttatttagtgattatgatatatcctaagtattaaaagaaggaacacccagatagcagacatttgacaaattctcactcggtgaatgaatttgtaaatttcattagcacatcaaaataagtatgttttaaagtaaatgtggcatctctgccctcagagctaagctttctcctgtcttccatgttaacccaccaaaggcattactgtttaccccacaacacagggtcagctcttcaacctcatctctcttctgtcttctttctttctttctttatagtgaatgtatttcctacagaaacagcctgtaattcaattgccagtgctcttctcaattctcagtgctatcacttttttctgcactatattgcttcttccctaaacctttctaaattggcttctggcctgtctctccaccctctactcactgtcagattaattttcctaaaatctaacattgaccatataatttcccagcaatgaagactttttgctttttaaatgaatttgtatttcttaatgaggcatttattatactctactgtctgaccttaacc

SEQ ID NO: 141217 - DNA, 142 bp, Homo sapiens
tgtgaccccagggtaggttaacatcgcagggttgtgacagaataagatgatgcctttaaagtggctgctgcttgcatccctcaaatacgagtgttcttctggcctgccctgttttgacctttgcccaggcatccagagtact

SEQ ID NO: 141218 - DNA, 242 bp, Homo sapiens
ggaaacccatgtctgacatttcagagcagggtaagtacccactaaagatgtctctaaaagtcttggtatatttctgacgccatccccttccactccaaggctcccagctttggacctcttgaatatacgtactcgttgtaaatacgacaagctttaactggaaggtagtaatggtaaccttcctttgagtccttactgtgaaccaggcagaatgctattttgtatgcatattctcagtttac

SEQ ID NO: 141219 - DNA, 199 bp, Homo sapiens
gtgatgaatttcccattcagggtgacaaaaacttacgcatctaacttccttgcgctgaaatccttaaaatttcttaatgactttcaacataataggcttaagaatcgttttttggttttttttttttcattttgttttttattgagatggagtcttgctctgttgcccaggctggagtgcagtggcgtgatctcagctc

SEQ ID NO: 141220 - DNA, 163 bp, Homo sapiens
tcctagattgggactcctttgattaaagggaaaacctaattagataattgtttccatagaaacttaggtatatttattattgcttttataggcctcttcaattactaaaatgaaggaacacactttaagcatggtccaagtttgcataggaggtgcatttctt

SEQ ID NO: 141221 - DNA, 698 bp, Homo sapiens
ccagcctgggtgacagagcaagatcctgtctcaaaaaagtaaaataaaacaaaaagttttcagtgaattgctgtctttgcttcacttcctttcattctttatttaatatttatttttaatttacattacattaagatttacttttttgaaagactgtctataatttttgacaaagatttagatccatataaccaccagcagaatcaaaatacaggacattttcatcccttcaaaaatttcccggctgggtgcagtggctcacgactgtaatcccagcacttggggaggccgaggtgggtggatcacctgaggtcaggagtataagaccagcctggccaacatggtgaaaccccatctctactaaaaatacaaaaattagccaggcgaggtggtgcaagcctgtagtcctagctactcaggaggctgaggcaggagaattgcatgaacttgtgaggtagaggttgcaatgagccaagatcatgccactgcattccagcctgggtggcagaaagagactctgtcttaaaaaaaaaaaaaagaaaaaagaaaaagaaatttacttatgccctcactcccttttatggtcaaatcttctcccattcctaacccctggtaaactcatttaagtccttacacttcttcctcattcttccttgaacccacttaaatcaatctttcatccttaccactccattgaa

SEQ ID NO: 141222 - DNA, 334 bp, Homo sapiens
agtagacatagttaatatagaaacagatgagcacagctgtgttccaataaaactttataaatggatactagaatttgaattttatatagtttttacaaaatactattttgatttttttaaaccattgaaaaatgttaaaaagaggccgggcacggtggctcagacctgtaatcccagcactttgggaggccgaggcgggtggatcacctgaggtcaggagttcgagaccagcttggctaacatggtaaaacctcatctctactaaaaatataaaaattagccgggcgtggtggtgtgtgtctgtaatcccagctacccgagaggctgaggcagg

SEQ ID NO: 141223 - DNA, 297 bp, Homo sapiens
tgcaatcagacatgctaatctatgtcagctttctcctttatgggattggcgtctactgagaaaaaaacctaacttttcttcataacaacaagattctgttctttaagaatatttcagcaccgttaattagaaagaaggttttattaaccataaggctagcactaacagaccacagagctgttttttaaagtactgtatgccatagctgccctgctttttctctgtctaaaacttcattttgttatacgctcatcaatcacttaagtcattaccgtaaatcctactgttgttaatttt

SEQ ID NO: 141224 - DNA, 158 bp, Homo sapiens
gtgtacttgaggacgccaggtgaggtttatggcaaatctgaggaagagaccgtggccaggtagtgtggcgcataccccagcttagtgacctgaggaggtcgtgagtgctcccgccaggagcctctggtttctaaaaggagctcctgagtttctgtttg

SEQ ID NO: 141225 - DNA, 345 bp, Homo sapiens
ggaaaggatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttat

SEQ ID NO: 141226 - DNA, 115 bp, Homo sapiens
atttaacacttcagagcccagatgatttgactggcataggtttcagctgtcctgcccaaaacatctttcccattatcccgtcttaatattcaaatttgaacatttaagattattt

SEQ ID NO: 141227 - DNA, 462 bp, Homo sapiens
tcactgcaacctccgcctcccgggttcaagtgattctcctgcctcagcctcccaagtagctggaattacaggcgcccaccaccacacccagctaattttttgtatttttagtagagatggggtgtcaccatgttggccaggctggtcttgaactcctgacctcaggtgatccacccatctcggcctcccaaagtgctgagattacaggcgtaagccaccgcacccggcagggacacagttttcgaatccttgccgatttgagtctttactgagcggcttgatttatcttggcttgggaagttgtggatttttagaacattgggtacacttgtattaaaatagatgtatactttcttaagccaattgcacatttttctggagtatgcccaagatgagcttttctcaaggcatcgcctgaagaacagcagtcctgcacaatgttctgtggtgaaagggttctat

SEQ ID NO: 141228 - DNA, 154 bp, Homo sapiens
cttggtactgtgacatcagagtaaaaaatcaccgcgtcactgggcgaagctgaaatattcaaatgttacctagcacctgactagaacaaaaaaacaacactggtgaaaactacaccaaaatagagcaatctgtcttgtttgttgtttggttttt

SEQ ID NO: 141229 - DNA, 388 bp, Homo sapiens
cagtttggacacttagtgtgaatcaacaaggttaaataatgaggtacaggagaaaaggcacagactgtaaatgagaaagcctgtgttaagttggtcctatcacttaactgctgcatgacatcaggaatttaatctatgtcacaatttcttcattgaggggattatattagaaaaagcatatgaaagtgttggcaaaactgcgaagtgctgtaacagtactgaataggactgccattatgaatggagttgtaattttcagagttgatcatgtaacaccttaaaatatgttttactagtttttcccttcaagctggaaaatattagctcagttctgaaaatttagtcatcactgggaacttccaaggaaactgatgacagtggaagtcaa

SEQ ID NO: 141230 - DNA, 521 bp, Homo sapiens
aaagacataaattgctaatatcagaaatgaaagaggggcccatcactactgatcccataaacattaaaagaataataaatattaggaatacttccatgctcacaaatttgataagagatgaaatggaccaattcctagaaggacacaatctgttaaagcccatacgaaaagaaacacatcatcttagtgtagcctgtatctatttaaaaattgaatcaataattagtaacttttcaaagaggaaagcaccaggcctagatgggggatcactggtaaattccaccaaacatttaagaaagaagcgatactggctgggcgcagtggctcacacctgtaatcttagcactttgggaagctgaggcaggtggctcacaagatcaggagttcaagaccagcctggccaagatggtgaaaccctgtctctactaaaaatacaaaaattagctgggccaaggatgcctaatctttagccactgttagccttttgattgataggtgggtagcttagttactttgacgcg

SEQ ID NO: 141231 - DNA, 922 bp, Homo sapiens
cccgattcgaaaccagccgcgggagccgtgggggcaggcgggagagagggctgggcccctgtgcttgcgagaacgggtccttcgaagtagaaactggggagaggactttaagccaggtcccctgggagaaggccgggccaggtcgggagctccagggggcaaggctgggacggggctgggcggagattctgagggcggggtccgggggagggtctgggagggggctgcagagaggggagggctctatgggcgggagacgattgctggggggcctgctggcccggacaccacctggagttagatgtggagggcagccctcagccctcagccctcagccccagctcctcaggggactccactcgccctccctgcccaggttacgaggtttctccttggccttgttcccgctgcgcccactcctgaaagctccggagatgctgaagtctggactgttagttcccggtctcctctccatgaactttctccaaacccctgggttccagcttcctcccttctgcccctttacgggaaagggtgactgcaactcgggtctcttcccaatcccagtgctgcctgatcagccccggtttgaatccagagctgagtgaggctgggaaggggagggtgtgaatggcccttgagctcctgctaccacagcccaccacaaggatgagtgcctggaagagcgcccatcactcgggctcagctgtgaaggctcctctgcctccaggatgaagggagcacctggagtagcatgtgtcactgtgcgtgctggggtgtggccgagcacctgtgccggtgttgtgagacttacagtgagagtgtgcatgtgtgtaaaacaggaaaggggggtgtctgggtgtgcgtgtggctctttctgaggactccagagcaggagttgatcccagtcatccgtgacccc

SEQ ID NO: 141232 - DNA, 757 bp, Homo sapiens
gaaatctatcctcaaggaaacaacttctcagtgttccatctgctattctactactcctcagggattattcaggcaccctcccttccctacacatcaagctcgaagatttgcccccgcccaggactggcaaattggctttactcaacatgccctgagtcagaaaacaaaaatacctgttagtctaagtagacactttcactggataagtagaggcctttcctacagggtctgagaaggccaccacagtcatttcttcctttctatcagacgtaattcctcaatttagccttcccacctctatacagtctgataacagaccagcctttattagtcaaatcagccaagcagtttttcagctttatatcccttacagtcctcagtcttcaggaaaagtagaacggactaaaggtcttttaaaaacacacctcaccaagctcagccaccaatttaaaaaggaatggacaatacttttaccactttcccttctcagaattcaggcctgtcctcagaatgctacaaggtacagcccatttgagctcctgtatagatgctcctttttattaggccccagtctcatcccagacaccagaccaacttagactgtgcccccaaaaaacttgtcatccctactattttctgtctagtaatactcctattcaccgttctcaactactcataaatgccctgctcttgtttacactgccagtttacactgtttctccaatcacagctgatatctcctggtgctatacccaaa

SEQ ID NO: 141233 - DNA, 824 bp, Homo sapiens
cgcagccactgaaccacaaggcttcgcgttaactggagtgcctgggagtcgcgtgccaggagccgcacggccagggactgactgacagacagacacgcaccaccaccacaacacacgagacccgggcgggccgccgccgccgccgccggggctcttggcaaactcgccggtcgcagaggtcccccgcggagctgcgccacagtagcgccgggcttgcagctttcacgccgggcgaaggacccggcgctgcgctcgcagctgcgcggagattcccggcacaggccaaagtcacagcaacgctgaggcacagttagagccaactaagatgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcaggcgcggggcttgaggccgggcaagggggcgcggggcggcgttggctgcggggtgcggagggctgccggcccgcacggctgctgggtctggtacacgattgcataacggtgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgctgtcgcccacaactacatctgggcactcac

SEQ ID NO: 141234 - DNA, 743 bp, Homo sapiens
gggaacgcaggaccgcccgcggaggcaggacccggctgactggcagcagggtcacagcgagcgctaggcgctgcctgaccttggttagcactgcctgggtttcttccttcgccttcctgctccgcgccattcggagctggtcttctcgggtgcgcgccggagcacgcccctgtgacacgaagatcgcgcctctgtttctttccttacacctcactgcctttttcccctttctctcttcggtaggatgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcaggcgcggggcttgaggccgggcaagggggcgcggggcggcgttggctgcggggtgcggagggctgccggcccgcacggctgctgggtctggtacacgattgcataacggtgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgctgtcgcccacaactacatctgggcactcac

SEQ ID NO: 141235 - DNA, 397 bp, Homo sapiens
tttccgtgacctcaatttttctggtctgtaaagtacagcacttggttttttgcttgtttttttagacagggtctctgttgcccaggctggagtacagtggcatgattaaggctcactgcagcctcaaccttcctgggctcagtgatcctcccacctcagcctcttgagtagctgggactacaggtatgcatcaccaggcccggctatttttttgttcttttttgttttgtattattttggctttaaacattttttctttctgcttctattggaccaggggagtcagattatttacaaagtgcaggtaattttatgagaagtcaaactccttctgtgctgagccatgacatgcatgcagaatgaaaagtcagctccaacagtgaccaatcctgcattc

SEQ ID NO: 141236 - DNA, 353 bp, Homo sapiens
aaaccatgagagataataaatgatttttaaaagacattatttctgagtgatttgtttatacatcattagatttccaaaatagcagttacttttgccattctgaactgtgaaaagtatctagttttaacttacatttccctgtttacttgtgaggttaaacagtttttcaatattcattggccatttttgttttgtatttaaattttctatgtatatgtattatatataattatatgttaatatgtttacaatatgtaaaattgaatttatgtataagcacactcatacctttttctattggatgggttctttgttttgataatcatatttaatatccgagtctttttttttct

SEQ ID NO: 141237 - DNA, 352 bp, Homo sapiens
tagaagccgagctatggactgacattgggtattgatgcacagagcaagtataattgcaattagctaccagtgaacactgggcactgatatacagcagacactgcctccaacagacattttccctttgtggatattggtcattggtggaagctgtcattcatatgataaacattatatatcaaccaacatttgcaccctggtgaacgttagccaacaaggaacactgaacattgatgggcaaggtcctattagcctatgatgacctctgttgtcatagacagtgcccttggtggagattaggtatgagtgggctttagcgctggtggactttaaattctgtaagcacataaag

SEQ ID NO: 141238 - DNA, 313 bp, Homo sapiens
actcacaactgctgacctcttccctagttggttattccttatctcggattcttttttctggaattgtttgctcatttggtgaggtttgtttgagaataatggggcacagaattttagaattggaacattcccagaaatgaataatttggccataactacaaagaaatcatgtggaaaatgccagttgggaaagcaacagctgtttatgagtcccactttaatttctacctccctatatttgaacacctttgctgacgtggtgttttcaagggcagaaaggactgtgggattggcaggtttcccaagtaggtga

SEQ ID NO: 141239 - DNA, 367 bp, Homo sapiens
tgaatacagcaggaaactgagcaggagtcagtctggctgtatcccacccctgcacagcaagaaccaacagcaagctaccactgtcacgtaaaacctaatcaggccaggcgcagtggctcatgcctgtaatcccagcactttgggaggccaaggtgggtgggtcacctgagatcaggagttcgagaccagcctggccaacatagtgaaaccccgtctctactaaaaatacaaaaattagctgggtgtggtggtgcaggcctgtagtcccagctacttgggaggctggggcatgagaatcgcttgaacctgggaggcagaggttgcagtgagctgagatcgcaccattgtattccagcctgggcgacag

SEQ ID NO: 141240 - DNA, 323 bp, Homo sapiens
ttcaatactatattacagaggtgaacaaaacagaaaaattcttgctgtcgtggagcttgcatgctagccattatacctggcaggtagctaatgcttaataatggatagatggacaggtggatggatgataagagaaagaaatgacctcctaggtgggagaaatacagaagtaaagataccaaagaaggaatacatggcatctgctgccaaggcaatgagaaggccattcggacaggagtggagaatgagcgaagagacaaaatgaacatcaagatagagagacaggctgtagaccttgacagacagactttggataggtagag

SEQ ID NO: 141241 - DNA, 386 bp, Homo sapiens
ttttgaatctaaaatgtgcctccatatataacatatagtcagatcttgttttttatccagtctcataatctctgccttttgactggagactttacattaaatattgatacagtgggtttaccattttacttttcattttctatgaatctcctgtcttttttccctctgtttctcctgctgtactactttcttttgcattaagcaaatatttcctagcataacattttaatgctttcaataattattttcagtatacatttttagttattttcttagtggttactctaagacttatcatatacttatcaaaatcaacttcagatttatacgaacttaatcccagtgaaatgtacaaatgttacttctggataggtctgttatcttct

SEQ ID NO: 141242 - DNA, 482 bp, Homo sapiens
atgaatatcttcaaataagttaataaacaaaagaatacattaggcccagttcctgcatttacataagaaaaacaaactcgaatgtctgacagtttaataaaatgaaaacacttgtttggctctgtgtaacttactctgcacagtgagtgatggagctgggagtccaacctgcatttttgatattcctgttgcttcaccctggctcccccatagccatgcagagagtgctgcatttcagtacagtaacacaagagacattgcaaggcgggtgacagaggagagggagggaggcagacacaactcagaggggacgggagagaagaggggctccaaggttctggagggcgtcctgggtacgtgtatgcctcacacgccttgctgaggtccttggggggcttgaaggcagccagggccaaagggctgggcaggttaggatcccctggccctgggacagcttgttctgtggctgagtttcctcagtc

SEQ ID NO: 141243 - DNA, 298 bp, Homo sapiens
gtctagctaaagccagacaaaggcgcccagggcttcctcccccacccgcttcacctagatcaggttcccaagctgcaggtgcatgtgacgctattcctgagggcgggcagtgggcagcagggagagagggcggggtctaagcagggcagagctgaagaatttaggagccatgggaacagagcaccgggttatgtggagacagtggctgggagactgatgtttcagaggtttcacccagagctcccaatactccatcttgaggacaaggtatattgcaggtaactgtcttgcatctctg

SEQ ID NO: 141244 - DNA, 443 bp, Homo sapiens
catcctctgtcctcacaccacccactcttactgattttgccttctattttacagataatttagaagccatccagagagacattcccttgtctttgttacaacaaattaaaaccctgcttgcatctgtacccatcctctccctttccccctctgttatatcctaatattttacagatgatgaaatacaggtgcagagaagttacatagcttgcctaagatcacacagctagcaagtagttgagcccagttcccagcagatgaagcatccctcttacaaagggctgatacttttatattgttctatctctcagggatctgattatattagctattccccttctcttagttaatttttttttttttttttttttttgggaaagggagttccgcccggccccccgggggggagaacggggccaaaatccgggccccgggaaacctgg

SEQ ID NO: 141245 - DNA, 369 bp, Homo sapiens
ataatttgtactgtctccccctactagaggtaacttattttagtccaagaacattttatgtgtgttttgctcattactgtgttacctgcaatttgaacattgcgtgacatgtaataggcctttaatgaatgattgttgaaagaatgaatagtgattaaagcaaaggctctgacttagaaccgaaattgagtcctggtgctggcactcgtctgctttgtgatcttaggcatgtcattaacctatctggcctgcttactcttctctgaaatggagatagtagaaccaagtaggtttgtcttgaggattcaatgcaagaatctgtgtaaagctctcagctcagaatctggtgcataataaacagtcaataag

SEQ ID NO: 141246 - DNA, 598 bp, Homo sapiens
gaagggctcaaccaggcctttgtttcatgtccccaattatttaaaatatggtataaaattacctttagggctatgtgtaaaaggtgtaaatgaaatagataaatttcgtgtttagacttgggtcccatccccgagatatctcattatctttgcaaatattctgaaatctgaaaaaatctgaaatacgactggctgcaggcatttcaaataaaggatgctcagcatatactgacttaagtcccttcaaatctagtcctaatctgccctcaatttaagatctgaatttatcctgcattaagtgacatattgccagcctgggcaacacagcaaaaactctgtctcaaaaaaagaaaaaataaaataaaataaaataaatagaaacatcttttcaacaaataatactagaataattgaatatctttatggagggggaaaaaatgaacctcaacctgtgtttcacaccctacacaaaaaactgcttccagatggatcatagaactaaacataaaaactaaaaatttaaagctaataggagaacatcttcacaaactttgtgtgggcaaagattttgtagacaggacacaaaatatacaatttt

SEQ ID NO: 141247 - DNA, 405 bp, Homo sapiens
acatcctatctgcagtgcttcccacttttcaacacagaacactataaacatttctagttgggctgttctagttatcttcagtaaactaatgctgccttttgtgggtctctagttggtaaagattttcagtctttttgttgctgttggagttttctgtttcctagtagtgtgtagacctgttgtctgtgacagttttattggtggtgattgccaaaacatgattctattcttaaacttttgtctggagttaaacattatagtagttgaaaaactaaatacgttatttcaaaggggaggcaaattgcacattctagcaaatgaatgtgcaattgaatccttctctaatataccaggcacaaagaacatcaaaggagatatgcttagtttgcaagtttattggggagg

SEQ ID NO: 141248 - DNA, 320 bp, Homo sapiens
catgggaatttattttgggaataaagaaactgaatgtttagtcagggcctttatacaaagcaaagtgaaatcatattggaaagagaacaaagacatatgtgaaatggaatattaagaagagtcatcttaaaagaaatccagttggaccaagtgtttgaagacctgtggcatccccagcacagaagctccactaaggctttaaattgttgggatttccactcgggctggagcactggctcccccgtggtctaagctgccactatcactgtgtctttagtgtaggaatttttaacctggagtccacaggttcccaagtggtc

SEQ ID NO: 141249 - DNA, 429 bp, Homo sapiens
aatatagctggccccctttttgctcaggttcttgctcaggtctctcctccagccccacgggacacgcaccaggtcttccggcattcattcattcatgccactgtttgctaagtgcctatgctgcaccaggtgcagcaccaggtgctggagacacaggaggatgagagcagggctgctgtccacaaggactcacaatgcagtggggagacagcaacctgtccacgcccactaggaagtagaaggtaaatgatgggatgcaaacagggcttctgaggttggaagagaccctgctacaaagaggcagagccaagattcgagtccaggctgtgggctctaagctgtgtgatcatcaccctatgccaccacctcccacttggattttttctgcatttaaatccagtgtcgcagaccagacctgagcaagccagg

SEQ ID NO: 141250 - DNA, 125 bp, Homo sapiens
gacaccctactgtgcacccagtggagtaaataaaacttaaaatgttaagtcaaccaagtgttagcaaggatgtggagcaactggaactcccatatattgctgatgggaaggtaaaatgggtaagc

SEQ ID NO: 141251 - DNA, 457 bp, Homo sapiens
tatcctcagagtcggttggtagcatagtggctgcagtgattggggttcaccctcccttgctcatttcagctcatggtattactagtgagtagcaagatcacctaaaagaaggcaaaagcaaaggcataggtacagatctacttggtttgcagcaaatctgctttaggcaaactccttacattgctcaaagagttttcagagttttggtacaaacaccatataaccgtaataggagcaaccagccatgaaggataacacaggtctttagtggaagaccaaagatggtgaatcaggtagtatcactaaatgcacttttaagtcaaatacttaatgttgaaactttatttaaaatattatataggtttgtgtatatatatggggatgtaagagaaagggacatgcctaaataattacgttaatataggaaatatacctttttcaattctgccttcttcca

SEQ ID NO: 141252 - DNA, 248 bp, Homo sapiens
ctaatttcaggggtctctgaattatatgtgggaaacatcgtctaaaaaagtaattttatccttattcatgcaaccagacccacactcatagaacttttctttaaggggagtgtcttgcagatgtataaatgagtgttaacatctttaaaagcgaaactgaacaattctctggcatttgaattccctccttccttcccaaccctctccttttcattttctcatttattattaaaaacacttttaaagga

SEQ ID NO: 141253 - DNA, 385 bp, Homo sapiens
gagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgattt

SEQ ID NO: 141254 - DNA, 330 bp, Homo sapiens
  misc_feature (13)..(13): n is a, c, g, or t
gcttttttgttgnccccttccactactggtttaaaaaaaaaaaaaaaaggctccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgattt

SEQ ID NO: 141255 - DNA, 144 bp, Homo sapiens
aaggcaggggatacaggaaggagtggggtgagggctctgtatgtgcacagcctgtgtgaggagagccgagtaaggtgggaacattgtctctgattgacagtgtctctagttggacattgttgcagtgggttcagtgggttcaac

SEQ ID NO: 141256 - DNA, 456 bp, Homo sapiens
gatgtaggcaaggtggccagtagaaataactagcttaatctaccagacaagtctgagatctactgcttggaggctttttactgtagagctgctctgtgctatatgatagccatcagccacttgtagttatttaaatttaaattagttacaattaactgaaatttgaaattcagttgctcagtcaggtgaaccacatttcaagcgcttaataaccacatgctactaatggctagcgaattggatcgtggagctatgtacagaatgtctccatctctgcagtaaagtccatgggacagtgctgatcttgagaatctagaggtgtttaaatatacacttagagaaagacatactaaatttaatagaatcgttgaatttgggtttttttgtttgttaagtaaaatagagaaattcattatcttgtaaaacaagaactccagacacaacaagcctcaagag

SEQ ID NO: 141257 - DNA, 303 bp, Homo sapiens
gccctggtgctgcctggggatggtgttctaagtacttgattccatctgcaaggcaaaacgttttgagagagagagaggattctcttttaaaggaatcataatgtttttaatgttaattatacaggctactcgattaatcagttaagtgccatccttatacagaagggaaactgggaagtgtttcaaaatgaagagtacctagcggcttgaaagagatgtttgctctatatttatattttgggacttgggtaactgacgattcagacatctatcagatggagggctgtctgcttggagtcatgc

SEQ ID NO: 141258 - DNA, 149 bp, Homo sapiens
ctgatttttcactggcctccatctacactttaataaaagttatatatatacacacaaaacactgattaatttatatggctgatcatctttttattttttgagacctgtcttgctatcaaactgagaccagtttaagggctggtctcaaa

SEQ ID NO: 141259 - DNA, 371 bp, Homo sapiens
cgatggtcttgatctcctgacctcgtgatccacctgctttgacctcccaaagtgctggattacagttgtgagacaccgtgcccagcccatttgtctagcttagaataaattgcctatacgttaaatgtgaaattgctatatttacttgaattaacttcaaagagtgctttcaaaaatgttaatgggtatattgatacatcccacctcatcatgattggactggtttatttaaagagtataaggttctaaatgcctatccaggatagagtgagcaagttcaagcttaacttagtagaggttggccacataagaaactatgttttaatgctttaagatgttctcccagcccccaagtctgcaagaatcaaaca

SEQ ID NO: 141260 - DNA, 371 bp, Homo sapiens
taaattagaaaaaaaaagattctgacaacatatggagagatggcacagatagtaagaaattcaaaaacgttatttttagataattttaacttctttctccaccaaactcactactagaatgcctagcaagtttcaaaattggcacatttaagtttcacctcccttcttcttgtcccttattgaggtattgttaacaagcaaatgctagtaacactgctgacttgttatcagcaaggcaggttgctctcaagttgtttgcagccctgacaatggatttataaacctggggctactcaggctgtgagacttagagtcatgtttttatgctacagaatttttttttttttttttctttttttcctaataactgg

SEQ ID NO: 141261 - DNA, 344 bp, Homo sapiens
gcttaagcaatcttccttccttggcctcccaaagggctgagattacaggtgtgagctaccatgcccaggctttatttatcttatgtctggaattttgtatcctttgactaacatctccccattgcctctttcccctggcctgaggtgacagccttctactctctctttctgtgaatttgacttttaaaagttccacacataaatgagattttgcagtgtttgtctttctttgcctgacttatttctcttaacataatgtctttcatgttcattcatgttgtctccaagacaggatttccttctcttttgaagctgagtaatgttccattatgtgcatgaatatc

SEQ ID NO: 141262 - DNA, 405 bp, Homo sapiens
tgtgcagataccactgccgtccatttccagaattcttttcattgtcccaaacaagaactctgtacccattaaatggtcactccccatacttcccttccccgcggcctctgtgaacctgcattctgctttttatcttgatgaacttgctctaggtgcctcatagaggtggaataatcactatttgtcctcttgtgtcatttcacttattttcaaggtgcatccatgttgtggcatgtgccataatttcctttctttgtaaggctgaataagacttcatttatgtatatacaacattttgtttatacattcatccattaacggacatttgggtcttttccaccttttggcagttgtgactaacgctgctgtgaacattggtgtgcaagtatctgttcgagccccaga

SEQ ID NO: 141263 - DNA, 458 bp, Homo sapiens
agtacagtgccaaatattacacaaacaggagttaaaagtcagtgagcatttctttggttaatatggacataacagcatatgaaagcaggttgacaatttgtttcaaaaatggttttgtgcactgctattgggacttaattaacttgaaatacagatttgtagacgttattgaaagtggaagctgttggcctcatcccattcttctaaacctaatcctgctcctccttaccacccagcccccgactggacagggaggcttccatgtggccttcatccattctgtgatgcagagcctgttgaagaaaagcaggtgtctttacagagaacttcaatagaatcctgtcaagtcatttgtggttttggagcatagtttacttgctgatttgactacacccaaatttggcctgtttgaacccttttaaacagggttcaaatgcttatctgatgtgaagacaagc

SEQ ID NO: 141264 - DNA, 427 bp, Homo sapiens
  misc_feature (24)..(24): n is a, c, g, or t
  misc_feature (28)..(28): n is a, c, g, or t
cggagaagtgcaagcaggaggatngctngaggctggtctcgagctcttgacctcgggtgatccacctgtcttggcctcccagcgtgctgggattataggcttgagccaccgcacccagcagtattttttatttaattggagtgttgattagttggttagtttttattgtcgtctcgtgtaatggcagagtttcctcctgtgtgctggctctcctgaaccaggtgtgatggccatttttacacatcatccctgtttagcaggaaagaccataagaaacaggtgcaggacctgcccctgggcacgtatgagacatcacacttgcagcttgggagctcttcaagggcaagtagtgtgtcttattcttcacgttgttcctggcatctgttacactgtacttgctttcaccctcagatttgtggaaacatta

SEQ ID NO: 141265 - DNA, 725 bp, Homo sapiens
ggaaagtctttttaacaaacagggctagaactactgtatagccatatagaaaaatataaacatattcctgccacataccatacccccaccccaaattaacaggaaccaaagacctaaattcaaaagccaaaactagaaacttccggaagaaaacatagaatatctttatgacctcgggcttagcaaagatgttctatattaaatgtaacaggccagacacaaatgtctatgtattgtgtgaatctattatctatgaaacccaagaacaggtcagacttatatgtagtgatggaaatcagtcattgcttctggggtgaagagaaaggaacccaaagtaactctctggagtgacggaaattggggcattggtgacaggggtcatttgtcaaaactcattaaagtatacatttagtatctgtgcttgttgtctgtaaattatagctcaataaaaactgagttttggccaggtgtggtggctcacgcctgtaatcccaacacgttgggaggccaagacaggaagatcgcttgagctcaggggtttgagactagtctgggcaacataaggagaccgtgtctctacaaaaaaaaaaaaaaaattagctggtcatggtggcacatgcctgtggtcccagctactcaagatgctgggcgtgaggatcgcttgggcccgggaggccaaggctgcagtgagctgtcatcacgcccctgcactccagcctgggtga

SEQ ID NO: 141266 - DNA, 481 bp, Homo sapiens
tgtggggctgtatattctcagagggaacccatccaagagataaactctaggccaaaacttccatgacaaaacaagaaatgtacttgaccccaatttcctgagtagcagtatagcagtagtttacctgctactcactactctaaggaagcgatttaaatgtgtaataaccataggcaataatcttaagtgttttccacacactatttcaatcctcagaaaaaacttacgaagtagatcctacattatccttattttacggataaactggcaaacaatatcctgaatactcctcccagtaccaaaaaatgctgcctaaaagtaactgaagtgaacaaatcgatacattttaaacccaagattcccagacacaacatcctcaggaaaactgctaaacaaatgggagggtgaacaatggcgggatgtagggaaatttacccttctacccatctagattttagttctgggtaaaagaaaagtctct

SEQ ID NO: 141267 - DNA, 337 bp, Homo sapiens
acttactgaaaaacagttctcacaagttatatttttaagtcttcccttttgacaggtatgttatttttgtgagaaaaggtttttttcctctctgaaaaactgtcatgtgtctctacacatttgaagaattgtcatatattatcctattcctttgtatagattgtatgtagaggaggcatgtgccatgtaaatgaaagaaactatataaaaagcgttgttccttataatgttacactacatcactatgctgccatgaactttaacaaatagtcttatccaaaagaaaggcagaacatcttccttctatgttttatttgtattaaaacatacatttatg

SEQ ID NO: 141268 - DNA, 333 bp, Homo sapiens
ataactcgcggcaggttgcgatctgttagtagtatatgtgcagaagctaggactgggagagataggagaagtaggactgctgtaattaggacggatcagacgaagaggggcgtttggtgaatgggtaaatggttgatgggtggataaggtgggtgggtggatggctgatgagtggataaggtaggtaggtggatggagagatggagagatggatgaatggatgaatggatggatggatggagttagatggaggatggatgggtaagtaatgaacagacagatgggagctaagccaggaggagggaggcccaaagctccatccaacctcatgag

SEQ ID NO: 141269 - DNA, 433 bp, Homo sapiens
ctacctccgcagagttaaattcagacaaacgtgctatcacgacttactgcagttaccgggatctccaataggtggttctgagagggtgggtgggtgacccactattctgcttcacttggtggaaccccgctctgcttggcaatgtggtatatactcttagcttgcctgcatcatttgacttgatcaccctgatcacctaccccctgccttccacacttgattttagtagctgactataaaattcacatgaaggggaaaaggtgatcttcaagaacgtcatctatgattaaacttgacatgatcagatcttcgaacatcagtgaggatggctgaaggcacctcatgaaattcaaggctccacgtatcagctctgtctcataaaagggaaaatattccctaggactcttgcctaacatactgatataatatactt

SEQ ID NO: 141270 - DNA, 959 bp, Homo sapiens
agaatgccagttcctggtaagttttgagaagtactggtggcatgttactcagggttaaacaaaatttcaagatgtcagatttacatttgcctcatgaaaccattacttaatactgatttcagctataggttgttgcaggtctgtgatactacacagtgtgactggttttgagtatctcattccttccatctactcaacatactaatccagcatcagcctctctgtacctcattcccattagtcacaggagacccattttattgtaggctttcatcattataacatctgtgttgaataaatagaaacccaactagaatttctcaaatattccctgattttaaaaaaaaactaatatttcagagtcaagaatttgatactacaaaatcattgtatttattaacatatattaaatgtacatactttgttctgactttcaaacttaacaaaatgagtctaactgaatagataaatatgcttttcattaactcaggcttctggcaaaggtatttaacaggtgaaaatattaagggttgttccttcatctccttggtatgtgaaagacagaataatcttacttggggtagggcattgggcctgtctacatgcttgtgtttggtttgtgcattttcagcaccagactatgatagaatgttgccgaaactgagttcatgtgacacaacatctttctctttctctgtatcttcaggggtcactgacttggtttcatctcaaaacaccttttgatgaatcttgagctctttgacaagttttgctggtctgtttcaagacatcagtaacctctttttgcattctctgctgaaactagggaataaggctaatagtgctgcctatttcatgtatataagacacctttattaagatataattcacataccatacagttaatttaaagtgtacaactcgtctgggagcagtggcttatatttgtaatcctagca

SEQ ID NO: 141271 - DNA, 900 bp, Homo sapiens
  misc_feature (786)..(786): n is a, c, g, or t
tgttgttgttgttttcagattgtcccagtgcttcgcatgtttttggctccatgttcaatccatttgctgaacacagtgaaagtatccagtatgtctttccaccgtaccctagagttggcatcttgtttaccagaggggagcggtctgaaccccaaggttaatggcacaagagaagagaaaggaggagatgccaaatggacaccctcctccaagccgctcctcccagaagggctccaggcagctgccaggagcagaagctcgaactctgctgagagacttgctctgtggagagcttcaagaagtatcgctgggattgctgtctggagccaccttaccaagaagtcagctactattttccggaaccaagaactgtactatatttggacccataataaaggttccccaggcagcttcagcttcgtgtgttgcaaaccaaatttattccctcgcagtgccctccttttcttgcactctctgtctcagtgagtggccacactgtcctctcatctgctcaagccaggaatctcgtgtctagtttgaaccctgtggctgtagagaaagtcctcaaagaagctattatcctatggtagagtaaccctaattaacaaaaccctttctgctttgtgtgccggaatggcgggctccctggcctcactgacttcagaaagaaactcgggaactcgcggctccagaagtagacccggtgggttgggtttgcccagtccgtgtcaccccagggggggcccctctcggctcacagcaacagtcccgggcggagccagcacntggggaccttaaccccttaaggataagagggggtaccccggggcataaaacgtccagcgagagaacaacacacaagaacacacctcgggtagcgggaacaaaaccctcatcatt

SEQ ID NO: 141272 - DNA, 175 bp, Homo sapiens
gcgagccccatctagagcaggttccctctgaacatgccagttccatgcatcaataaagtctccttatgaatgaaaaagagtcctgaccaataaaactgttgtcagcctgtgcacctggtgagttgaggatagactggactttagcttgtggatacccaggctctcaaacagattt

SEQ ID NO: 141273 - DNA, 411 bp, Homo sapiens
gacaaaagagtcctgagagctaacaattcaaaaagtgctggaggtttctgtcattctgctattaatggtgacaaatcccatgttcattaaacttttcatcaatttctcaaagtttcattttcagaagtaaagtaaagttacttcttggtcagtggatgaattttagataaacacctaaaaagactggcatcactggcatagaaataggttttagacacttatcagacatgaagttctacaagtttattgtgagtatattaagttattgctatttcaagaaagaaaattcacaactgggttctaaatatattgactaatttttgtcagtttctgtgagctgcatgagttctcatatctcacattgtttttccttttttctcaccttccttttttctctaattgaaggtagac

SEQ ID NO: 141274 - DNA, 210 bp, Homo sapiens
cgagctcggaccgcaccaggcgcacttctgcagaagctactgagaattcaactgaaagacaatattccatgtaaatagacattgctctgtactcttacatacattgtccatgtgtgcccagcctgtctccccaaacaaattacaagacactcagtgactgggagctctgtcatatgacttcattggccatttagccctaacctagggtgg

SEQ ID NO: 141275 - DNA, 183 bp, Homo sapiens
gcgccattgcactccagcctgggcaacagagcaagactccgtctcaaaaaaaaaaaaaaaaaattgtatcttcatattagattcaattgtcttaggaattgaagtgaagaaagaaggatgaagaggaaattatctcttggattgctctccaggaaatccttctctatactttaaaagctcttg

SEQ ID NO: 141276 - DNA, 350 bp, Homo sapiens
gatctagtcatttgcgattatattatctcaacagttgctgagcaactgtgcatgctgttgttcaaagactggattttgttgtcttccctgaaagagtgttgagttctgctatggtaggcaggttacttgcaggtcagcttgactggtcaaggcttgggtttttaggctttgttacaatgggtctagggtagtgctgttcctgtggctggcttttctgggttctcaactggatgccagaagttctcaacacgaggatagcacctcgtgtttttctactctgcttagctagaactctaacatctcccattactggtgatctctgggatatccactcagctcacagcccctcc

SEQ ID NO: 141277 - DNA, 162 bp, Homo sapiens
cctgggtaaagacatttttattaccagtctccttccttattctgtttctggtgatctcagaactttggagaactgaattatagcttcccttcacaaaatgctgggggaactctttataatactttagctaagcattatggtccctgatgaaatgtgctaaat

SEQ ID NO: 141278 - DNA, 284 bp, Homo sapiens
gacggaaacactggcggcacatatgaggccatattccggatcagaccgggccgggtagaacagacaggacaagagcgagaaccctggccgaatggcgcgggtggctccagtacagctgctggtgacccatctggctctcagcagtgcaacgaggtaaaagcttccatactttttccttaactctaaacaaaagttactgggtacttggtgtgcatctgttactcttctaggcattgtgggaaggagatatcagaagagcccctgcctgcagggagcttacagtc

SEQ ID NO: 141279 - DNA, 683 bp, Homo sapiens
  misc_feature (683)..(683): n is a, c, g, or t
gtttctcctgcccagcatcaacgatgagccttggattcttgggatcaatatcagtcttccaccgtgaatgggaaacccatttctccctggagacaggttcctctgcaagaccactcccttattcttttttctttctttctttctttttttttttaaagtaggacgccttgttgctttagatggggtttcaccggtgttgagccaggatggtctcggtctcctggcctcgtgattcgaccgcctcggcctcccaaggtgctgggattgcaagcttgagccaccgaacccggcctgaagtgtatttttttttccttttaaagaccagggttagtagaagggtattttgaatatacaattagtttaaattggggtatagttttcagtggtctctgattaaggagatggtggaataccaaaaaaaaaaaaaaaaaaacaaaaaaacactctggtggccgcccagggccacagaaaagttaaaacacctcggtggggccaggggccccgaggcatacagaacgggacaacaggagccacaagaaacccggggacaagaaaaggccggagaaccccccgcaaaaaaacgcccgggggacacaccacctcctgaacaaccccagagagggccgaagcaaagcgggaccaacacgggggccagggcgcccaataaaaccccaaggcagaan

SEQ ID NO: 141280 - DNA, 404 bp, Homo sapiens
aagggtgctgagcatcagctctgtaaattgatgttccaccaagctcttgttttagaataaatgcgataacactgaaaaagttagagggtgggttttgagttgactcatggtagaaccaactgtggtgttgatcagccgagtttaaacaaggttgctttttgttttgttttagtagttgctgatgagaatgacccagcctgtggaagctgaccatgagatcatgatccttctctacaggacttccattaaaacttaaacatgcctttctcctccagcagggctgcctggtaccatgtcaaattgcaaacagggcactctgagcatgtttgcccgagaacaggctgaccatccacacaaaatggcacccaagccttgcctttctgttaactcccaaatctcaagat

SEQ ID NO: 141281 - DNA, 512 bp, Homo sapiens
ctaaaaaactagcaaaataagatacaagagccactgctggggctgtgaggaaacaggtgaggttttcctttgttggaagtactgattattggttcagcctccttggggcttagattggcagaatgttacaagggcaataaaactgttgatgtgccttgccaagaattctgcttttgacactataacttaactcttaaaggagaagaaaaaatgtagttgctacaaagatgtccaaagcactatttttaataacaaaaaaggaactagtttgtactcaaaaggagatagattattatacaaacacatcaatgtggcaaatattacataatcacctatttgtcattgtggtagctatatccataaatgaaaatgcgtgtgaataacaaagtaggaagaaaagtagaacaaacactgtgcacactctgatcacaaccatagaaaatccatcaatgtgttcactacctaaaattagaagaggatttggaactgtatgaatagaattattttttgtt

SEQ ID NO: 141282 - DNA, 463 bp, Homo sapiens
tatgtgccacattttcttaactttataacctgtgtggggcaggagaattaacctgcttttggattagaggctgcaaaaaagccagttctggtgaccacactaaaaagattaatgagcacttagcaccaaattaaatacccccctgcccccgcctttatgaaagtggagttcatagtacaaatgtgacagcgttaaacattgaagccattcgaaggaacctgggaagtactcaggcaccgatgagttaaaaacacagagacatccagtaagtgagttcccgctgggcacgggtctgtttatcttgcctttctgaagtcagagccaacattcttaatggttttgaatgattcagaatgtttcttttttggcagggccagtttccacgcatgggcttatgactaaaaccccttaggtgaggtccaaagcagaaaccagcctgggtgacagagtgagactatctcac

SEQ ID NO: 141283 - DNA, 317 bp, Homo sapiens
ttcttgatgttagatgtcggacctggtaggaggtgtttgggtcatggggcagagtccttatgaatagtttggcaccatcctcttggtaatcaaaatgtgtgcactttattaattcaaatgaaagctggtttgttagaagaacctggctccttcacctcgtacttgctctgtctgttatcttgtggtgtgtacagttaatcttcgccttcaaccgtgattgtaagcttgctgacactctcaccagaagcagatgctggcacagactttttatacagtctgctgaattgtgagccaaataaacttggttttttaataaa

SEQ ID NO: 141284 - DNA, 413 bp, Homo sapiens
aacgaggaagtggtgggggccgccgtgcccaggggcactggcctgggggcaggggagggaagagggatggcaacagagagatggatgggcaacatccgcaccatggagaggactctggccagcacttgcacttagcatcactgatcaacaaggcaaaagggtgggactggcctgggggcaggggagggaagagggatggcaacagagaggtgctgggatttctggctaaagagaccagaagacacccatggttgttcatggcaagactcccagctgcattcaggcatttgggaccttctgtcaccgtcattggtcattctgggtcttcagtccccaagcgaccatgcctactgctgctttcgtgggtcagccctggaaatgcccaggggcctaggggctggcctgccctcaga

SEQ ID NO: 141285 - DNA, 1569 bp, Homo sapiens
gcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagaccca

SEQ ID NO: 141286 - DNA, 308 bp, Homo sapiens
gtagaaggtgggaggctggggcccggggagtccatagccctcctccctctgagtgacgccccttcccctgtgcctgcatctctgtccgcaggtgcaaacgccatgccagtcgggaggaggcggagctcgttcagcagatggcagcgaacatcaaggagcggcaggacgtcttcttcgacatggaggcctacctgcccaagaagaacgggtaggagctggcaacctccccacccctagcacaggcccatgcccaggcctagcacagctggtccatataactctcgccttcctgctggtgctcagattga

SEQ ID NO: 141287 - DNA, 1634 bp, Homo sapiens
gcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagaccca

SEQ ID NO: 141288 - DNA, 680 bp, Homo sapiens
tatgtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggtgtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcccttgaaaaacaaggtgaatgctttgcaatgacagtagcgggttgctgcaaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactca

SEQ ID NO: 141289 - DNA, 323 bp, Homo sapiens
ggttctatcaactaggattaagtttgttgcaataaaagacaagcccaaaattgaggtgcttaagcagcatggaaatttattttgttctcactcatagaaacaagcttggagtaggctgaccctggctggtggggcagtcccatggctggcagaggccccaactccttccagctctctcatgtccttaagggaactgcaccctcaggtcaggttgtgggtcttggaacttgggcatcaggagagagcaagcgggtgaggaagggcaggcttccttcctttaaggaaattccagtccctctgtccttggccagtgatcaggtaca

SEQ ID NO: 141290 - DNA, 837 bp, Homo sapiens
attcctgttttctaatggtttgatcatagtactgtagttaagtcgagtcagcatttgctaacaatttttttctttaggtctgttattgaattctttattttgaacttcttatttggctgaattttgtcaagtggacttttttgccctaattaagtgaagttgttacgtatgtatagaaaagtacatgaataagtacacttttacacaatactcatttaaacatcacccagatcaagatgtggatcattgccagaattagttttgcaatttttggggaaatttatagtaatggtatcatatattacatactcttttgtttctttcatttaattgtatctctgaatttccatgctgttgcatgtaacaaaaatttgttgtttttcattgctgtgtagtatcccatatgactataccgtaatttattgatggacattcaaattgttccagtttccggcagttgtgataatgctgttaagaacattattttaatttttggggggaaacatgtacatttatttcagattgggtctgtacgtactggggttgctgcagcctagggcttacttatgttgagggtttgtagatattgccaattttccaaagctgctctctcagcttacattcttatcagtagcatggaggagttccagttgctcactgacactagctcttgcattatatttaatttctcctattttggtggacgtgcactgatttgtttatggttttaatttaatctccttgaaaaatattgatttgaaacatttttgtatgcctgccagccttgataatcctttttttttggtgaagtacatttcaaatcgtttgcctatttaa

SEQ ID NO: 141291 - DNA, 281 bp, Homo sapiens
ctgaatcaaagcatatgaacatttcttaaagtcttttcataaatattgccaaattttgtccttaaaagtttgactaacatcaaactttaatatcaaatttgactaaaaatatgacagaatacacatttcttgtatatctttaccagcattatctgtctatccatctaccctccatctttccttccctttctataggaatcatcatatatttctttaattaattatgatggtaaataaacctggatattggacatcttctagtttatcttttgcccattttg

SEQ ID NO: 141292 - DNA, 104 bp, Homo sapiens
tagactgcctttgcaggactaacaaattagctataagattagaaattacggtttactagccacgcaacctctggctgcaagattctgaaccttcccaaattgct

SEQ ID NO: 141293 - DNA, 356 bp, Homo sapiens
ttcttcttcaacaatctcttctactctttcactcccccatgcccctaaagagagagaagacatgtggcttatcacaggacaggttacaggttctcttcccgtagcattccactgcctgtgggaaattaaatagcagttgtgttggtggatagtgtttagtttaccaaatgcgcacaggtaagttggcctgttggaaagcctgggaggagaccctgctcacatctgtgcacacatgcacatacacaggggcacccacttggcccctgggtcgggttgcctatcacttacccaagataaagcagaactgggcctggccagaacagcagaaccagtattaatacctgaaatgggtacag

SEQ ID NO: 141294 - DNA, 665 bp, Homo sapiens
gttcaaggattcttataccttagcctcccgagtagctgggtttacaggcatatgccatcatgcccggcgaatttttgtatttttagtagagacaaggtttcgccatgttgaccaggctggtctcgaactcctgggtttaagtgatctgcccacctcggcctttcaaagtgctgggattacaggcataagctaccgtgcccagcacatatagaacatatttatgaaaacattcagattaaatgtttttcatttttatgaaaacattcagattaaacatttttatgaaaacattcagattcttttgctatcaactttcagcaagagaatgggtctgcctgtttgtctctcctttcatacctgtttgcctctaggaagttactggaaagaaaaatgttgtttatgagacataatagcattaattttggcagaaattacagcttagacagggcctcaaaagcattttccatgtggctgtggacctcccaggaggcttgaaccttacctgggagagcccagctatcgacagcacttgaggctgttgctgatatcactttgccctttgtctgtccatttctccttctcccacctccttttattgtttgggttttttgttcttttctttttctgcctaagtcttagcatttctattaatatttaaagacttt

SEQ ID NO: 141295 - DNA, 289 bp, Homo sapiens
ttctgcatccccctaaaaatctggaggagctgaaataagatcaacaaccaaaagttaaaagaaaaaagctcaatgtgaaaagatctttataacaattacagcagtttacaaagaaagagggagcttctctgtgagggtgttaactacctatctccagaaatggtcaagaagctgtaataccaacttgatggcatagaggagattttgcaacagacagaaggctgggccaaatgcacaataagatctttttcagttctgagattctgatttttagataatctacctggga

SEQ ID NO: 141296 - DNA, 354 bp, Homo sapiens
tagatttttaatgaccatcatttcattgcaagcaaatttattaatccagtgatactgatgaaactaagaagctctttggggccgggcgcgatggctcacgcctgtaatcccagaactttgggaggctgaggcgggtggatcacttgaggtcaggagttcaagaccagcctggccaagatggtgaaaccccatctctactaaaaatacaaaaaaattagccgagcatggtggtgggctcctgtaatcttgggaggctgaggcagagaattgcttgaacccaggaggtggaggttgcagtgagccgagatcacgctactgcactccagcctgggtgacagagtgagactcagttta

SEQ ID NO: 141297 - DNA, 386 bp, Homo sapiens
cagatagccagttacaacagttctaatgagtcaaatcacactacagaagtagtttccattttaaatacattatggtgttaaaaaaagaaaaaacttaattccgaaggtattttatgcatggcttcctgaacatcttttctcttaacaaaagcttgttagctttgtcgagttaaggaagtcagcatagagaagctggtatttccttgatgctaaactataccagtgctaaaaacaaaacaaaacaaatcccaacctaattaattctattttgggtctagtttccaaggcagttttcacaaagactattctcagcccactgttcctagttttgtaacttcaaccttcagtagctggaaattgttatattttgggtaattccttgacac

SEQ ID NO: 141298 - DNA, 1112 bp, Homo sapiens
gattgtaaggcactaggacttcctttcttggctcctgaaagggcctcctccacacaggggcccctcacagtggagcccctccctctggggtgtcctatttcaatgttctaagaaagaggctgcctggagggtctatatttggagtatgactcctcagcggggacaggtggatgcgtggggactaacttctgcatatttggtccctgagttttgggattattctgaggggcttgtatgggaggtgcagtgaagttgtaacacaaggcaggacatgaaaaaacttctttttcttggcaattgcttgggatcctgtacattgcccttccacttgtgagggaaaaaaataatgacacggacatcaggtgtgttgcagtgattcacagtcatccacagaccctcaccaccatctccactggaaaatattgaacactcgccactgctagggtagtatgtagtacatgaatggcagacaccggcgagatctcaagtgttacgacggatgaaaattccacctgttaagtctcctttccatccaagctctagcagttggttgttccatgggtgtggtgaggctgatctgattacatgcttatgtaaaatccaaataaagccccttgaatggaaaacaggttaatttgggaagtcactagtaaagcaggttaatttggtaagtcactagtaaagcactaggctcatcaggagttgggtcttaaatatatcctctaggagtcttctctgaagaaggtcttagacacctgaaaaaagatgctgagttcagccagaacttcaaaagttacaaatcacctgtgtaaaattgtcaatattagaaaacgaaatgtctttccaaagattaacttatagatcatattgaatacgtgctggttttgtttaggacaattttgtatttaaaatgtcaagaattactagtcaattttgaaagctgtaaaatagtttgcagtaacagaagacattttaaaatgtggcacaaaataatgtaaacaaaagaatgagtcttttgttatttttacaccctgaatattttttgtgtcaaatgaaaatggctatactgtattttctgattacaatattagaaaagaatgtcatattaaaag

SEQ ID NO: 141299 - DNA, 206 bp, Homo sapiens
tgggaaagaagatttttcaggggatgggaattgtatgaggaactcctgatgccggacacctctgaagacacgtggcccacggcatacggaaggacaccctcaaagatgggtgacagctcccaggctttgtggagggcagaggagagggtccggagagctctgctctcaagtctgcgggcctggatctctaaataggtgccgcctgt

SEQ ID NO: 141300 - DNA, 103 bp, Homo sapiens
agatacacagatttgtgctttgggcatctggagctgatgctccgggtcagaagaatgagtttctccaagacgggcctgtaaatggttccctggtagaaaatga

SEQ ID NO: 141301 - DNA, 158 bp, Homo sapiens
gtttgtgccactgtactcaagactgggcgacaaagtgagatcctgtctcaaaacagaaaaagaaaaagtctctgtgtgtacttctatggtagaatgtgactgttagaaaatactctagaattggctgggtgtggtggctcatgcctataatcccagca

SEQ ID NO: 141302 - DNA, 268 bp, Homo sapiens
cagtagttcatcatgtagcccaagatagggtagcccaagtcagcctaaatctcgtggtgcttcagtggcactgaaagccaaccatagcttccaaacctgacgtagatactttaatgtgataaagtggagctaattttcccatttcatgtgtaagtagatgcaagagtgcactcacctcaatgtggtttgattcctatcccgcaaaagcacacttcagtctcagtattcatgatggtttcagttcacttattggtcattgtccctttgc

SEQ ID NO: 141303 - DNA, 149 bp, Homo sapiens
ttccaatctcagtactgttctagctgcgctttatctggggccagagtcactgtccccttggatctttcccgtggactttggtgcaggctaggagatgcttctgtgcccgctgccagatccgcacccttgagtctgatctgtctctttca

SEQ ID NO: 141304 - DNA, 183 bp, Homo sapiens
gagagtttagggtggtttttcttttggtgaggggatttgctctggtttcacatccattaacacaaaacatgagctagtcagggcccttgtggtctgcggtaaggggatgcctgtggagaaatgggcctgagtgagtcaggccaagagaatgtcttccttcagaatggagtcaactggataact

SEQ ID NO: 141305 - DNA, 184 bp, Homo sapiens
taatgcttacatcctctgtaaagaaagttatcaataccatttgtgcaagacatgctaagagatgaccaccaatgcccattcctcttaacgagtgcatttaagaaaagcctagacattctttaagacaaagcaaaacaaaatttgtctcttaggttggagtattagtctgttctcatgcttctaa

SEQ ID NO: 141306 - DNA, 257 bp, Homo sapiens
cttagaatcccactgtcttctttctggttctaacagaaagcatagtctctgagacatgagtgcccttgcctacttagtccatgcttgcttaccttatacttgctgtcttagtctgtttgggatgctacaacaaaataccatagaccagatagtttataaacaacaaaaattcatttctcagttctgaaggctggaagtccatggagcctgtgggtatagtatctggtaagggtctgtttcctggttcgtagataaca

SEQ ID NO: 141307 - DNA, 289 bp, Homo sapiens
ctccggcaggagcccaggtccggagcttcccacatccaggcgtcccgtccgggataggaatcccgctcccctccggtgcccagcctcggctcctcgcattgcccctcccgggagaaccccactccccgccctcgcgggttagtccttgcactgcctgtttggacacaaagctctgtccatactagcgatgcccgatctcctggaccttctttgcggaattacaccccggatcttaatacgcacgcgcgcctgcgcatacaccccaacacacacacacacatgctcacac

SEQ ID NO: 141308 - DNA, 810 bp, Homo sapiens
tctcggctcactgcaacctccgcatcccgggttcaagcgattctcctgcctcagcctccagagtagctgggattacaggcacctacaacagaagacaatccataaatgaccatgtgatgggtgctccatcaatgatgaaaggaatgaatgagtaccttttatggcatggtgggaggtggaggtggcgggagcacttgaaggtggaggagattggtacatgcctgccccttgtgactgaatctggaacaggtgcacgtttctgcctgcttcgtgaagcaaactgccaaagtcgaaccaaggccagtcaccctgcagggccctcatctcttttcttgagagagtccaaagactgtgggactaggcctgctggtctgctggtgttctcccatctctgcctctgagcaccctgctggaaaggctaccctgagatgttggtggactggatctctgatctagaaaaaactgctcagaggcaaaagctacaagaggcacgttctggcatgaatgatactggctcttccggcccccagattgcagatccacagagaagactatgggtgaaagatgaccccaggtgtagaacttcatcttaggaagagatcacccaaccagagacttcgtacacatcatttggttgattttagttaacgagagcatggaagatgttggaataattgctaacaatcctggccggggaaattaggaagcccatcctctaattaaaatttaatgtagaggaactgaccatcatgaatgaatggactcaattccttgagaagaagacagataatttcaaactatttcctagaa

SEQ ID NO: 141309 - DNA, 145 bp, Homo sapiens
ttcaaatgcatttgttttattacattcaaacagaaaaaaataaaaattttttgtgaataaaagttgatgcaacattccatttctgaacccataaaagtagataggattttcagagttggagcagagaggagaggtgattaaaggt

SEQ ID NO: 141310 - DNA, 314 bp, Homo sapiens
cactagtcaatgatggcaaatagctattttcagctgaagagggatgaacgggggttcaaatcactgaatctactatagatctgtcaggaaggaaagagactgctacttttctcataaaccttcatcccaaatcacgatttacctaatttaaaaaaaattttctttggcatctttatataaaaatgaattactaaaaaaaaaccaattaacaacacatgattcaggtagttctagctaatagaggtgacacatatagggaaagcaatgatcagaacagggtagaaagagaagataaaaagcaaatataattttac

SEQ ID NO: 141311 - DNA, 556 bp, Homo sapiens
actcactgctcagcaatcctcccatctctggcctcccaaagtactgagactacaaacatgagccatcttcccctcccctaggaacctttggggagattgatttgagtaatgacaccgtctcccacgtggcggtgttactggccgcaaatctgtatagctctgcagcaacctcagttctcaccttgtcagaagaaggaattcgattgaggggcataacgcagaagaagagaccgaggcaagtttcagagcaggagtgaaagtttattaaaaagttttagagcaggaatgaaaagaaagtacacttggaagagggccaagcagacatcttggaggtcaagtgccccatttgaccttggacttagggtttgatatgctggcctacttccagcgtcgtgcaccccttttccggtggaatgcccctggaaggttaccagttaaactccgccattttgcctctcaattcacatgcttgggcccactcacccagctcctgagatcttatcaggaagctgctgatcaccagcttgtgtttctagctcttgggaaactgcctttc

SEQ ID NO: 141312 - DNA, 2438 bp, Homo sapiens
ctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtccgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 141313 - DNA, 299 bp, Homo sapiens
  misc_feature (17)..(17): n is a, c, g, or t
  misc_feature (29)..(29): n is a, c, g, or t
atatacaatcagctcgntaccaggtcggnagtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 141314 - DNA, 1320 bp, Homo sapiens
aagtctgtcccttggagaagatgtgaaagcagatctgtcaaacgcaaggatgtccaggcttgagtgttaaagaaaacaccagtgcagcttatgatgcagcttgtacagcgtaattccacttttcgtaaaatactgtatgagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 141315 - DNA, 2059 bp, Homo sapiens
ctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtccgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaaaaaaaaaaaaaaaaaaaaaaaaccggtgtgggggcgcgccgggggcccgcgggaagaggttttcagagaaccatgcggtggggcggcggggggccccgagaggggagaagagggaaagagggggccaaagaggggtgttcccagaggagaaactcggggcccgagagaaaagagggcggggaattcctccccacaataaaaaaagacgccgcggggggcaacccgggagcgggttcgcggaacaacaaatccacgagagaggggagttcggaggaggcacactaagagggggaatcctaattaacagagagggagtccaccagagggcgggagcctggcgagatatatataaagatattaaagccccccgcgggacagcggggggacaacgcacgcacgcgcagaacacagcagaagcgaccagaagcacagcaaaacacacaaagaaaacgaaagcaaaacacacgaaccaacagaagga

SEQ ID NO: 141316 - DNA, 249 bp, Homo sapiens
ggaacagggggacagtgtgggctctggaggcagccaggccggggtttgaatcctggctcttccacttatcgaacccttcaaggtgggggcccctctgcctggaggactcagtgaagggacattctgcagctgtccagaaacaggaaccaggtggagcaggggcagcttttaatggctggtcatgtctttcaggagtgactggctgcaggcaagaccaaggccaccactgtgggccctccttccagtcag

SEQ ID NO: 141317 - DNA, 2919 bp, Homo sapiens
ctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtccgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaaaaaaaaaaaaaaaaaaaaaaaaccggtgtgggggcgcgccgggggcccgcgggaagaggttttcagagaaccatgcggtggggcggcggggggccccgagaggggagaagagggaaagagggggccaaagaggggtgttcccagaggagaaactcggggcccgagagaaaagagggcggggaattcctccccacaataaaaaaagacgccgcggggggcaacccgggagcgggttcgcggaacaacaaatccacgagagaggggagttcggaggaggcacactaagagggggaatcctaattaacagagagggagtccaccagagggcgggagcctggcgagatatatataaagatattaaagccccccgcgggacagcggggggacaacgcacgcacgcgcagaacacagcagaagcgaccagaagcacagcaaaacacacaaagaaaacgaaagcaaaacacacgaaccaacagaagga

SEQ ID NO: 141318 - DNA, 334 bp, Homo sapiens
tcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtacccgctcgccgccgcacgccctcactgcgccgggggacgactgcgggaatgggtgggcgagtggccggggcgggatagaggtgtgtttaaggggcaagctgccccgcccggtccgaccctggtgcccagacaggtgtgggcagtccta

SEQ ID NO: 141319 - DNA, 588 bp, Homo sapiens
ggtcggtcctacttttcacaggagttacagtcctgttaggagacaaaacacaaatattagttcatttcatcctcacaagcaccatgctagctagcaaggtggtcttcatcctttcttagcagaggtgcaaactgagatccagattcaccacacactcctagtccatccacccccagccatgcaattgcttctctgaaccccaccacccccacagcagtgcttactcttgaactatttatctgacgcatcacatgtcactctgcagggatgcagctgctgaatctgggtactgggaatgccacaacctgcagttttgccaggtatgctcacctatcaggaaaggactgctccagtatgaaaagatgctataaagtaactcttgagcattgccctgaggttacagttactattagtatcattgatttattactgctgtacccacttgcttgctgttatagataaactccaattcagagagaagttgagaaggagagtccttggtgctctttctcctgtgccctttccatttctgcccatgaagatgatggctgctttctctgaactccttgacccttgcttagcaacaag

SEQ ID NO: 141320 - DNA, 900 bp, Homo sapiens
agtttgggactagcctggccaacatggtgaaatcccgtttctactaaaaatacaaaaattagccgggtgtggtagcaggcatctgtaattccagctacttgggagactgaggcaggagaattgcttgaacctgggaggggcaggttgcagtgagctgagattgcgccactgtgctccagccttggtgataaagtgagactctgtctcaaaaaagaaaaaaaaaaggaaagaagagattctggaggtagaaacaagaaatagtttcctgatctttgctgggcaaccgtacttttggtaatacttgattaactcaaatcctctattgctttctaggaacttgtttgactagattatatcgtatatcattagcagggtgacagttacctactaaattttgaagttatatgaataatctttattttcaagaatcttatgaattttatatgttctgcaaaaacaggtaaaacttcattcctcttttactctatttaaaaaaactgtaatggatggatatatataattgcgtgtgtgtaaaagtaatattaatatatcaatatcatgatcttactggtatatgtttttctaagagaatttttctaagagaattaggtaagcctttccccactcttttaacatcttagtataataaaaaattgagtgagagtattcacacccagagatactgtccaaagtagaagaactagcttcaagactgggaactgactagggtgctaattagagcccctctgtagtccttttatagaaaatggtaaactcaggccattgcctatgaaaacattgaaaagaagggaaggaggagaagggttctggaggaagcaaggaggaaactgccaatgatggtagtcattgttctgaagtcagtttggtgcccaatctaag

SEQ ID NO: 141321 - DNA, 693 bp, Homo sapiens
aaagctgagtaagattggaatcatggagttagggtggtccatccaccgccatttctttctttaccaagcatcacctggcagcaagaataaactagtactcttatttaggaaaacccttagaaaattaagagataaggaaaacccttagaaaattaagaggtatcaatgcaacctccatcaaaataccagtgacattcttcacagtcatagaaaaaagatcctaaaatttatatggaaccacaaaagagccagaatagccaaagctatcctgagcaaaaagaacaaaactggaagcatcacattacccgacttcagattatacaacagagttatagtaaccaaaacagcatggcactggcataaaaacaggaacagaatagagaacccagaaacaaatccatatgtctgcagtgaattcattttcagcaaaggtaccaaaaacatacattggggaaaagacagtctcttcaataaatgatactgggaaaactgatacccgtatgcagaagaatgaaaccagacccactacctcccaccatatacaaaaatcaagtcaaaatggattagagacttaaatctaagccctcaaactatgaaactactaaaaggaaatattggggaaactctctaggacattagagtgggcaaagatttcctgagtaatacctcacaaacagaggcagccaaaacaaa

SEQ ID NO: 141322 - DNA, 405 bp, Homo sapiens
agacacacaggtgcttcatcagaggtgctgctgtgtggggaggaaccttcacatgcacagaaggccacgtgcatgttttcccttcaatacccagtcacatcccagcacacacacccatagtcacacagagccatgccactcactgagttacacacacctgctcactgtgcacataaagatgaccatgcactggtctggctgtgcccacacacactcacatcacagacaggaagacaaagcacactcacccccttacactcactcacacacttgccggtcctggtgggtcatccacctcccacctaaagtcacttaatctcagcagagttcactctcatcagacaccaccacaccctcacagagggttacactggtccagggtccacagcctacacccacaatcat

SEQ ID NO: 141323 - DNA, 141 bp, Homo sapiens
agttgatggcagaggcagcagaaaactcccacccctgtctgaagtgctctctaaaaatagactgcaataaatggagccaaaataattcccccagcccagctgctggagcactctgggcacggtctttgacagcctcaccat

SEQ ID NO: 141324 - DNA, 111 bp, Homo sapiens
aagaacacagggattgttaagtatatgtaatgttgtcattctttggcatcactttggcgaattgcttttgtttttacccatgtgaggaaatgtagcaaaaagacagtatct

SEQ ID NO: 141325 - DNA, 359 bp, Homo sapiens
tggccgtgtggccgagtggggtgggacatcggagaaacggtgagtgttgcttcctcgtgcgtgttcacgctttctactctgaatcgtgagcagtgaatacacgagttgtgcgtgtggcggcagcagaagtgagaggtgccagtttcctcagctccatcctgggggctgagcgaggctgcagcagaaaggcctgggggcatgtggaaagaggatggctgaaggtggtgggtgtgctggcaggggagggatgatgaaggtctggcccaagacgggaacgaggatggaagatgagactgagggatgttcacgagccagagttgttggggccagggaagagactgggtgcagatgggatgggg

SEQ ID NO: 141326 - DNA, 364 bp, Homo sapiens
accagaggacacaagacagaaagatcttccgtgaaaagaaggggattagtgaatttctgcatgctacaagtggagaacattattctccttcttcttgctgggctgccagaacaactgctccgtaggtagaatatgacagtttggcttggttatttgttgcataagatgtgttgttgtgaattataagattgctagttactggaaaatggtacatttagatttacaaataaaaatggaaatatgacaaaattagagctcaggaaatgtaggtattttgaaaagtcactcttgtcttctaagcctttatttctacgtaataaataatgatgttctttagcagttatattattaaaaagtaaaaagt

SEQ ID NO: 141327 - DNA, 656 bp, Homo sapiens
gaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaactcctgacctcaggtgatccatccgcctgggcctcccaaggtgctggaattacaggcatgagccaccgtgcccggcccgttttttaaatggtgacaagtccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggac

SEQ ID NO: 141328 - DNA, 180 bp, Homo sapiens
caccgcccacaaggtgcaagtactggtttatccctggttttggataaagagactgaggcatggacgcgtgggtatcatagctaatcatggtggagtggccttgagcccagacagcccggctgcagagcctgtgctctgatgatggtgggacggccgcacccggaggccctgggatgtggg

SEQ ID NO: 141329 - DNA, 138 bp, Homo sapiens
ggacactgctgtgaccctgtagctgcagacatgtgacatgtgtctccacgaagggaagaggctgccgtccactgtcgctttctgcagtgacactgtgccctggcccgggctctctgctgggttgcagaagtgcctggg

SEQ ID NO: 141330 - DNA, 362 bp, Homo sapiens
tgggttgaggaggtaatagaaggtcagaaagtaaagatagtaaatatagaccattctttcaagaagtttggctgtggggctgggcatggtggtccatgccttaattccagtactttgcgaggcctaggtgggaggattgcttgagcctaggagtttgagaccagctggggcaatataatgagatgtcgtctcgacaaaaaaatttttaaaagtagccgaacatagtggtgcatgcctgtaatcccagctacttgggaggctgaggtgggaggatcacttatgcccaggaggttgaggctgcagtgaactgagattgtgccactgcactgtagcctgggcggcttagtgagatgctgtctgaa

SEQ ID NO: 141331 - DNA, 556 bp, Homo sapiens
gtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatata

SEQ ID NO: 141332 - DNA, 380 bp, Homo sapiens
catgattttaccgtccccttcctagagttctccctttctcccctgcccaggctgcacccctggagagcccagctcaggcccctggcccctatgaagcctctcctgaataatccatcagcctgccctgagctcatccagtctccagtgacgattgtgctctccaccagcaggacacaccggagcactttctctgtccctgagaattggactccattccacagttaggtcctgggtcacatacagacatttcacatcccctcctcagtattccccagcagcgtgcagcacagtgcgggcttctaggaggcagtcggtggatatttacccatgattttaagaggtctgtcttgaccaggaatgttgagaagtgcgcctgggtg

SEQ ID NO: 141333 - DNA, 210 bp, Homo sapiens
catgggttctgatgagcatgaaccaactggcatgaccaccaggagccaccatctctccagcccgggaagggcttgtgtgtgttgggggaggggagggcacgtgcggctggtctgaggttttctcccgtgtgaaatgtcagattcccaggacttttagagttccaggcatgtgtcctgggtcccttcgccagagcctacaccaaaggctct

SEQ ID NO: 141334 - DNA, 448 bp, Homo sapiens
attttttattatggaatatcttaaataaaaaatgataataaataataaccagtctatcacccagccttatcaaatcttactattttgctatatttacttctgaccactttttctctttaaaaagaaaatattggctgggcacagtgggtcatgcctgtaattccagcactttgggaagctgaggcgggtggatcacctgaggtcaggagttcgagaccagcctgaccaacgtggtaagaccctgtctctactaaatacaaaaaattagctaggcatggcggcgcatgcctgtaatcccagctacttgggaggctgaggcaggagaatcagttgaacccaggaggtggaggttgcagtgagcccagatcgcaccattgaactccagcctgggcaacaagagcgaaactctctaaaaaaaaaaaaaagagaaaagattatagatataatt

SEQ ID NO: 141335 - DNA, 456 bp, Homo sapiens
catcaagagggatgactggcttggcacacacagcggctgggatgaccctggaaaccatgctcagggtgagaagccaggtgagccagttcctacagaatatcctgaatgggaagacccagacacagaaagccactcaacggtcgccaggggctggggaggcgggaagcggggagcgaccgaggaacaggcacgcacggggtttcctctaactccaaagctgctgaatatgccgaaagccaccccctgaaacacacggagctcgtgctgtgacgactacacctcagcaaacctgcttccagaaaagtaaacaaccctcacctgtctcaaactcaactttctttgctggctatcgtcatctccaaatactaaagacaggtttctaaagaaacaacccaggggcaactggatgatgggactcagcatcaaggaaaaatcaatcccgtggggcccagctga

SEQ ID NO: 141336 - DNA, 543 bp, Homo sapiens
tctgtgacccatagttggagtcactgcaaacgtaacctctcttagtctcaacacacgtatgtttattagcatccttgaggagacctgcaatgaaaacaaaattacctttgtttaatctacttttccgaacttatttgatcccagggtcccccatctctctcttacacacacatacacatgcacccacacacacacaatgcccattccatactgaggaaccctgatccagtggaatttttcctatccttctgatctctcaggagaataagaaatatcgtctgaaaatctggaaatcattctgcttatctttcaagatggacacatatttctttgtctacgaaactttcctcagagaccactatttaataggaatctatccctttttctgcacaagtataagaattactaactcttctcatttttcatgtgtgttgtgtaatgcctaatatttatgggtttgtgtgtgtacagaatcctgaataatagagactcagtgatggagttaactttcttcttttttccactagagcataattttagatt

SEQ ID NO: 141337 - DNA, 385 bp, Homo sapiens
catgttgtatgcgggctagcggggaagtgtgtgagtgcatgtgaaagatggcggttccatggaggaaccaagtgcggggagtgatgtgtgggggccgcagttctcttagcgtagaccatacactctgagagaaccatgggactgaccgggactaacagtgttccacatatggcttagggaggtgacaatgaggtgaggagtgactgctgcctaggaggtcgttcaggagagggccaccctccctgtgcctgccactccctcggggaccaggagggtccagcgacatcatggggtcggatgtaggttgaagtctcagcagagcaccgtccacagtaggtggacagtcactcctgctcccaacagcgggaggtcacaggaaaccatg

SEQ ID NO: 141338 - DNA, 389 bp, Homo sapiens
cggagctaacctcctgccagtcctctggcttaagttctcctgacggtgctccagcctaatctcctgaacagtctactgcctaactactcccttgacgatccttctgtggctatggggtggttgcttcagtctcttgctggcctctgctctaaatcctgctgtggctccacattgcccccacgcttctgcctcttccctgttctggctttgctgctctttggcttccagtaatctcgatcctcctaagtctggctcctttctccctcttccttcactctcctgccatcctggatgagcctccctcccagtctatccttcaagacctcaccttctccaagctgttgctggccacccatgctcctgggtgtggggtgggattgctgatataa

SEQ ID NO: 141339 - DNA, 213 bp, Homo sapiens
tggctcctgaaatttagtgtatgcatactaaggtctacctctagtgggataggataaaacagtcaggaagatattttcctaaagtaaatactgcttccactcagtttttcattgcaaactggataatagccatctgcagataaaatttttgatgggagtacatgatgagagtactttaaattgtttgtagaaagaaaagctatatactttaac

SEQ ID NO: 141340 - DNA, 449 bp, Homo sapiens
taagctggtagggaaagctagtaatacacacatactcaccacacacacaggtgggtcagagaaaaaaaacaagtacaaatggcttagggacatgagaagtgtggccctaactttcgctgaaagggaccctattaacattaaccctcacctctgggtcagagagggttggcactctagggcctgccttgaagctttacctactgggaccaaaaggactgcttggaaagctattttaggccaggtgtggtggctcaagcctgtaatcccagcactttgggaggcagaggcgggtggatcacctgaggtcaggagttcaagacaagcctggccaacatggtgaagccccgtctctgctaaaaatacaaaaaattagctgggcatggtgggcacctgtagtcccagctactcgggaggctgaggcaggagagtcgcttgaacccgggatgcgg

SEQ ID NO: 141341 - DNA, 380 bp, Homo sapiens
tcgctagtgggcagggatacgtgcattcacaaagtcacccgctccttaagggagacgttgtctactccggacaaggctcatgtggaggggcctcttcccgttctcctcttcagaatgacaggagcctgccacagaagagtactcataagtggagcgactaccacttacggatgagttgttaaatacaagacaggcactacaccaggtgcacaagagcgagtcacccaacttgtcctcatcccggcctagcaagggaggtactgacatcatccccgtttcacagatgccaacactgaggctcagagaggttaagtcactgacccgagattacaccacatgcaaatgtggtgaaggaaggactctaacccccgtctctgcag

SEQ ID NO: 141342 - DNA, 531 bp, Homo sapiens
gtttggaatgtcaggatcaataatagtcctcagaacattgtaaccttactccagcaactatgctaacataaagcagagaagtctgaagtctgtccattagtattggtgacaaggtcatggttgcttttaaactttgcttgccaaaatacctggagggaactcaatgtgcatactcaagtttctgctgtggcaaattgactgttgctaccccaggagaccctaggaagacaatcagttcatgtctgactggagacattgcaactttatttgtatgaactatttgggtcaaatttcagggggacatgtcactacagaggggcagagggtcatgataatgaaaagaatcattacgttatattggtaattagatgtatgactctacaaacttgtttttccttgggtgttagtaacattctttttggagatagatggcattttacaaagtctatccacagaaaactggaagtatctaaagataatgataatgacgagaatatattcattgtaatctggcatacagaattttctctg

SEQ ID NO: 141343 - DNA, 232 bp, Homo sapiens
accctatagtagccttcgggcctcccctggcttctggctctagcgtggctcccatgattcagtcttgtttggagcctcctccatccctggcttgagatcctccctgtacttctggccaagtatctgggccacagcactagcccagcctcctgccccctgccccctgcccttgatcttgtccccagtctcctcccaaaggcttatctgagtccaaggttggcattgccgtaca

SEQ ID NO: 141344 - DNA, 395 bp, Homo sapiens
attgactccgacccctccataatgtgtgcccacaagatctctgaaagacatagtccgtcttttcaagtcaacgtaagaggcctctgggataaggtcctgccctcccacagcccaaggcatgatccctcaagtcccatgcttagtaaggggcacaagcccttagaaggtcacaagacaatatccaccaaatattgtctacatatttaatcctttgactcagtagtccatcctgaatattattcaacaaaccaaaatctctttccaaagatgctgtttacaaaaaattagccgggcgtggtggcgggtgcctgtagtcccagctacttgggaggctgaggcaggagaatggcatgaacctgggaggtggagcttgcagtgagccgagattgcaccac

SEQ ID NO: 141345 - DNA, 263 bp, Homo sapiens
tttattgaaaagactctccttttcccattgcgtgttattgatgcctttgtcaaagataaggtggctgtaaatgcgtggatttatacctgagttctctcatctgtttcactgatccatgtgtctgtttttatgccagtaccatgctgttttgattactatagctttgtaataaattttgaagtcaggtagtgtgatgcctccagcttcattctttttgctcaggattgctttggctattcatagtcttgtggttccatgtaaat

SEQ ID NO: 141346 - DNA, 579 bp, Homo sapiens
cgctggtggccctgtaatcccagctttcttcttggcttcctatcttgggtctctctctagaggctgccacattctctcacaccgtaggcccttctgggctctgtcttcctcatcaaattcccttcccagccccaccttccctgcgagcttccttagaacccatctccttggcctggctggtggccctgtaatcccagcactttgggaggccgaggtggggagattgcttgaggtcaggagttcaagaccagcctggccaacacagcaaaacccgtctctactaaaaatacaaaaattagctaggcgtggtggagtgtgcctgtaatgccagctacttgtgaggctgcggcaggagaatcacttgaacccggaggcagaggttgcagtgagatcgtgccactacacttcagcctgggcgacagtgtgagactctatcttaaagaaaaaaaaattagaacctgtctccctgccaaaggcatgagttgggtgccagccacccttgaaacatcactgcctgcacccctatgtcactggttagatgagaacacctcactatctctggaggatcgacacagtctt

SEQ ID NO: 141347 - DNA, 444 bp, Homo sapiens
  misc_feature (14)..(14): n is a, c, g, or t
ccctccccgggttnttgcgggggggcaatccccccgtgaggacccccccaacacttagacaggccgggtttgacaatatatatcaaacttacaaatgtatcttctcgtttctggaagtggatcctataggtaaacttaggaatgtttgttatgtgatatatacaaggtgattcctacaactattgtgtgtaacagcaaacgatttgaatattatcaacagtaatccaaaaagtttgttaacatttttctccctttttctattcatatctgcatgaggctggattttcttcatatatgccaagacaacatacagcatcagagtagggaaaagcccaaatgtccattaataggaaattggctaagtaaatcatggtacagcaatacaatggaatattacatagtcgaaaaagaatggtaggatgaggtccattcagtgacaagaaa

SEQ ID NO: 141348 - DNA, 488 bp, Homo sapiens
gtggactgcatctacccagcaggtgtgctgagctgaaggaagaagatggatggggacagagtatagaaaagaaagcaggtagcccagatagggtggttctcaaaataagagacaataagggtaggatctctccttataagcttgaatttatcctcctctaattcctagtggcactatacattttaatagtatttgaagccacgttagaattatgacagcatatgttaaaattgtgcaagtggttcagtaatataagctaacatttcctgaaatgatttaaaaatctggcagactgcaaagttatcctgataaggaacttggttttgattacagtaatgagatatacgggatggtgtcagaaactgtcttccagttgacacaataatccataatttatagattggcttaaaaattaaaagacaaagtcaattataactaattatgatgctacatttgctcgaggagttactatatcctttgggataaag

SEQ ID NO: 141349 - DNA, 310 bp, Homo sapiens
ctcactcaccccttgcccccgctagaaaggttgttcctgtctacactgaacagttccaaatcacagtaagcacatagaggtcagtgggtttggatcaaatcccagctcacccctcattatatgaccttacacatcacttaacctcccttagcctgtttttcttttcttcatctgtgtaacagcaacaatgcatgccacctgccacatatccctcatgggcttgttgtaaaattcagtgagaagatgatgggtttttcagtaccatgtccagcacgtggtacacatgcaacaaccacccaatctgatccga

SEQ ID NO: 141350 - DNA, 384 bp, Homo sapiens
gcaggggaatcgcttgaacctgggagatggaggttacagtgagccaagattgcaccactgcattctagcctgagcaacagagcaagactccaactcatatatatatgtatatagtaaatccatcgtgttctctatagatttcttgatgtttccagtttttctattgcaaatttatcctttatgattattcttgcatatgtttctttataacatataagaaattaatatgtatgcaattcagtataagatgtgtttcttatggtaggtctctagggcagaggttggcaaactttttctctaaagggccagatagtaaacattttagactttgtaggtcatactgtctctgttgcagcagttcagctctgcctttgtagcataaaa

SEQ ID NO: 141351 - DNA, 303 bp, Homo sapiens
ttactctattgctcaatggacctcatcacattgaatcctcacaagaggttatcatctttatagatgagaaaatagaaaggtcaagtaacttgcttatgattacaaagctactacattggagaatcagtattcaaacccacatatatctgacttcaaagtccaaaaaattcattaaggacaagggccatgttatctatctcactcttgaatccagagcttggcccctagtaggtgcttaacaaatacttattaaatcaatgtatgaacagcaggataggaagaaaacagaggatggaacgctgg

SEQ ID NO: 141352 - DNA, 483 bp, Homo sapiens
atacaagcgtacatgtaattatgtaacttacctttatggattgattgaaggttgaaaatcagaccatttcatttcttttatagagatatctgaaaatatcagtgttgcattttaaattttgtaaacttaaagtccattgtctataaatgatctgtttctgaccttcacagaaagtttgggagaaaagatttactctaatattcaccaatcatagttgcataaaatctagactgtctccagagtgtacaacattattttaacatacggcttgcattactaatagagtttatatgttaattcgtatggtattctagatacttaagttttgtacctttcaaaatagaaaagaaatataaggtcattttcttcacatatttcatatttaaatgattacttcgcttagcaaatataacttgttacatgagtaagatcaaggattattaagacactgtatctgtatctcagccatcctgaaaatttgtt

SEQ ID NO: 141353 - DNA, 111 bp, Homo sapiens
ggattacaggcatgagccacactgtacccggccagaaactttcttaaagctagtttaaaaaccgatcatttggtcctcatttcccattttggctttgtttcttcagtgtgg

SEQ ID NO: 141354 - DNA, 743 bp, Homo sapiens
ccaaagactgaaaatgatgcaaagtgaattgtttctatctttgcaatccaaacgttcctcttcgtttactctccagatcccttccagcaaattggtattgccactctccctccatccctgggttctcggggctaattctgttccagctcgctctgtttagctctttcttcgagcagaacccaagctaggatcttgccttccagagaatgctttaaaaagccttgtttcccaatatactgcgtttcagttttccacgagtgcagccatgctcgggagaggcgtacgagctgcttttacatgtgagaggtgaacaaatcaaaggtgagcccgttctgcctcagtgaggccttttgtgtaaaaagggccttctggagtaaagcaatcaggttgactgacaactgccgaggctaccagtgacagtcctgctccgtgggataacttggagaaaaatcagggccaaaagcagacaaaaggatgtccagaaactggaggtggggaagcctgagtgagatcaaacaacctgaaaatgtgtcttccatccatttagggctttatgtgcagcgaggttggagtggctggctgaggatgtcaacattttaaatttgtcactgctttgacttccctagctttatctcccttcagatcaaagcggggagactaggagttgtcactactggatttggtttcagactatgttggtgtacccttgctttatgaccttggggtttcctgtctttgcttgg

SEQ ID NO: 141355 - DNA, 643 bp, Homo sapiens
cctacatcgagcgtagacggacggataaacagacatggcacctacatccatgaatggatggataaacagacgtggcacctacatccgcggacggatggataaacagacgtggcagctacatccacgaacggatgaataaacagacgtggcacctacatccacgaacggatggataaacagacgtggcacctacatccacggacggatggataaatagacatggcagctacatccacagatggacaggcggataaacagacgtggcagctacatccacgggtgggtggacaaacagatatggcacctacatccacggacggatggataaacagatgtggcacctacatccatggacggatggatgggtaaacagacatggcacctacgtccacagacggatggatggacgaagagacgtggcacctacatccacggacagacagaaggacaaacagacgtggcacctacatccacagatggatggataaatagacgtggcacctacatccacggatggatggatggataaacagacatggcacctacattcacggacggatggatggataaacagatgtggcacctatatccacagacggataaacagacgtggcacctacatccacggacggacgggcagata

SEQ ID NO: 141356 - DNA, 489 bp, Homo sapiens
tgataaatttccttacgttcatttttttgctccattaggttagctcattactcgttttgttaatatctccgatttatccacggttcccgtcctctacccccttttatttgtatcttagtataagcggaacctaccgtagaactccacttgaggcattacactcatgaaggatggtcctaatcacctcggccctgttgtctgttctccgcatctagtgccgaaagggggatgtgcctgcatctatcatctattatcaccatcattttaagaagaaagaccattttgacactgaacaattatatttactaaagcatcagaggtaaccaaggtgttaatcatgaacacaggtcttcatgatgtggctgagagttcctggcttagggactgtggttactaatcatcaacattccctggacctgcagggctggtaaattctaccaatgccttttaagatcaacactgtcacccgggaggcggagcttgcagtga

SEQ ID NO: 141357 - DNA, 310 bp, Homo sapiens
aaactgaggaggaggtgggctgagtggaggtaattgtatttgataaactcaattactacttctcagcaactgggatgtgtcctgctaatacaatggaaaaaatgattatgtgttctatccctttgatgatccaagtgaacaaaagtagaaataacaaagtttctagaacctggcaacttcaaggcaagaccagatcctaaattatggaagatatttcagaactcattagtacagattggactgacctacttagcctgtttgtggatggcagatacctgaatgccaggaaaaaagggatgttggtagcccc

SEQ ID NO: 141358 - DNA, 437 bp, Homo sapiens
tagaaagaataaggaaaccagaacgcaaagggtcaagaggaattggccatgcacagaggttgatgaatcactttccatgcggagggaccacagtaacaacagcaagggctgtgagtagagtggcttgagtgagggtggagtgagacgagatgaggcaggtaggtgggaactgggtgatgtaggattttggaggccattatgagaaattcaaatattcagtgaaatgtgacactactgaaaaagtttagagaagggggcagtgtagcctgattcaagttttaaaagattgctgtggttgccatatggagactagtttaggaggaaacaggagtggaagcaggaaaagcagtgaggacaggctgctgctctaggccagacgagagtccccgatggtcaaaccagacaatgcatcagagaggactgagtggcttcaagac

SEQ ID NO: 141359 - DNA, 807 bp, Homo sapiens
tccaaatgtcatgattcagatgcacataaaatgcaaccacatccctattttgggatgaaagaagtgatgcttgggtgattaagaaatttacctatgggcacatacctggttccagaatcaggattaattggtctgacttaaaatgccatgctgcttacataactgagacaggtcaaaaagttaaagaggactaaatccagaaagacttcattagtggcttcgattagataggaatatgattttatgagcatctgagggagggaaacactttgctgtagagtttctcaaactgtgacctgtgggtcatttgcatcaagacatctggaatgtttgttaaaaatctccatttctggtttcttccccaaagctataaaattagagccagtaatctcagcactcttgggattactttgggaggccaaggtgggtggatcgcaacatggcgaaaccccatctctacaaaaagtacaaaatatttagctgggcatggtggagcatgcctgtagtcccagctactcaggaggctgaggtgggagaattcacttgaaactggaaggttgaggctgcagtgagccaagatcacaccactgcactccagacaaagtgaggtcctgtttccaaaaaaagtagagcctctggtggtgaagtttggaaatctgcatttttaacaatctccatgttttactgtaattaaagtttcaatatagtattaggaggcttatatgcccctttagataccacccaatgccccctcaccagagtccagggactcttacagtaactgtccccattgaacaactaaaggct

SEQ ID NO: 141360 - DNA, 771 bp, Homo sapiens
ggaagccaagaagctaccatctgtgctgtgtttatatctaaagaattatttagaagactgattactcagttagctgggcctcctgaccttctagtattacacttagaaaggtaactaacactttcttgaaagtcacttcacttttaataacccatataattccctcaatataaggtagggatcaaagtattgaccaaagcttcacactgagtctcatgtgttgtggatgctatgaatgatcacttgtggttaacagatagtgactcctaacagtgatatgttagtaaatatttaacaatgggctctctagggaaaaataactgattcatagcatttgccagtttccatgatggaatagtaagaacaattttataaattcaaaaacatagatgaaatatagaaattcctcaaaagacaataatgaccaaaatcaactcaagcaaagtaggaagcccaaatagccctatatttattaaagaaaatgaattcacaaatctgcccaccagaaaaattgcaagtccagatggctttactagggaagtatatcaattgcataaggaataaattacactaatcttgcacaaaacccttcagaaaatagagaggaaacacttcccaactcaccttttgattccagaatttatactgttaccagaattaggtgaagacattatgagaaaagaaaattatagatcagaaatcagtatacttcatgaatagagatgaaaagaaaattctttgcaaagtatcagcagattgaatccagtaaaa

SEQ ID NO: 141361 - DNA, 270 bp, Homo sapiens
gacctgtaatatgccaaaagaaaaaagataactgccattttagagatcaatacccacttaaaatagtcttcaaaactgaagatgaaatagacatttttagataaatgaaagctgagataatttattgccagcagatttagttatggttaatattagggtaaatacaaatgatcattttaaaaattcttttaatttcttcaaaagacaacagctaaaaggaaagttgcagtgttatattatgggttgtataatgtatgtacgttaaaatat

SEQ ID NO: 141362 - DNA, 754 bp, Homo sapiens
tgaggtctgaagtgggagtatgagtcgatacagtgaagcactgaggatgtgggggagaggaaacggttttggagggaacgagttgggtacggaagggaggctggtttgagggagtggtggggtcgtggaagggagcctggggctgggtagacagaagcctaagaaagggagacaggacatggaattgagaaaagacgagggaaggggtacacggaaggaaaagatgtggggaagagcgcgagaggcctggccagggttgggatgggtgggacaggctgagaaagtccattaggtgaaatcctaggaggcagcaggctggaaaaggttccagcgaaggtcgcaaggaaccccacaggggaaaacgtggtgggagctcagggtctcccagcaccctgccgccctctgctgggctctgcctgacaccggcgaggctcagtctgggaggaggtggagcccagggaagtgtagccaagcagggacaaggagagaccgcagcctcgtggaaaaccgggactggaggcaggaaacaggtagggagggaagggggtggccgcaaactggggtgggttggggaaggtgcgaaaggacgacgccccgtagcctaagggcagaatttcaggggggtggagggtgcagagtgaaggggagggcattgcagtgcgcgcggtaagggtttctcatctcacctgagtgtggcgttcgattcactggcagcaggaaagacggggatcagagaagagttaccactggcgcc

SEQ ID NO: 141363 - DNA, 308 bp, Homo sapiens
aaattcaaaaacctttgttcagtgttaaccttactcagtctctctgcagcatttggcactactaaccaagctctttttacttactttactcttcctgcctgggcttcagagaaaatatacatccttcaactttctcttacttcctattatttcctagcctccttcaccagctcttcttgaatggcccatacttaaacattggaatcccctagagatctctctttgtctctttattttcttactccatatatccaccttgtgtaatatgaaccactctatgacttcaacaacaatctctaggctaatcc

SEQ ID NO: 141364 - DNA, 386 bp, Homo sapiens
gtctgagtgccaggaacataagaggtgctcagatgaatgaccaaatgaatgaattaaaaataatgcacataatgactcaattaaaaaatagtagacatcttgctgaaggtaatctatgaatggctaacaagcagatgaaacgcaaattaaaaccacaatgaggtaccacatcatgctcacttggaaggcaaaaaaataaaataaaatcaagggctgggcgcggtggctcacgcctataatcccagcactttgggaggccaaggcgaacagatcaccagaggtcaggagttcgaggtcagcctggccaatatgatgaaaccttgtctctactaaaaatacaaaaattagccgggtgtggttatgggtgcctgtaatcccagctactt

SEQ ID NO: 141365 - DNA, 438 bp, Homo sapiens
tcaccttcctccaggccccacctttaacattccgatgacaattccacatgagttttggtagagacacagagctgaattttattattctgtccctggctccccaaatctcatgtccttctcacattgcaaaatacaatgatgccttccctacagtcccccaaaatcttatatcattacagcatttatacaaatgttgaaagcttaaagtctcatcagacacaaggctacagtttcttaggcccatgagcctctgaaatataacgcaagttaactacttccaaggtacaatgcttgtacaggcattgggtaagcattcccagccaaaaggaagaacgttgccggaaaaaaacaaaacacagataggacttaccggccccatgaaactacaaacccagaaggccagtcattccatcctacagttccaaaatcacccttttt

SEQ ID NO: 141366 - DNA, 496 bp, Homo sapiens
ctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttg

SEQ ID NO: 141367 - DNA, 167 bp, Homo sapiens
cacccaaacacattatactccttgctacaggtgataatgttcctgctctgtgatttttatgttaaccttaatttaagtcttccaacaaatgctgatgaaaaaaaaatacacaaaactttgtatttgcttttttaaaaaatgctagaacagtgaggtggtgtttaaaa

SEQ ID NO: 141368 - DNA, 450 bp, Homo sapiens
gaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccac

SEQ ID NO: 141369 - DNA, 281 bp, Homo sapiens
ggtgatgggagggatttatacatagcagaggcaatatagtatgggagaggtagagaggtcttggcaaatgtggagacacaatgaacatgagctgactcttcctcagtactgtgtttctccacctgacctagaaaaccttgattcctgaaaagcctcaccctaactttgccacaacctggcgatccatccatactgttcacagccctcaggagagactggataattatgaacacaccttgctttcttccatcatttcccttttccccaagggaacatagctg

SEQ ID NO: 141370 - DNA, 710 bp, Homo sapiens
catgaagacactagaaggatactcaaaaataacaaaagtgacttgctgtttgaaaagggattaaagtttatgggagcagaggccaagacaaatgtaccagtggataatttctataccatttaccttttaaaacatatgaatatatgacttacaaataattttaaaggccctccatataatattatatactttctcttgattctgggacacatttgattctgatacacttttgaaaagtctattctgatacacttttgaaagatgtaaccaaacagctcttcaatttactgtgttttaattgtttacagtcatagcatcctgcttggaccagggcagtggcatgaagcccagcacaggaagtaacttagaggaatttcttactttatagttgatagataagacatatcagtgactcagctgtctttactaattaattgaaaactgatatagccagaatacctttatagtattaatatttgaaaatgaacacgtctaaaaatgaactatgactactggaattttcttagataagggatagcgacaagacagaacttatcagtgaattataaaagaaaaacttatgaaatagttgactttatttttttttaaataatcaacagggtgagtcacatgttgtgaagatgcacactgcttctcactttttgccactaaaataggacaggttttatctctgacttggaaattcatga

SEQ ID NO: 141371 - DNA, 189 bp, Homo sapiens
caggacacttgtgatgatagaggacagaatttgtggagagatcattagccccagatttatgaatttattgtgttgtttccgaaaagtggtctgctgaagagttcactatagtaatttcaaagtaatctttaaacttagtatgcacatatgcattttttcatttttactgtattaagttttctatttgtc

SEQ ID NO: 141372 - DNA, 824 bp, Homo sapiens
acccgtctctactaaaaatgcaaaattagcagggcgtggtggcacatgcctgtaatcccagctactcgggaggctgaggcaggagaatcacttgaacccgggaggcggagtttgcagtgagccgaggttgtgccactgcctccagcccgggaagcaagagcgaaactccgtctcaaaaagaaaagaaaagaaaagaaaagaaatatattgatgccgggtcccactcccccaggagtgtgatttaattgatctaggttgaggtctgggcatccgagttttagaagccctcctggtatcctaatgaaccagctctccacagccagcctggcatgacatttagggtgtcactcgacattaaacatctgagaagcaggtttaactttaggcttacacttacagattaataaaatggaattttttgactagtggctcatctaagcagggcagccatttactaaaataaccttgtgctagctagaatgttctttatgggggaggggagcaagttgctgttcccatgaccagtgtagtcggatgcatcaactcattgtgggcccctaggtattgggatagaggcacatccttaactaggtcctgcaccctgtggcctggactccctcaccagcttcttctagaactccatggggttctagccacaccatgggatgcatacacgcttcatctaactgataacatgctcattgtttagcatttatgttagacaatggttcccccccatggcagcagctccagacctcccagaccacgtcaaatcttcctgttatgtgctcatcattctagtcctactcctacacagccatgat

SEQ ID NO: 141373 - DNA, 151 bp, Homo sapiens
tgaggatccctgggagccttaccctgacaatgacggcctgcatggtccgggggtgagggcagagtctgctgtggacacctggctgtgggcatgaggggagggtgagggctcccggagtgtttagggctcccggagggttaagggctcccgg

SEQ ID NO: 141374 - DNA, 369 bp, Homo sapiens
atgtcccattcagcagcctaagactaagtggttggtactaacagctgagtcaatgggtgactcacagccaggacctaaccctgcctcatcttttctgcctttccgtgactaatgcctcatgcccactaaggtcagagacaggacagaaattcatgcatctgcctctttggcatatgtagttttatacctctcaggattttgtcaccatttttcattttctctgttcgttaactatgtaaattttaatcatataatcatcttttaaactttttcaataacaaaaaatctgaatattttcttttcatataaaaagctcttctaatagtatgcattattctaaaactcattttaacatccttacaacaaaat

SEQ ID NO: 141375 - DNA, 432 bp, Homo sapiens
accatattaagagggtaaagaagaatcacatgatcatatcagttggtacagaaaaggcatttgacaaaattcaacactcattcattattttttttaagttcagaaaaaaataggaatgggggcatttctttaacttgataaagagcttctcttgaaaagttagagctaatattacactcagtggtgatgctttctccctaattttggtaataagacaaggatgtctgctgttaccactcttatttgacaaagtgctgaaagttctagacagtgcagtaaagcaagaaaaggaaataagagacatataggttggaaaggaagaaatcaaactgtccttatttgaagatgacatgattgtctacatagggaataataagtaatttacagaaaactcccagaattcataaatgagttcagcaaggttgcagggta

SEQ ID NO: 141376 - DNA, 473 bp, Homo sapiens
ctttttatggctcttaagtcccgaacaattatacacacccattacagttttttggctgggaggatgagaatgttacagggactgatagagatttagggagtctaataatgtgctttccactacaggttttagtcctttatagcttctggttgttgatgatattatgcaggtttgataaagatttagatgggggccaggcatggtggctcatgcctgtaatcccagcgctttgggaggccaaggtgggcagaacacaaggtcaggagattgagaccatcctggctaacatggtgaaaccctgtctctactaaaaacacaaaaaattagccgggcgtggaggcacgtgcctgtagtctcagttacttgggagactgaggcaggagaatcgcttaaacccgggaggcagagattgcaatgagccgagatcacgctactgcactccagcctgggcgacagagcgagactccatctca

SEQ ID NO: 141377 - DNA, 410 bp, Homo sapiens
ggggtctagaggatcccatcagtttacacaaaaaaaatgctgagtaaatgtttgttctatgaatgtaagtgtaggaatatctggaattaatactttcagatagcgtctgttgaaacacaagtaggagcaaagtgctagaaggctaaatatggtcagggtttctgcagaggcattgtctcagaagttttaataagctgttgaaacacagttaagcaagagcaaagtgctggaaggctaaatgtggacagggtttctgcagaggcattgtctcagaagttttaataagctaaagaaatctggtcttgagtggctagcccccacctagagctcactgctcagtagatgtgaacatggatggtggtggtacacgcattgggtgattgattgtgcaagatgaaaaatagaggtgg

SEQ ID NO: 141378 - DNA, 283 bp, Homo sapiens
ctacattcatgccctcattttgattcaagatcttgaaatccatggtacattgtagtttaggttagcatatcacaatgtgaactcgaggccgagcgcggtggcttatgcctgtaatcccagcactttgggaggccaaggcgggtggattacttgaggtcaggagttcgagaccagcctcaccaacatggtgaaaccctgtctctactaaaaatacaaaatcacctgggcctggcggccaacaaactacttgggaggctgaggcaggagaatcacttgaacctgg

SEQ ID NO: 141379 - DNA, 282 bp, Homo sapiens
  misc_feature (7)..(7): n is a, c, g, or t
tgacacntcccacaatcctggctcactggtggtcatttctcccctcagtgggcatttcctggaagactctatcctttgagggatctaacccacagacctgaccacgagccccaagtcctcaggcttcacttccccactaggcctgactacgcaagacagagcctgatgctgggggtgggggcaggctgtggcaggcatggtggctcacgcctgtaatcccagcactttgggaggcagaggcaggtggatcacgaggtcaggagttcaagaccagcctggcca

SEQ ID NO: 141380 - DNA, 721 bp, Homo sapiens
caaagcattaaaagccagttaaaatgtatgtaaattacctgaaagagcaagcaaaacctaatactcagtcagtgaatttatttactacattagtataactttccctgaatcagactccaaaggaacacatcagggctggggtatgctgggtggccaggaggagtgggttcaggagcaggggaaagagtgaggaggtgaggaggtagccctgcacgggctgcagtggggaggaaggggaacatggacagcctaggggcagctggaggcctggatgttggtggctctgtctctctgcccttcgtagatgcctctgtcacagcactttatgcattttaccacctgtgtacagttgctcctctctacctggacttccagtgtctggaggatatggggccactcactgatctttgtattttcaatgcccagtatagtgcttggaacatagtgtcttcttaacaactgttgaacaaatatccacattaataattgtggagggtgtatataatgtgaagtggcccagaaaatataattctcttacataaaattttttgttctctcccccatccctccacttctgcccagaatataagctctacacaagcagagatctttgtgctgacatatgccaagccctataaataatgacaggcacataacatttgtttggatgaaggaatgacttcaggctactttttgttatgagcattaaataagataatat

SEQ ID NO: 141381 - DNA, 520 bp, Homo sapiens
aatatgaaggttttcattataaagacaataataaaagccatgagaatggagaatattgtttaaggagaaagtaaagagaagggggtttgatattaagttctgaattactattagcatttaaggatagaatcagaggaggatgaaggagagaagaggagtcaaagacatagaaggaaagccaggagagtgtggtgccctagaagctgctgtatccctcaccaatcccaggacagtgactggccaggacagtgttcagtaattattggttgaatgaaatcaaaaggagatcattttaaaaaagagggaataattaactgaattgagtgctgctgaaagggttacatgaactattcattggattggcagcatggatattgctgatgataggggcagaagtcatgtcggaatggttttaacagagcttgcgtaggaggtgagaaagtatgagaaagatagcaggttcttaattctgatgaagtttggctgtgaagggagcagaaaaatggagtattagctgaag

SEQ ID NO: 141382 - DNA, 531 bp, Homo sapiens
acaacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcatagaccagcctggccagtatggtgaagccatgtctctactaaaaatacaaaattagccggacattgtggtgcacgtctgtcatccca

SEQ ID NO: 141383 - DNA, 1243 bp, Homo sapiens
gaaaaaagaaggaggaggaagaggaggaggaggacacaggtgtgaccattgtcctccagagctacagattctggcattctaaaggaagaaggacaaagaaaccaaaaccagtttctccaaggcttcagcttttcagtctgaccatttgatctacattccattattttggcagcatggtgggagtggattcggaatggacaaaaacccttttcagaattagatcagctaattaaaatgcacacaaacttctttgttccttcacctcaaggagcgtccttggaaagcaaacatacttcggggcatttcagtgggggcgcagtgcgagggtgtcctttgcgcctcagctccggagaaaaacgaaaggtgggtgggaaactaggatagaggtgaaaagtaagaggggactgaatcagcgaatgacaaagggagcagggctccggacaggggtaggaggaagaagaggagtgactggggcttgtgtcaagcttcttctgaatggctagacagccgccaggtgggagaggcggagggtgaagaggcgggttccgcacgcggttagcctggggctgatctagtcttcagctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgac

SEQ ID NO: 141384 - DNA, 416 bp, Homo sapiens
gcttctaagttcccagccccagttctggatgagaaaatggagagcagcctcagtagtcactttccttcaacttcaaggctgccatgagatggtcaccacctcatgaccaggaaggagcatgctgctttggtagactacacatacctccctgtggcagccaggcccccaccacccattctcatcattccacacaaacgtgagcccctaccatgaacaagatgttgcatggagcactggcagaagcagagtgagttgaaggtggcttcctcccaggactgcatggtcacagaccccagcaccagcaaagtatggtcatcaggaccacaggaagggccagagatgggctatggggcactggggtcaggaagagtgccccatcttcctgaagggtgatactggacctggtccttggagaa

SEQ ID NO: 141385 - DNA, 427 bp, Homo sapiens
  misc_feature (14)..(14): n is a, c, g, or t
cagtgcctactacntagcagccattcaaactactatcaatgccttttacaaaatgaggtcattggattgcagagttggctttcgagaagattttgtggcctttctcagctgtctaggtgctgtaggtgctgtgtttctatggctgcaaggatgaagagaaacagaagatcaaacttaaagtcacagcaagtaggtggcagagtgaagagcagatccagcagattctctgaactctcgggtgagcatgctttcagcaccacaacacaccacaatggaacagcttatgaacttcttggaaactatttaaataacaaagagaatgacctttgtcttgagtcattcattatctgtcacaggagacatgagatatcatctttgggcaaggtcttcgccccgttttgtaatttaagtaaaactttaatgctga

SEQ ID NO: 141386 - DNA, 529 bp, Homo sapiens
tccccattcgcagccttgcttcccttatcctcgaatctgccctcctttcaaaaatgcctcctccttcaaatattcacagtgcaaatccccaccattcttctaaggtcaaccccacaggaattaatctgatacaaggattcgtttcattatctcttggtgaaggtcattcttaacaatacaattcctcaatctagatgaactctacgaacatcaactgttcataggaaatgtttcttctgtttatctggatattattcccctaaatacaacataatttacagagatccttgcctcaacagagaattatgttttaagttgtgtcaaccaaaatagtgccacctgccccttgaacaatcttgacccacagctgccacccaacaacccccatttatgtataagttatttattttctgcttctaaagttcacccccaactcttgaggaacaaagaaaaaaccctatgagtgtagctttttcaagccatccaaatctttgtctcctggaaactgcccagtaaaagtttcaaaatg

SEQ ID NO: 141387 - DNA, 210 bp, Homo sapiens
acataagaaattaaatctttttttttagatgtttctcagtggtaaatgtctttacttctcagaccaagtccacatactgtattttgtatctgaattattttaacagttccaattcatgtgactattgtgttttcagaaggtgtatttatgagttaaccttctagttaaataatcacattaattaaaaatagtgcctgagctattgtatat

SEQ ID NO: 141388 - DNA, 345 bp, Homo sapiens
tgtgtagagtgggatggaagagctttatgtaaggctgtggcattgagaaagtcacccaaacctacctatgcagcttaagtgggagtaggtagtggggaagtctcagtaaccaagagggtctcgggcagaaccatgcaaaggcttattggggaggagctgggtgtcagtgaggagtgcaggtgttaaaaatgctttagtaactgcagggtcctttgcatattgagaagatgtgaggctaaatccggagctcagacagcagaggcccaggtgtctctaggacaccttattattttttacctggtctacctgtacagaaatgaatatatcacaaaacagtgctggtcc

SEQ ID NO: 141389 - DNA, 356 bp, Homo sapiens
tgtgtagagtgggatggaagagctttatgtaaggctgtggcattgagaaagtcacccaaacctacctatgcagcttaagtgggagtaggtagtggggaagtctcagtaaccaagagggtctcgggcagaaccatgcaaaggcttattggggaggagctgggtgtcagtgaggagtgcaggtgttaaaaatgctttagtaactgcagggtcctttgcatattgagaagatgtgaggctaaatccggagctcagacagcagaggcccaggtgtctctaggacaccttattattttttacctggtgacacagcatggcatgacggggggtccgcaggctggcgcccaaagcctaaccca

SEQ ID NO: 141390 - DNA, 214 bp, Homo sapiens
ctttgcccttctttttctaatttcttaaggctgaagtttagcttattaatttgaaaccttctttaaatgcaggcatttaaagctataaagttctatctcaacacagctccactgcatcccatatgctattgtatatcaactttttctttccattcacccccaagtattttctaatttccctgtgatttcatctttgatccactggttacttagg

SEQ ID NO: 141391 - DNA, 271 bp, Homo sapiens
tatggtcatgcaatgttggctgaggcttcaggagaaagacagggtgagccatgtgttaaacagctgcttttcacatagggctctaacactgagcaacttctgatttctaacatctcctttaaattcattacaagtaaagaaaaccagggaggcaaggtaaggaggaagagtggagatttacactgattgggttcagcatataacacaaatcttctaagggaagatatactgggcctgtaaaattctctttttaagcggatgccagctgggt

SEQ ID NO: 141392 - DNA, 304 bp, Homo sapiens
tcacccctctgctcactgagataaatgcatgtctgattgcctcatttggagaggctcataagagaatgcaactgtctgttatctacctatgacttggaacttcctccccacttggagttgccccgcttttccagatcagaccaatgtttatcttacatatattgattgctgccccatgtctccctaaaatgtgtaaaaccaagctgtgccccagccaccttgggcgcatgttgtcaggatctgtgccatgtcatggatgcaagttcttaactttggctaaataaactttctgagttgattgtga

SEQ ID NO: 141393 - DNA, 652 bp, Homo sapiens
ccttttctctcagaaaaagtaataatgagcctagtgctctaacacttgggagaaaaatagataaacgcgaccaaacacaagactctgaaatgatagtccttgccaagtgtgtgcagatgggaaactggcttcttttgaatgtggaaggagaggtgtatcccatgtgaggggagcaccgttgtgattttgaaaattgtactgtacatcttcttgttggcatctgcttaatttctagcaatatctcattaacatttcttttgtgagtttttgtaaagcacatcttgaacttttaaacctttaagtgaataagaattctaagtgtatgaaattctttgattaaggaagtgaacgcccagaagtgcatacaatttcttgaaacacttttatcctctgttaaagtttgttgtagaaaatccttgtttaacattatacgccaaagacattctaagcttaatttcaaaaatattaaatgccaaagagcagaaaattcttaaaaacaaccacttctaacttgtcaccttattgttaacattgacagtttcacatggaaatggtcaaatttcagttttcaaagtcatttgactctttcactttaagtcaaatagtaaatgtgactgaatcttcagtattttaattaaaacaattttatgta

SEQ ID NO: 141394 - DNA, 326 bp, Homo sapiens
tggctgctgtatggagtatggatggggatggggaagcaggaccagttaagaagctgaggctgtcttccaggaaggtgcatgggcctggcccactctgtcagtgacagggacagtgacagtgtggacaatgacccacacaagacagtctgcagaggcaccttgagctgcacttgctggtgaaatgggccctcgggctcctgtcttgagccacccactcagtgaagccaggtactgacaagggacagtctcagggagggaaggaggcaggctggggcagaagctgagaattcatgcctggacctgccacatgtgaaatgtcaccagga

SEQ ID NO: 141395 - DNA, 220 bp, Homo sapiens
gtcagcttcaggctcccagctcccctctcctccacgacatcgtgacttcccaaggtccagggactaaggtcatacacaagtctcagggacgtgtatacatttgatttagggagaaatatgtagaataaactgcagcaaaacgactgaagccaaaatgatctctcatgagcatcttgaataacagttattaattctaaatgaagtgacctcctcttaaggg

SEQ ID NO: 141396 - DNA, 341 bp, Homo sapiens
ggctctgtcccgacactggctcattctgttctgtcctcctggatgtctccaggacagcagctccagtcctgaggctccccctagtctccacccatttctcctttccttgaccctgcatcatcattctagtgagagccatataatttcacaccaattctttcccattgtacagaattacattttcttaacatagatgaagatttaaaagcatccctggatctgtttctgtctctgttagcttcaactctatgctgcttttcagctcagcagtcacctcttcctcctctacctcgaaatatttgattcattctccatgggataattggtccccctctctctgt

SEQ ID NO: 141397 - DNA, 333 bp, Homo sapiens
agacctgtgttccctgatgcactggccagctgcttcccggggaggaggaggcagaaatatacagtaactgattgttgcctttggtctgtgaactgtactatggaacactggaacttactccttcacctgactgcatgtttgtgccccataaccagcctcactttctgtctgcctctcacccacacaccctgcctagcctctgggaaccaccagccaactctctgcctctgtaagagccactctttcagtgcccacaaatgagtgagaacatggtacatttgtctttctaccccggcttacttcccttaacatgacagccttcaattccatcca

SEQ ID NO: 141398 - DNA, 270 bp, Homo sapiens
tgctgggattaaaggcgtgagccaccgcaccggcctcaaacgttgttttttaaggaaagccattaggatttgactcaagtcattaagaaagaagaattacttatgaataacaacaataatagtaacacacattctcttagctgtgtattaggtattccactaagctctttgtacaaattaactgattttatctgtataacaactctatgtggtagatactgttattattcctgttttacagatgaagaaacaggctcaggaaggttaagg

SEQ ID NO: 141399 - DNA, 227 bp, Homo sapiens
gtttcaccattttggccaggctggtcttaaactcctgacctcgtgatccacccgcctcggcctcccaaagtgctgggattacaggcatgagccactgcgcccggctgaaaagcaaaattttaataaaaatcctgatgtttggttttcttgcaagatcaccagatccagcaatgttgtgccccagttcctgtgtgtcagcagttggctagaggtcaggaattagtgcc

SEQ ID NO: 141400 - DNA, 372 bp, Homo sapiens
ggcaagcagttcatgaatcaactgttgactacttctgaaacctaaaatgaaataatatatatgaaagctgttattcagtgatttatacttatcaaaatatacttgtcaaaatattaactgatttgtgtttgtcaaaataaatatattcatacatagcaccttggtaaatcacagatctagttgtattgtaggtgcctagaccaacatgacaacttgattatatggcttgagatatttacatcactcttaccacaaaaacgtcaataaacagagcttattaatcttttgaggaggaggaaatgaaggtgtaggaaagcatgtatgaagtgctacagcatttgtatacatccatctttgggaactgagtgagca

SEQ ID NO: 141401 - DNA, 358 bp, Homo sapiens
gaagtctgttcatgtgtgccctgggagagacttgcttcccacacaggccacggtggactctaacggacctgaagaaagggaggcaggcatgatgggaggaaaagctttttggtgaactctgagatcagaaaggtagcgctgtgaagactaataggctctgtttcaaaaaactagtaagttaaggaagattgtgctaaaagaggaaaagattgctgggaacagacatgagcaaacagttggaggcagctcaaggggcttgactgagagctgtgtacagaaaaaaaaattaaaaaagagagagggtgaagcatgggaaaatctgtcactgggacaccaagggagcattgtcacatggaca

SEQ ID NO: 141402 - DNA, 388 bp, Homo sapiens
ggcaaatggtagaaatatgatccaaatatgagccaaacctcattggagtcaatcacaaggtggctggcctcttcagagtgattggcctttaatcttttagaaacaagttaacagagaaggaccatattccttgggatttattaagataaaatatttaataattgttattgcctgtggcatttattgaatgcaaaccacggataaagcatttcacgtaaattctcatttatcttcatcaaacagtttcaacataagcattactatactcttgttacaagtgtataaacctatttccaaatgttaatttgttgaaactctttgaatcaatactgcatcagggattggatgtttggaggattcatatagggaggttataaaggaagcaaag

SEQ ID NO: 141403 - DNA, 326 bp, Homo sapiens
agtggaatatttctagcaattgtgacttagtcgtaaaaatattctcttatcttcttttatcttttaagtcatccaaaggccagatgttgagaaatcaggatgaaggccttccctttactgcaaacaattggcagcctataataagcttaattaaataattgctttggactgtcttgggtataattaatcatttagctctaaagaattgctggaaacaacagtggacacaaaattgaagcattcagggtttctgagatacattttgatgttctcacagcccttactggccctgagttagataagtgaatgtaatttgttttaagttg

SEQ ID NO: 141404 - DNA, 491 bp, Homo sapiens
ggtcctggggcactttgtctcctcgtctctgagctcccctgaccgtaggcctccaccgtccatccttccacccacccatctgtccatcctgtgttcatggggagaacaccctgcaggaggaagcattttaggcactagataggggaggtaagcagacccagatcctacctcctgtcgaggaggggagatcttttgaaggcagtggtgtcccagaaaggagcagtctctgtgtccctgtgagggcactgcctagggtagctgccaccaaggggccttgacaggtcttatggaggaatcggcagtgtctgctatgcctcaaaggagggaagccacaggcatgatgcttgttccgaaggccatcctagcagggcgtctggggccctgcacactgacctgcatgccctcgtcacctgcactctgcatgctcaccatctgacggactcctgcgagggctggggtctccgtgttctgagcctgtccagtggcatctg

SEQ ID NO: 141405 - DNA, 138 bp, Homo sapiens
gaaacagaattttactagtgttttaagttcccaaagcttttttacatatcatggagaacaaatccataatccagcccaaagtgttaataataatacaaagataagtatactatcaaaatctggtgtgaaattctgttg

SEQ ID NO: 141406 - DNA, 454 bp, Homo sapiens
gtatttctcacccaggctaccaggtttgagagaggttccactgcaggtctctctgaaaatagaattgtcagttgaacacttatttcaaacacagcactgtcttaggtgctgtgaaggtactaagaaatattctaatgccttaggtttgctgagtgctttactgttcaacccccacaggcattgcttcattgcaacctgtgatccctgttttataacatgattagatccttgtaatgccaaaccccaccaccctgttggctcctgcctccttacctggagcctccactgtgctaggcctgctgctttgtcctgccagatcaccccattcccacttctcaccagcacttccacgacaggctcacgatgtccccttctggaagcctccccaggccaccctcgctgagcacgcaccctactcaggctgcgctctgtgtgtcacgagtttggcacttac

SEQ ID NO: 141407 - DNA, 269 bp, Homo sapiens
agtcagtttcagctaccctggcccagggagttttatattactgtacactgattttccagaagatttagtaatcagaatgacaaattttggtgatgggcaagaggggggctctttgtaagggagcagatcattggggagcaggatgagaggaaaccatcttatcaagctgtccataacttgcagtgaacattgggcatgtatctcaggcttttcactggcaataattacactcgctaaattttgagtgctatgccaggtgttgggcagtg

SEQ ID NO: 141408 - DNA, 437 bp, Homo sapiens
ttgatatcacttataaggaccactggggccactgtgggaaagaagaatgatacccaaaattgtgaggcaggttcgaagtaccatttcactattcagagatttcaaaaaatggtgcaacattaattagctgtgaaagcaacaaagaggaaaacaccataggctaaagccccacaagctgagtgtccagttcctttatcctgattttgtttgaggcctgcacagagagatttaaaaaagccattgctgattcattgtcactaagaggcagagtatattgaagacaagtccatctgggggctcccctttccaactcttcagaatgcctgtgatgtgtcaagttctgttctaaggtgcagtgaccaacaggtaaaaatcttagctctccttagagcttacattctagtggggaagagaggcaagaaacaagatatattagt

SEQ ID NO: 141409 - DNA, 361 bp, Homo sapiens
agccccacggtagagtccactctgggtcccggccctgcgctgggcgctgtgctgagcgcctctgtggctgccatcatctgattttcagcgcactcacaggcaggcgccaggcttcactttaaagatggggaagctgagtctcagggaagtggggtctgtgccagggtcttagcaggacttctggggttgctaggacccccacggggctgggctgggggtcttcatgccaggcccaatccctttcccatagttccccccgccggcactacccaacatgtggtctccggtcatctcgtgctgtctccacccctccctccgcttctctgctggagttgtccctgtcaccttaccccagagcctt

SEQ ID NO: 141410 - DNA, 543 bp, Homo sapiens
ctgactcttgaggttttccgcgtggctcccagcgccacatccatccggaggcgatcccgtggaaggatcgcgtccaagataaaagggcccgagacctatgcttacgtaattcctaatccgtgatcttttatgggggctgaattcccctccagcacagcctgttaccaggtacttttcacaaacgctactagcggttgtgagtccctcccccctccatttctatgttacaaattgaaaacgtgggacgattacctaccaaatttcacatcatggcccagatatcgggtggattttgtggctctgtgatcgacttatacctatgctaaagttaacggtctgagaaggtagattagtggttgcctagggctagggagtgggtttgggggtggggaatagaaagtgactggtcatggttataggcttttttgtagcaccataaagatagtttaaaattagattgtggtggtgattgcaccaccctatgatttgcatggtatgtgaattatatcttaataaagctgtttaaaaagtctggtagtctgc

SEQ ID NO: 141411 - DNA, 436 bp, Homo sapiens
cagggcatctttgtaattatggcactgagtagcccaagtcttagattatttcattgtgatgtttccagtgtaccatcaactgtataggtgattagcatttgcctattaattccttcttcctctcttatcttcttaatgactcttatacattttgttatcttttcttactctccatgtagtagttcttactctgcatgttcagactctagtggaggtgctaggaagttccactttctggtagattatttagagtacaggatagtcaagggaataaggatggtgctaaggcaggctgtggtggtttaagcctatagtgccagctactcaggtgggaggatccctggagcccaggagttccagggtgtagtggagctatgattgtatcactgcactctagcttgggcaaaaaaagtgagaccctgtctccaaaaaaaaa

SEQ ID NO: 141412 - DNA, 338 bp, Homo sapiens
gcacaggaccagatgaacgtaatttccaaaacgggttcaaatggtaaccctgattatatcgctaaggctacttgtaatacgttttaagttaactgctgtatttccgacatattgctgacaacagtggattggttatagcatgtgttctacaataaaatgtactttccaaaaaatacctaaagaatatttttaaaataaaaatgtaatacaatacttgatcaataaattctattataaaatgaaaacattgggctgggcatggtggctcatgcctgtaatctcagcagtttggaaggccgaggtgggtggatcgcttgagctcaggaatttgagactag

SEQ ID NO: 141413 - DNA, 490 bp, Homo sapiens
ctgcttggtttctgggagtcgggagttggggaacacacttaaaggcactacggcacatgagttggctgacctgagctgtctcaggagttcctgtatggggctgaccctagaccaatgccccaggggctgatgagggagtgagggagggaggacaagataagacagccttggctgatgagcaggagaacgtgtgcttccctcatcactaagccacagaatcacctctcagagatttttctggtaagggttcctgaccacatgtcagtgggacctaagcaagggtttcctctatcccctgaccttcagctgaacctcaaatcctggtaggccaccctttggttctcaggggtacaggatggacagagagcaaagcactcagcaagtgaagtgggaggagacacagtttacacaactttctgggtgtcagattccgggatatgtgtaactttaggcaaattgctttacctttctgaacctcggcttccacatc

SEQ ID NO: 141414 - DNA, 380 bp, Homo sapiens
ggaaagcaaagcaaaccagttcatcagcaggttttctttgcctgcatgtgctgtgcccagccttgcagttgacacgagagaaatataaaacatggccctggccttccttcatttaaacatttctctttcccaagcacttactctgtgcaaggagctggagaagccaaagctggagaaaaacaaaggagggcctgccctcgagaagttagcggtctaatgttgtggttctcaaactcaggcgtgcgtttgaatcgtctgggggccttgccagaccacagaacccatcccctgagtttctgaatcaatgggtctgaggttgggctcgctgagaatttgcatctttataaattccagataatggtcttgcggctgggtaggca

SEQ ID NO: 141415 - DNA, 202 bp, Homo sapiens
ttgtatccaacaaacttgaggggaagaccaaaagatgatgatgatgattaatcatatttacaaggtactcttaatgtacattttctcaaaaagcttaaaatctaagcttcatgaaacaaatagattggcaataattacccagcaaaatacagtaagtgttataactaaaggcagggatgggagttgatataataggagatgg

SEQ ID NO: 141416 - DNA, 325 bp, Homo sapiens
aaaaaaagataaactgttgtttaccacactgttctgtctgctttggtatacttttactgaatttaggaatgtcgcttgattgtgttcattcatagaagaatcttgagagtgaaaatagcccatcgttttgatgaagaacagttaaagaactgatgggtgttacttatttgtgccacactgttgtttattttcccaaaacccactcatgtcacaggcttatagaatcacaattttcttaacaactaaaagatattccttcttcacaactctgtttttaattctatgtgtatgaaaatagtttaattggctgggcgcagtggctcac

SEQ ID NO: 141417 - DNA, 320 bp, Homo sapiens
  misc_feature (3)..(3): n is a, c, g, or t
gtngatctagaggatcccaattcctgcccttgtgccaacactgccgtgggagtgaaactaggtacagagaacagcagatcctctcctgccctgagtgaccactactgctcatgcaatacagagaaggcacagacctgagcccgccagtgctcccaaggcaacaccatcaccaatgcaaccacatacacagtcgccagcagcaggaattctcgcgggagcagcaggaattctcgcgggagcagcaagaattctcgcgggagcagcaggaattctcgcgggagcagcaggaattctcgcgggagcagcaggaattctcgcgg

SEQ ID NO: 141418 - DNA, 597 bp, Homo sapiens
tgagttgagacactccatgcccatatcagcccattgtgagcccgttgtgttttcctgtatatcacttgcactaaaattagataagggtgctgattttggagctcttggactcccgtgaattaattggcagtcagtgaaggtctgctgtttcctagcactctgctctgggtactgtggcttgtatttaggaatttctgtccacttgagatacatccatgaaatgtacattatattatgtgccttatatagtgagtgttgaattctgtagtcactaagcatacttaagataaagatggggttggtcagtataggctgttgtcttcagagacccaggaggaactgaaactgcgcttgctagctaactgttgcaagccacttttgatgttcatctgtaaacaccctacttctaggatattgatctccagactccatggaaatgtttattctcattagtccctgtccctgtccaaaaggtagttctttgccttggcttataccggctgagtccagagcaaaccccaccctcatcctatgagactagtagggtgtgggagtgcctttgattcttaaatccaccaccatgggtgctgttcttgt

SEQ ID NO: 141419 - DNA, 237 bp, Homo sapiens
tcttcatgccttcttataggtatgtttgttctctaccctctgacctgtatgttcttcctctgccttgttttcctttccctattcaagtctccagggcagtgatcaggttccttggtgctaggcccactcctgtctcagggcctttgcacttgcttttcactctgcctcttagaatcctccagatagcctcattacctgtgaccttacttctttacaaaatccgttcaaatgtcacat

SEQ ID NO: 141420 - DNA, 667 bp, Homo sapiens
tctctactaaaaatatgaaaattagccgggcgtggtggcacttgcctataatcacagctactcgggaggctgaggcaggaaaattgcttgaacccaggaggcagaggttgcagtgagccaagatcatgccactgcactccagcctgggcaacagagcaagactccacctcaaaaaaaaaacttttttattgatatctctatttaatgaaatatcattcttcttgttcttgttagctctttgtccatagtttctttagcttcttgacacaccaaagagagggctcaagcccactgtggcagctttcctgggcttaggagtctcaggttataatctagtgcttccagaacatctgtaagttgagagggaaggaaactaaaaaggagggaacataaaagtatgaggtcaaaatttgactgtaaagtcctctttaaaaaactaagaaatattgggtaaacttaagaactgggcagagatttgtatgtaggactagggaggagagtttgaagtccaaattctaccaagttagagaaccaaattacaatattgagctttatctacttgaaagcacattagggtcttggtttaggaattagaaccatatagctagactgaagaatgcatcatacaccagagagaaaatctgaaataggtcgactcaaaccaaac

SEQ ID NO: 141421 - DNA, 400 bp, Homo sapiens
aaggtagaaaaataactgagagctactgttgcagagaaatgagcaaactctagtaagtaacttctacctgatggagttatagttaactgcagttaacactttcagatttgccaaaaacggataggaaagtaggacaattcccaagaagcattttctcacatttaccattacccttccattcaaagttttcctaaaagtagaaataagagttctgaagtaaactaacaagtcatcttccaatatcttaattacagtcagccctccatatccatgggttctacatctgtgaatttaaccaaccaaggatcgaaaatatttgacaggaaatactaaacatgtacagacttttcttccttgtcattattccctaaagatgcagtataactactatttacacagc

SEQ ID NO: 141422 - DNA, 366 bp, Homo sapiens
ctttgtacagggttagggaatgaagttctgccatcataatgcaccactgtgctctttcagatatatgattaaagattgcattgtttccttttgccaacctgaaatttcagctcttaagaaatatttttgcctgctttaatgtaactcaagtcaagtacaaataaagtaagccatttctgaggagaaccaaaccaaaccagcagggagaagtagcaatttaaatgcagctccacctcaataaaacaaagctgacaaattactagaaatccattgcccacctaacgtcctagtgtcaaatctcctgattcctaaagccatctgttggaaaacaatttcagcaaataattatttcagcatgtttccgct

SEQ ID NO: 141423 - DNA, 194 bp, Homo sapiens
ttctcaccattgcttcctcagttccttagcatccaccacgcgcagaactttacactttacactcaaggggtgtatgaataaagggaatgcaaccaaagtttaaggtaagaaactcagagcttgttcagttcagttagtacttaattggctacccagccttgtgccaggtaccttgttctggggctagagagctg

SEQ ID NO: 141424 - DNA, 361 bp, Homo sapiens
ggaccaccttagagggcagctgtgaggtttggcagtaaccgatagccaatgggcagtaaacaggaactgctatttttgctctttatccatccgttcattcagagagcttccctgctccaggccaggctccctgccagatgctggggacatgaagatgaacaagccccagttgccttgaaaggtggtgtgtacctaccgagggagaggcctcgagtgcaccccctcagccacccaacaagtgcatgtgggttaattgccacaatggaggaattcacagtatgtgggcactgtgccaggggcaggggggcacagcagtgaacaagccagacgtgggccctgccctgggccaccaccagtctct

SEQ ID NO: 141425 - DNA, 121 bp, Homo sapiens
gtgaatttactgaggcctggtgatggtttgcttcttcccagttgcctgcggtgcttgtgatgggcaagcctgtttgggtctcctctgagctcctggcctctctgtttcagcaccttgtcca

SEQ ID NO: 141426 - DNA, 433 bp, Homo sapiens
ctcatcttttactactaatcaactgagtataaatatgaacatttcaatgagcaaacagaaggtgatttgggagttgaggtatttaaaaaactctacttttgtttgacagacgtgtatacaggcatgacttttttttttttaacctaaaacgatattgtctgctatactttaacttttacgtatgacttagaacaggaagttgttgattagaaaaataccacttatctctctaaagtacttatctcttatctctctaaagtagtactttagagagtgctaaatactctctaaaaatactacttacatctctctctacttatcattctacacaaagcttgccatgccttctgtaagcaataaaatagtagccccaaattgaccttaatagatatatgataaaactagaaaagtaaaatattattggtaaaaccca

SEQ ID NO: 141427 - DNA, 557 bp, Homo sapiens
tgtgttcaaggactcagtgctggaggagccctgggtccctataagaccccttttttaggcccaggccttgaaaatgattggggaagggaaggggccatcatctgtcaagcgacattttgatgccagacctgcagatgcagcacggggaatcggccacaggctgagattgaaacatgagtttcctcctagaaacggacacagcctccctccccaggaatgcaggaaggtgctgaaactggttactagcccggcaaaggaatagaaggaaacatttttttctcctatttgaaagaagagaggacccaggctgggccatcagaagccacctgtgcatcgtgtgtgtccctgtgtgagcctgcagacaaaagactgctgtcttgggctgggcgcggtggctcacgcctgtaatcccagcactttgggggagtgatgcggtggatcacctgaggccaggagttcaagaccagcctggccaacatggtgaaaccccatctactaaaaattaaactcgagcaagcttatgcatccgccccaattcaagctcacttggccaattc

SEQ ID NO: 141428 - DNA, 568 bp, Homo sapiens
tgtgttcaaggactcagtgctggaggagccctgggtccctataagaccccttttttaggcccaggccttgaaaatgattggggaagggaaggggccatcatctgtcaagcgacattttgatgccagacctgcagatgcagcacggggaatcggccacaggctgagattgaaacatgagtttcctcctagaaacggacacagcctccctccccaggaatgcaggaaggtgctgaaactggttactagcccggcaaaggaatagaaggaaacatttttttctcctatttgaaagaagagaggacccaggctgggccatcagaagccacctgtgcatcgtgtgtgtccctgtgtgagcctgcagacaaaagactgctgtcttgggctgggcgcggtggctcacgcctgtaatcccagcactttgggggagtgatgcggtggatcacctgaggccaggagttcaagaccagcctggccaacatggtgaaaccccatctactaaaaataacaaaattagccaggtgtggtggctcatgcctataatcccagctactcgggaagctgaggcagg

SEQ ID NO: 141429 - DNA, 731 bp, Homo sapiens
atttatctcacaacctagatggtaaaccccttgtggattacggatgtcagttaaatttctttaaattcattcatccgctctttcaacgaaaacgttctgagatcacctatgtgctagacacactattaggcactggaggataaaagtgactaaggcacagggtaatcagatagtgaacaacaccagtaccttgagactagtgctatacaaaggtatcagcagggcaccagcaagccctaagagactggggaagaccctcaggaagagctgtcgtagacgaggagactcctggttggtccacaccaccatacacattaacacccagtaaggaactgtttaaccaacgaatgaatgaaatttctccccacaggtagtgggcagtcatgaaggacacccagtgctccactagggtttagggcaactccagagtagccaagtcagattctgcataaaccaagaagacattgctggaacagtgattataacatgcttcctacactataacactctgcaatttcaaaatacgagggctaatcactttccaatccaaacaaactgtgctttattgtgagtaaagaaacagaaaggggtgggggagtctggaaatgactttgaggggaccattttaatgaatgtagtctttgaaattcaggtaaatagagcctctctcatttccagcacaagaagtcattcactgtggcagccaagtcggccatgagaaagttgtgata

SEQ ID NO: 141430 - DNA, 676 bp, Homo sapiens
ccaggctggtcttgaactcctgacctcaggtaatccacccacctcggccccccaaagtgctgggattataggcatgagccactgcacccggctatattcaactttttaagacactgccaaactgttttccaaagtgacaataccatgttacaggttggaggtttccgtcagcaatatatgagggtttcagtgtctccaaatcctggccttttatgagtcagaggaaaaactttcgcagaagtctacaagaggacttcccagggtaactacagtagcccatgacaaacactagtcactgataagcagacacatctgagaggcttagactggtcaactaacaccccaggcccgggaaggggctcataatgcttatcagtgcccagtgtcagaacacagttgaagggggatggctattggatacgaacccagcaaaggcattcatatgtccatgcgtcagggtaagcttggattattgatttaaacatacagattggagccagatgctgtgtgtatgtcacaatcatgattttattttatttatttatttatttagacagagtctcactctgtcacccaggctggagtgcaatggcttgatcttgactcacagcaacctctgcctccctggttcaagcgattctcctgcctcagcctcccgagtagctgggattacagg

SEQ ID NO: 141431 - DNA, 323 bp, Homo sapiens
accattctcagtccttaatcaaagttaccagcaggtgaattcacagcatttgccctaaggatgttgcaacagcttactgacttcctgtttcaatatgactgtcgtttcaaaggactactcccaaataagagaaaaaaaaaatccatgtacatgtgaaaggcaactgaatataatacatacaatcatttgtgtttttacaaatgaattgaattgtgaatcaagcttggggaatgtatttgattctcttgggattacatcacagataatttcatagccttataatgtgttttgaaacagacatttttcacgttcccaggggcaac

SEQ ID NO: 141432 - DNA, 224 bp, Homo sapiens
tacatgcacacacacacacaggggcaaagccttggaaaattgcaattttccattttaatttgagagacagcccggtcacattaacagaacccttgacggaataggttgaattcccttctctgtccctataaccccatggccttggacatatccttacctggtgccctttcctccctcttatggtccacttttgtgattctgattttaatttcagttctctgtta

SEQ ID NO: 141433 - DNA, 294 bp, Homo sapiens
ctttgtcccccatttccatcaacccttactatgcctcactcccaggaaacctgtgatctcctttttgtctctatagacatgtcttttctagaatattaaataaatggaatcatatattgtcttttgtgcctagttttttgcttatatttctgagatgcacccatgctgttgcacgcataactatttctttttattcctgagtagcattccactgtatggtcataccacagtttgtttatacattcacctgctgatggacatttgggttgtttccagtttggggctattacaaat

SEQ ID NO: 141434 - DNA, 440 bp, Homo sapiens
gtcatcccggtagataaccattggtttaggcaaaggagcagcaaggaatgctctctcataaaggtattttcctcatacaatttcaaaacacctttctattaggaagaattctttagggcagaaactctggccaaatccgtataagtgtgtcctaagaatcttatgattgaatacttcacacacacaaaaaaaaacaaaaacaaaaaaccttcctttctctagtaatgagatctcaatgggttagaatagagtttgaaaacaaattatatcaataccattaaaacactacaagaacagatcaaaactggactacaacaaaatttaaaattgttgtgctgcaaataatgccatcaagtgagaagacaatcccccaaatgggagaatattttcaaaccatgtatcacaaagggagcctgcatccaaaatatattaaaaaacgc

SEQ ID NO: 141435 - DNA, 302 bp, Homo sapiens
ggaagttggagccctgagtagtgtttggactctgccttccagaaaagaagggtttgctgcaggcctcaaatggggtgattggttcttgggtgagtaaataccagagtaaactcctctggtattgtaggacagtgttttggtcgatctagtaaagggggaaaacatccttactcacagttctggaattttatgtccagctattccttgtatgccatgtcacttaggaaaatttaaaaagtatctggctgggtgtggtggctcacacatgcctataatcccagcactttgagagaccaaggcag

SEQ ID NO: 141436 - DNA, 163 bp, Homo sapiens
agccttttcaaggtgacatcaagacagaaactacttgctgtggaaatcattgtacaaagtgggtaggagtgagaagcccactgataggatgagtcccctgggagctgatgaaagggtgagatccaatccatttttaaacagtccttttttttttttttttttg

SEQ ID NO: 141437 - DNA, 357 bp, Homo sapiens
aagtcagaacagtccatatgcttcttacaatatcagtgttttcagttgaattttctcctttagtcttaagattgattctattctgaaagtaataaaaaaataaataaatggaaaaaataccaaagcttgatttttcagattattacttgaagggtagtttggaaaaattctgttttcactttcagccccttctttgcctcagaacaaacatggctttttgtcataaacaaatgttatgacagaatgtttaaatgaaccctttgatttgcaaccaccttatcttcaaatgccactatatttgtgagaacttgtttcctttagtctgataatacagcaagacccagttaaaatagcagg

SEQ ID NO: 141438 - DNA, 293 bp, Homo sapiens
ctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaa

SEQ ID NO: 141439 - DNA, 447 bp, Homo sapiens
ctgagagccttccagttgaactggtttgactgcagacccttacatgaataccgagtcttacaaatctctacaagaggtagcagccagtaggtaggtgcacatctctgtattgctaaattccttcctttttccccaggcttgcactagaaaggacaccaaagtgcccttctaatagcttcccctctctggttttcccagaggtttctgttgttcgctccctccttttaatgtcctgtttttgtttttctgggagagactcatatttactttccaaactctcccttgatatgtctcatattagtgttatccaggagaaatcctgggctggtcctaacctcctgtcttgatcaggtctcctatctctgtggaccttcacctgtctttcccagactgggccaggccttgccaatgatgttgaccagacactgggggaggggacaggaggag

SEQ ID NO: 141440 - DNA, 408 bp, Homo sapiens
ctacaaaactgagaagaggaagggagggcccctagcaggattcttcttcctttgtacccatggagaggaaatgcctcctttccctgctgtctctggggtggctcctagattcacccactctcctcccagaactccccagtgccggactaaaaccgaactctgaaacgtgcccactgacttcctgagcaacagatgcggatgcgtttccccagtcagcagcaggccctacccaggccccaaagaccacccctttcttctaatgatgacaacggcaaacatttatggagtgcccatacagtgctgggccttgtgcctggccacttgcggactgtctgtcctgcgtgcactgcaactccccaagaggtgaagtaactccctgacagctgctcgggcctctccttcagaccc

SEQ ID NO: 141441 - DNA, 361 bp, Homo sapiens
ggctttctcaggtgatgagaatgttctagaactgcacagaaggagaggttgcacatcgtgaatgtaacaaatgccactgaagtgttcattttaaagtggtaattttatcgtatgtgagtttcacctcaatttttttaaaaggcaaaaagagttaagaattgattcttagtaaaaatttgtcttattttggcgtgacattgtacaaaaggagaaagcgattctaaagggcatttcaagaaccatttccttcaaaccaagctgtcgaatgaagtcagaaatgaacaggtttctaagacgtggaactacttctccttccaagagcaggaagccaccttccgaccctggagacaccaaactcccc

SEQ ID NO: 141442 - DNA, 175 bp, Homo sapiens
aggcccagggtgagggtagctgcccgaaaaagggcagcagacatgcagccaattagatcttggcatgaagaggtcaaagaggggatagaatgaaaaaaaaaactgtttagcgaccaggtgtgtgagagcaaatggagcatgaacactggccgagcacccactgtgggccagccat

SEQ ID NO: 141443 - DNA, 299 bp, Homo sapiens
tccatccatccatgcattcatgcatccatccatccatccatccatcattgagaacaaaagatatcgttatgctgttaatgagtatttcattttagacacaattaagtatggaaatgtagattcaggattaagactatacataaaggtatcatggaaataaaagaattatagtgcaagagctgattttctggtgagcgaatgggaaatgggttctaaagaaaatctccacagaattttctagaatggttattaagaatggctacatccctggacaagtattctgcatgtcaggagtctac

SEQ ID NO: 141444 - DNA, 463 bp, Homo sapiens
tgctgtgataacagggtgagccactttgcccggccaagtgtttctttttggtgtggtaagaatattctggaattagatggtggtaatggaatggttgtacaacagtgtcaatatactaaaaagcagtaaattgtatactttgaattggttgatttgaaatggtaaatttgaggttacctttctggggtgcagccttatctatctctgcccttgtgacacgacctgatcatcacaaattcccttttaagccagggccaagtggttttggttgcttgtaattgaagggtctaaattgtccaagcaactgacccaagggcatcagacttgacagaccagagtctgaaccctcagaaatcacatgtgagaccatgtcaccgagggaaccgaagcaggggcagcatctgcaccctcaccctggggggttcagccctcaagggccatagcctgtttctccgtgtgccca

SEQ ID NO: 141445 - DNA, 424 bp, Homo sapiens
cgtccagtgtcacaggcacaggccacgcccactcccttacaccctggctgagctgctttcacaccatacgggccgcgaagggcggttgcatggcctgcaaagcctgaaatatttacagagaaggttgtgctcacccctgccctaggggcaaagcccaaagtgtacccttggggcaagacagaaaaagctactaaaggcgatgttgtaataatagcatcgtcatcattacattattgattatatcaaatgtctgcttactctgtccataccctgtgcgaaggactctgcacctaccaactaattggatcctcacaatcttaaaactatccttgctcaactgatagggaaactgaggcacgggacggtaaggccacttgccccctgtttcacagctaggacatcactggggcaggatgtaaatgca

SEQ ID NO: 141446 - DNA, 398 bp, Homo sapiens
cccaacttggttccactgagaattctaaacttactctgtaaccatcccaaactcctcccagccacagtctggcagaggtcctgctattccagatacctggaggaaggtgcccatttacatccatgcaggcaggcctgcagatctgggcctttactggggtcactgaggcagttcaatgactcagtttcagttacccgagccactgtttatggtcagttctccctatatagaaacccacacagttacctgaggaaatgctctctggtactcactgaaagccatactcatcaacatcctgatacaaggtccaccatatgcagaccgaactgcaaaaacttgccctagtgtttgccctatggagcaaagccctgaaggatattcagtctgtccaaaaatga

SEQ ID NO: 141447 - DNA, 911 bp, Homo sapiens
gaccagcggtctcaaacatcagaagttctacttttttaaagacagagtacacgattctccttcgtgtccatggagaagagcagggtaccagcccagtggaaaatgaagccacctacactgaagtctccacgtttaccagcttttgctctttcctacttacagcccatctgttgcacagcagcctgagtgatctagaaaacataaattagatcatgtcatctcctgctttaagtgggctggtggtttcctttgcaattagaatggcttcaaagctcttacacggccgaccaggccctatgttatcctgcttacacctcagatctcacttctgacccctctctcttggtttactcttctttgaccccatgggtctttacaggggccctgtactatgctgaataccttcccactgcaggcccttggcatctgctgttccctcttcctggaaagcttttcccatctcttgggtgttcagagtggccttttccatccatcgcctccatcagatccccctgttttctcctctttctggcagttctcaccacctgaaaccatgggtctatttactcactgtcatgctcactccattggaatgtcagctctgtcttgatcaccctgaacccccggagcccaataactatgcattgggtgaatggctgaggcatggatggtgagctgtgttttcgagttgggtgttgtgtctgggctgttttgcctcgtggaatagatgaagggaggaagttgctgggaaatgctggagggaggctacaggtctttgtgaccttgatttcaatagcaacagcttgcatctaaggcaacatctgaccatggacaaggagggggacaattgtcaagagaacaggctgagtggcagcttaggctgacgccaggtaggggttagagagctgaga

SEQ ID NO: 141448 - DNA, 545 bp, Homo sapiens
ccaacctctgtctgaaacggagggcagtatcttagctaacttccttttaaaggtgctctctcaagtctctccagaatgggctccatggaaagttaatcccacaggctaaggggtctcatcttcacagtatccaactgcagcatttaaatgcacttcatcttccctggaacaacaggaaaatacagtgaaagctcaaaatgaggcaggtgacagggactgggaagaagggcttgtactaagcgtggaacaggtgagatgcaacaccatgccctgttctgccaaaattaagaccctcctgccacagtttaagctaaagtctgtgtactccctcattcccacctcctccagaaaagggcacttgcatgctttctgttaaagtgagatggttttttcccctattccagtggaatacggtaaaatccttatcccttcataatgggcttacctgaaagtgaatgaggcttcctgggaaaacccttctaaaggagtgtcggatgcctcagaaagaactagagttaccttcctcctttctgtttcatcaaaat

SEQ ID NO: 141449 - DNA, 672 bp, Homo sapiens
  misc_feature (498)..(499): n is a, c, g, or t
  misc_feature (506)..(506): n is a, c, g, or t
  misc_feature (529)..(529): n is a, c, g, or t
  misc_feature (574)..(574): n is a, c, g, or t
  misc_feature (578)..(579): n is a, c, g, or t
  misc_feature (581)..(581): n is a, c, g, or t
  misc_feature (596)..(597): n is a, c, g, or t
cggacgcgtgggctcatcatgacctaactctgtttacttttccagtttcttatctgatctctgctgtaaatacgatgtgtttcagcaatttgatacccttagcagttcctccagagtgcttttactgcttgactgtttcttctccctgaaatgctgtccccatctccaccgtatagactcctacttgttgacctgtttgcttttttgattttaagcaaatgagctctttgaggacagagatcttattaatgcttatgtctgactcatagtacacatttagtaaaaatttgttgaaagcataaatgaacatttaaaaaacgagaagagactgggcacagtacactcccagcactttgggaggctgaggtaggaagattgcttaagcccaggagatcgagaccagcccctctggacttgaccccaatgcctctgtttaccagcccctgaagaaatgaaggccagctgtgtgttgtgcccaaaaattggttaccggaaggnntgcaaangagcgtctctggcagtcaagaanaaaaaacagtttctatgtatttgtggaactgtatctgtgtcattnttannanggggggaaaagatannatccagtctgattagaactggccatcagttttctgtaaatttttagaagactcacagaacttacagttatttctg

SEQ ID NO: 141450 - DNA, 156 bp, Homo sapiens
ctggagcacagccctgtggttggtggagcagcttctccagcccctaggattcctaagagggcccaggaccccagctgctggtagaggaagagcagccaacccaggacaggacagctgaccccacccctgtcccgcctcccacaacagcctcatttc

SEQ ID NO: 141451 - DNA, 483 bp, Homo sapiens
ggcaaacagagccaggcaggtaccgatgacaccaaagcatcatccaacaaggaaagctggactttcacttctgaatctgcacacaaaaaaggcatcagatgtaaaattcagagagtggacactttaaaagatcagggcaaagttaaactttcaaagatcactgaggcaaagtgcattcattcaaaaagcatttaccaggctgggcacggtagctcacacttgtaatcccagcactttgggaggccgaggcaggtggatcacgaagtcaggagttcaagattagcctggccaacatggtgaaaccccacctttactaaaaatacaaaaattagccgggcgtggtggcgtgcgcctgtaatcccaggtactcaggaggctaaggaagagaattgcttgaacccagaagacagagaatgcagtgagccaagactgcaacactgcactccagcctggacaatagagcgagactccttctcagaaaaa

SEQ ID NO: 141452 - DNA, 683 bp, Homo sapiens
agcaaaggactttggagcttggccatgttagtcctagaagccacggagaaggacccttctgattggctttcaggacttatctaactgctaagtgaagcctctttgaaagtttcttatgtgtacctcctccccactacctagctctagcttctgtccaacctggcctattttccatccttcaaaacaaaccccaatgtgtatggcttactccagctgcttccttaccttcaggtttgtgggcttcatttaagccatgggaatgccagcttaattaatgcagattaagataagaacattaaaccccaaaaatgatgggaaatcactctgtcttcaaaacaatagaaaataataaaatctagttataaagattatataccattgtcactagtaagaagtggcactcttatttacaaaacataaagaaattagggtttaggtctggcatggtggttcacacctataatccccagcactttggaaggccaaggccagaggattggccaggagttcgagaccaacctgggcaacatagacaaaattagcttggtgtagtggtgtgcgcctgtagtcccaactactcaggaggttgaggttggaggattgcttgagcccaagattttgaggttacagtgagctgtgatcacatcactgcgctccacaaggcaacagagtgagactctctt

SEQ ID NO: 141453 - DNA, 511 bp, Homo sapiens
cagtggagggcacagggggcagcctcatagacaatgaaatttcctgtcctgtgtcacagtcttgaggctgggggatggagtcagcaggttgttgtaataatccagactagaaatgtaaacaggtcaccattctttctctcccagctcttccctgaattctcatgccattctgaaaaacctgcctaaaaccctttatgaatcagataagggccagattccataggcttctttcaaacttttttttcatattttttcatttacattctgcctctaaatgtcaatcttctaccttcttttctctctctgtgtttccctcctttccactgtttgccttgctagtgtccctctggcatctccattacacggactattatgcagctatcagaaatgatgtttacaaagactgtgtaataaacatggaacatgcttaggtttaataggaagctggtgcagagttgtatagacatatgattacagtcttataaacataagtctatatagttaacaaaat

SEQ ID NO: 141454 - DNA, 225 bp, Homo sapiens
caggcgtgagccaccgcgcccggccttgttttcctttttactgaatttaagtgcttagggttattcacaatatttgactcatgacattctttcatcttcagttggaccttgtgcaacctgcatctggtaatttgttatttatctgtttgtgtatttccttataatacagtcactccactgcacgttcttcccctgtgtcctcccttcctattactttgccttccc

SEQ ID NO: 141455 - DNA, 1364 bp, Homo sapiens
ggcgggtgggtgggttacctggcgcggccgggcgcgtctgccgggcaccagagcaggcgcagcagcagcagcagcagcaggctggcgagcagggcgagcagtgcgccccccggccgcatcctgagccacaggcgccgccgccaccgctgctgccggggcgaagcacagcccgggcggccccgactcgcggctcccgccgccgccgccaccgccgccgtggccgcagccccgcgcacccacagcgttcacaggcggcagcgaggggcgcccgcagcccacccggcagagtctccgcggcgggcggagaagaagccgcgttcgggctcgccccgggctcccggccccggcccgcggagcgccgcgatcggctggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaaactgtgcagtcgcttggctggatcctcccacgcatgaagaaagctggggactggggaattgctgggtggatcatgacactgaacagaagcagtaacctgtgcttacttcaacccagattcagagggacagcgaactggtatgaggggctaggagacctttaggcatgagcacattactacctggagacccgtttagcccctgcctgtatttgcaaatagttttattggaaaacctccatgcccatggctttgtattatcagtgactgcatatggctgtatgatctagggctgcaagggcagaattgagtagtgatgacagaggtggcatagcccacagggcctaaaatatttaccatttgaaactttccaggaaaagtttgcatactgctcttaaataagcaagaggccattagcttgaggctgtctctgtacgttgagttcccacctaacaatggaaacctacattaggctgtaatgaacagggggctactggccaatcatgggcaaccaactcattataccaggccccacaaggcagcctgcatagctatagccaatcagtttctccactgtgcttctgagtttggcctatcaggctttgctgctcacaccatggggtggacctcactggacctcctctggttgtgagtgctgcccaattcatgaaccctttgctcgaataaactgtgctaaatttaa

SEQ ID NO: 141456 - DNA, 487 bp, Homo sapiens
gctacaagaatggagacgagtagaaggtttaagctggggctctcatccagcttggagaattccctgacactctctagtaccaagggtcaagagttgactatcctttgcaaatatttatttatggagttattttccaaattaagcaaactagcggatagttttgtattttcccctatccctctcccctgcaacttctacctttagatctttagatgattttatagaaggatgggtttttttttttggtcatttttaagttactggaattatctatgggggaaatgtgtacgtttttatatagaaatatgaagattttcttctccagcattctccttgtgagctctttggatcttattttaatatctatatgcaagttccccgcgcccccccccccatgtcaatagcaaatgttagccttctggaagaaaaataagaacatatgaaataacctgacttctgtttataagtaatcttaaccatttgtgtt

SEQ ID NO: 141457 - DNA, 521 bp, Homo sapiens
ctgagtcctaagaggccaatgaaaaggaaaacacgttaaggagccagggcgcttcttggatatcagcctgaatagttctgtttcatctggaccccaattttactctcctgctgttttacacggaactaaaaagagctttacagaggaccagatagactgcaggtccctaggcagtcaggggccaggcaaggcataggagggtgtcaggcctctgagctcaaactaggccatcatatcccctgtgacctgcacgtacacatccagatggctggttcctgccttaactgatggcattgtcttgtgaaattccttctcctggctcatcctggctcaagagctcccctactgagcacgttgtgacccccactcctgcctgccagagaacaacccccctttgactgtaattttcctttacctacccaaatcctataaaatggccccacccctatctcccttcactaactctcttttcggactcagcctgcctgcacccaggtgaaataaacagccttgttgctcac

SEQ ID NO: 141458 - DNA, 346 bp, Homo sapiens
acagaggcacatgaagagcaccatgtgaagatgaagccagaggtcggggtgatacttctaagagctgagaatgccaagattgtcatgaactaccagaagccaggggaggggcccggacagagtctccctcatgggcctcagaaggaaccaactctgctgacaccttgatcttgaccatccagccccagagccattggacagtaagtttccgttgtttaagccacccagtttgtggtactttcttatggcagccctaacaaactaagacacaggaaagccttgggggaaggcgttgcatctgtctctgagaggacatatttgggaccaagtccctcctgtgacatca

SEQ ID NO: 141459 - DNA, 397 bp, Homo sapiens
tttcttactcttcacctgatttggctattccctaacattttctgtccctttatcttcaccgaagtttagcttagctttctgcctttaaatgtgttctttaagtaatgacagatcatccttattctaggctgcaaagattgtagtaaatatactctttctagacaggcagaataaattttgatggctcatttttaaaaaatttatatctttttgaggggtttggttagcttttcaaatttgaattagtcaatattttaaatggcttaattatttttaaaattttttaatattgtaatatgtaaatattgtcatgtttcgtattgtaaatgttacagcatttgtgacaatgaaaataagtcttaaaacatatcccagaaataaaaccacttcatcatgt

SEQ ID NO: 141460 - DNA, 292 bp, Homo sapiens
accaggtctcctgtcctttaacatattactgtattattccattagtattactgcaggatgtttgttgaaggccttgcaggcttcagaaacattaacttctaggtcttaattctttatggattattttgctcccatatgaatttctgagtttctctttcactgttaaacccagcctgaagaaagccttctgtggtgcctcttgtcaccacatgaggtctccataaatcctgacctggattaagcagaagtggaatccactatagccaatatccgagtctcctattatcttgca

SEQ ID NO: 141461 - DNA, 265 bp, Homo sapiens
aggcctggagtcatgaaggtaaagaggaggacatggcccgtcctgtcaaggggtctcagcctagtcaggatgaagacacactgccagagtgagctccccccacacagacatagcaggtgctagggcagaaggaagaacaacatggtaaaggatgaaggggaaggtcccaagcccatctggaaaacgaagggtctgagaagctttctagggggacatgagatgagtcttgaggggtgggtagctaggccaacaagcgcctgaagga

SEQ ID NO: 141462 - DNA, 367 bp, Homo sapiens
gccctccgctttttgtggccaaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgaggtcgcccctgtccggcccttccaccctagttctcttcaccgtccgcccatcctatcgcgcgcggcctcaggtcccgattcggcatgtggcttgtcttccatcgtccccaccctcgcccctcttggcccctcagggcagccctgggattcggcagacgccagtcc

SEQ ID NO: 141463 - DNA, 207 bp, Homo sapiens
gaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattat

SEQ ID NO: 141464 - DNA, 502 bp, Homo sapiens
tcgcatgcatgtgtctttatgttagaatgatttatattcctttaggtatatacccagtaataagattgcagggttgaatggtaagaacattggtttttaaagttaagttaaaagagaaaatgtaatcctttaaaataataccagtccaatctcactatagcaaaattccaagggactctcttccatttccataatgtgtacttgatattgctggaaataaacgaactatagtctaagacttagacgtcttttatgtcagactgagatttttattgtaatggttattaaacagattttttgaaaaatacatgtaatactaataatatatgagttaagaaactttagaacttaatttaaaaataattaaggctggtatagtggttcacacctgttaattccagcactttgggaggctgaagagggaggcttgcttgagaccaggagttcaggaccagcctaggcaacatagtgagaccttgtctctacaaaaaaaaaagaaaaa

SEQ ID NO: 141465 - DNA, 168 bp, Homo sapiens
gatatgacaattgttttgttttcatagatctggcctagcagcttaattgtgcagccagacctgggtaatcctggagcaagagtactacccctaaattcctaaatgtactaccttaaatgcaaaatatagatgataatgtttaggtgaacatgactttcagccacaaag

SEQ ID NO: 141466 - DNA, 481 bp, Homo sapiens
cctcctaattctcatctacttctcccggatggccaaatacgctaacctggctcaggggtgtgcttcacttctggcatcctgcttccagcatcacttgccatgatcattactatcaagccatgctaggcatcatgacctctatgcagatagaaattactggattgtctagagaatactttcccctcttgcttttcttgactgccctggcagttttcatgaaaatatagttcacctcatgagtatggctccctcccactttccaccccaacttcctttggattcccttcccagaacttcagcattgtctcttatggtgggcaagtttctccacagttagcaagtattcagtagcaaccaaggttctacaagacttctggggacctaagaaacactctcaaactacccactatcttctcaccgaaagtaattctttgcctctacttcctatccccaggcctctagtgggtcctatcagctttct

SEQ ID NO: 141467 - DNA, 654 bp, Homo sapiens
tcttgagcacgttcatcagcgtgtgcaaaaggtgctctttgcccaaataaattcgggcacctgctggacagaacacatctcagcagagatttttgttgaaggacttttcggggcctctgccgtgcctgtgtgtgtcgtgactccagagtgggaatctgcagggtgtcacaaactgacttagtcagagtccgtctccacccacccgctagccccctgaagcccacccacagcatttttcaggatggttctgcggcgcatatttttgaaaatacgtttgctttttccgttagtgggttttccctgagtgcttttaatattgtcacgaggccgtgtgcccagcgggaaagatgctcctcctgcttcaacaaaaactccctgagcctccagaccagggctggcttctgagcacttgagatgtgcctggtccaaattaagaagctgaaagggtaaaatacacactggattgctaaggcttagtatgaaaaaaattccttaatactttttttatattgtatcttttctttgtttatattaatagatgttgacataatattttgggtgtactggattaataaaatgttactaaaattacatatgtgaatctgagcaagaatttttatggcttaaaccaagattgttctcaagtttatatgg

SEQ ID NO: 141468 - DNA, 302 bp, Homo sapiens
cagtgagttgcttaattatgtcagtttgttgtctgtagctttcagtcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaa

SEQ ID NO: 141469 - DNA, 396 bp, Homo sapiens
ggcaggcatgaacaatgaaagctctcactgggtagaaacaattttcctagattcttcaagaacaaaagcaaatatgtcctggcgaggtggccgacacctgtgatcccagtgctttgggagtccaaggaaagaggattgcttgagcccaggagttcaagatcagcctgggcaacatagtgaaacctcatctctacaaagaatgtaaaaaattagctgggcgtgcttgcgcctgcctgtggtcccagctactctggaggccgaggtgtgaggattgcttgagcccaggaattggaggctgcagtaagccatgattgcaccactgcactccagcctggacgacagacagagaccctgtctctagatataaaaataaaaataccttttttttttttttga

SEQ ID NO: 141470 - DNA, 860 bp, Homo sapiens
ggcacatgccttgtaattccagctactcaggaggctgaggcaggagatagcttgggagtcagaggttgcagtgagtcggaggttgcagtgagccggaggttgcagtgagccgagaccactgcactccagcctggtgacagagcaaaagtccgtctaaaaaaaaaaaaggtgctttctggcccaaagcttaccctaaaaatggagaaaacacagggcaagttaggaaaaaaaggatcagagaaagaaaaaagtagatgggcaatggtcagtcaggtcaccaaaaatacctccgggacatttccacccaaaattgcctatctgagctaatgctttggaattaagcatcctttgctaatatgacatgaaatctgcttttagattaaaaaaagaaaaattcatggcttaaagttttgcaactgccaccttttgtaaaggcagttttcttaatgcactggagttctaacatgtttatggcccacacatacatattttggggctcctgctatttggtgagagaagacacaaatgcatgggctatgcatggatatgtttccatggggcctctttgctttcatatttatccagaacgtggtacatgctttcctttcaggctgcaattcacagggtttgttttgttttgttttagaacatacgttttcaacgactgtatctttaaataatctgtttgaatttagcttttctcttccttgggaatagctataaatgttggatttttctttgcttttcatttggtattctcacccccattgttttcatctctcccttcttttctgttgtattttgggagagctcttgcatctgtccttttcccatcagtgattaaattttcagcaatgtta

SEQ ID NO: 141471 - DNA, 237 bp, Homo sapiens
tggacctaggacactagtgcaggcagtactcctggatcaattgacaatttgtctctcagatagattcagttgaggaatttgtccctggatatttgtactacaacatactaaaatcaaaagtcaaaacatcatattagttaacagaaagggttatttatttattttttcttagaggtctgtcacacaggctggagtgcagtggctcaatcacagttcactgcagcctcaacctcctgg

SEQ ID NO: 141472 - DNA, 443 bp, Homo sapiens
cagcctagagggtttaacaggaaattagcctgtgctattgcactgaattatgacgaataactcttgtaactgtacaatatttgttttttccatcttgtacattgggctcctgacaagattttatgttttcctcaacagtttaagaatctccaggaaagtgagctgcactcccttggtactttgtttcccctgatcaggggttttggtcagttggggatgcttcaacaaggcgccgtagactaggtggcttgtaaacgatggaaatttacttctcaccattctggaggctagaagtccaagaccaagatgccagcatggtcaggttcaggggaaggccttcttgcaggcagcagactgccaactgcttgttcttctcatgtggtggaaagagagctcgctaacttcctggggtcccttttgtaagggcataaattgcattcgcg

SEQ ID NO: 141473 - DNA, 302 bp, Homo sapiens
atgtggggaatgggagttgagtgcatgatggaatgggagagcctttcccttcttgtcaaagggtgctgaaatccctcttctcctggacagggtggctcataatcggccagccttctacttccttgttcctatatctgggaagaccttttttttttttcggagacagggcctcatcctgttaaccatacaagagtccagtggtgcaatctcggctcaccacaacctccgccttcctggctcaagggattctcctgcctcagcctcctgagtagctgggattacaggcgtgcgccaccaccgcc

SEQ ID NO: 141474 - DNA, 550 bp, Homo sapiens
tgcatgtttcactgctgtgaccttggtctctgtattgagattgggagctcctggtgggcagctcctcacctcagagacctgcttatgactaagcccaggataagggcttgttgagtgatactatggaattcaaggcctagtgccttgaacaaactcactatgtgtcttaaggagagcccctgctctcttctggtggccaccaatcttgaagtctcatttacctgtgctgggattctgtcctgagagctgatagtggaagagactggcacactctcacatcaggctggcaggaggctggtgttgagggaattagctcagggagcaaaggcatgggtagggaaaggtgactaggggtaggaaggagatgaatggggatggggtccatagaccacactgtctgccgcagcatccccagctggacttggtggggcccaggcagggaatagctggcatccagacgtgctaacaagtattcctgagcagtctgtgtcaatgcaggtgggggataatgacacagaggaagacagagtagagagagctgatggacccc

SEQ ID NO: 141475 - DNA, 262 bp, Homo sapiens
aagaccagcctagccaacacggtgaaaccccatgtctactaaaaatataaaaattagccaggtgtggtgacacacacctgtaatcccggctactcaaggaggccgaggcaggagaattgcttgaacctggaagggtgaggtcgcagtgagctgagatcgcaccactgcactccagcctgggcaacagagcgagactctgtctcaaaaaataataatttattgtggtgaaattcacagaacctaacagtcaccttaaagcagc

SEQ ID NO: 141476 - DNA, 445 bp, Homo sapiens
aggccccagcgggcgcttgtgctggtactgtcaggtggcaggaagcccaggaaatccagccctctcttttcccgctttctgggtgggagctggacagcggatgcagatgcgcaggccttcaggcagagcgggctgatcctccatcaagttcgacagggttgttttttagaggtcttttttttttagcatggcattgggtttcttcccccactctctctcgcctgatggaccccctcccctggccaggatgggctggtggcagcgcacaggactcagtgagagctaatgataaatgtaatagtgtgtaacagtgatagagggccgctggagcctggttgtcacacacaattaatatcccccgccgttctgtctccgtttgtttgttcccccgtgattcggctccccgttaactaatagcacatgagcccggacataaattgtattt

SEQ ID NO: 141477 - DNA, 314 bp, Homo sapiens
ctgtgtgagagaggtcacactgtcccatatgctaaggttggccagccatttaggggatacgttttccattctgctggcggcattttagaagaccactgaatagtctcagaaatatcatcaagaatagttttaggggctgggcgtggtggctcatgcctgtaatcccagcattttgggaggccaaggtgggcagatcacctgaagtcaggagttcgagaccagtctggccaacatggcaaaaccccctctctactaaaaattagctggtcgtggtggcgggcacctgtaatcccagctacttgggaagctgaggc

SEQ ID NO: 141478 - DNA, 223 bp, Homo sapiens
  misc_feature (169)..(169): n is a, c, g, or t
  misc_feature (209)..(209): n is a, c, g, or t
tctctatgccaagctacttctacctactaaatagctattttccctcaaatctttcttaactcctgtcctccatccctgccttgcttaccagagtattatgttgtttgtgtgtttgtctccaccttccctccctccttccatttgctgctttaaagaaaggaagacagtnaaagtggagggctggggacactatcagcatcactgcattnagtctcaacatttg

SEQ ID NO: 141479 - DNA, 263 bp, Homo sapiens
ttttctccagctactaacagaagaccaggaatagaagaggaataaggacaagagagaagtgacattttgcttcgtttagccctggtaaacactcggaagcaactcagctttaaaaatcttttcatgatgcattttagtccatggagatgcactcagcactcaagagttgttaccagagaattccaacattggggacaggcacagtggcacatgcctgtaatcccagcactttgggaggccacggaaggtggatcacttgaggt

SEQ ID NO: 141480 - DNA, 573 bp, Homo sapiens
atccaccctgttttcactacctacctagcgagcagatccaccctgtctactctacctgcttgtccagcaggtccaccctgtctacactacctgcctgtccagcaaatccactctgtctacactacctggctgtccagcagatccaccctgtctacactacctgcctatccagcagatccaccctgtctatactacctgcctgtctagcagatccaccctgtctatactacctgcccatccagcaggtccaccctgtctacactacctccctgccaagtagatccaccctgtctacactacctgcctggccagaagatccaccctgtctacactaccttccttgccagtaatgcacgctatctacactatctgcctggctagcagatccacgctgtctatactacctccctgtccagtagacccaccctgtctatactacctccctggccagcagatccaccctgtctatactacctgactggccagcagatccaccctgtctacactacctgcctgcccagaagatgcgccatgtatacactacctgcttgtccagcagatccaccctgtcta

SEQ ID NO: 141481 - DNA, 382 bp, Homo sapiens
atccatgtgtgcacagcaggatggtctgtctccagctcctcatggtgctcattgttgacactgactcaacaagaaagccttcattgagccaaggagaaaagaagagtacaaacctcagagcccccctgagttacttttattacagggtaattatcagtgaaatgcatccactattttttaaaaacaaaacaacacttggtactttctgagaaatgtagatagatttgcagataactttttgctacagttttatagtatacaaaactatacaatatgtacatatattgtaaatccttttgcataacaaataatacattaaattttaaaaaatctatataaggatagcatactaggagtatcaaaaggaaaataatcattgatc

SEQ ID NO: 141482 - DNA, 789 bp, Homo sapiens
tgtcttctccttctctcttccttgtctcttttctttctttctttcttctttttttcctttctgtttcctctttctccctccacttcttcctgtgtctcttctctctttaactctgctcctctttctctctggctcttttctctttgtgtgtctctctgctgttttcttcctcttttgccttctttctgcaccttttaattttctccgcctggaatccagcctcatttctgtgtcttttctctgtctcttcggtggctgtctgtcctccatccaccactcctgttctgtgagtcatcccttccccagggagagaaggcaaccaacattctccttgctaggccttgattttttattttattttattatttttttttttttgagatggagtttcactcttggcccccagtctgcagtgcaatggcgtgatcttggctcactgcaacctccgccttccgggttcaagcaattcttctgcctcagcctcccagtagctaggactacaggtacgcatcaccacgcccggctgatttttgtatttttagtagaaatggggtttcaccatgttggccaagctggtctccaactcctgacctcaggtgacccgcccgcctcaacctcctgaagtgctgggattataggtgtgagccaccgcgcccggccactaggacttaatttgaatggaaggtgattttgcctctcacaaaggacaaagctaacagatctccgaagtgggagttgcctggtaagccaggttgacccaggcactctgggcttcaaggattgggagac

SEQ ID NO: 141483 - DNA, 214 bp, Homo sapiens
atggctgtgttcccggggcctggggtgcaggccaaagccctcagagctcagtctctgtggtccatctcaccagggagcagggtggcctcccatccctgtgacctgccctggccatacccacctcctaatggtgggcgaggtgcagctttcggtccattggtgacatctgcctaggtgcccacgagactcaccatctgcattgcagttagagtcc

SEQ ID NO: 141484 - DNA, 164 bp, Homo sapiens
cttggccatgatgatcccatctttctggtatgataaggggtggagacgggacaggggaccctggcagggaataggaagggggcataagattgagggaaaattggtgtgatctggggatactcaagaacctgatacggtgaataaaaaaccaagaatcaaccctg

SEQ ID NO: 141485 - DNA, 388 bp, Homo sapiens
ggagcgcagtggcactatcttggctcactgcaacatccgtctcccggctcaagcagtcctcccacctcagcctcctgggtagctgggattataggcacatactaccgtgcccggctagaggattatagtttaataatggatttatttctaagtgtaaaaccagatgaaaagcaaaggccaaactacctgccatccagttagtttgaaatgatccttcatttatgcaaagagaccgacacagataatccaaaaactattctttttactttggaacgtgaaggcaatgattttttaaaataattgttttgcgttgaacaacatcaaaatgattctgttcctaacttcactagatggcagagagactcaaagcatttgagatagcagtagc

SEQ ID NO: 141486 - DNA, 125 bp, Homo sapiens
tcatgccatgttgaacacatccattttcagtcagttgaccctttttacccttttgtgacaccaacaagacatgagatgaatcaaaaggacttcccacccatcaaaatcacagcactctgcctacg

SEQ ID NO: 141487 - DNA, 416 bp, Homo sapiens
aaaacaaacatacaatctctataaaacaaatatttttaaaacataaacatcacaataatcttggcatgaaacagaaatcatgaaaaatacagactttaatgagtgttcatcataaacttaatgatttttgcctaccagaaacaacctggcaacagaaataggaatttacttttattcctttctaaaagctggagttgggactacctctatgaaacagagcaggcatgtcttacacatgttaggacatcaagatgaagtctccactagcaacagctaattcctctcccccttcttttcacccttctaggaacaaagaatgcacttagaatttctaaacttaagaaaacgaaaaagtctttggaaggaaaatagcttatcaatagataagagaaaattctaagggaaaaggaaaaaga

SEQ ID NO: 141488 - DNA, 260 bp, Homo sapiens
ctaggcaagattattacagtagcgctttcctctttttagaatatacccttgtctagcccctaccccatcttcaggacagtaaaggttctcaactcacttcaaaccctcctagccgtctagaacagtggctcacaaccgcagacccataggaaatgtagggccatctatgtaataaatttatccggatgtattataacaattttaaggttacacttgtcctttcttgaacaggacaattctttattctaagactatatgct

SEQ ID NO: 141489 - DNA, 289 bp, Homo sapiens
ggtttttattaaagactgaaatttgacatggtggctctttatgtaagtaacctgttgtggaggctaaagtaactccatcttggatgctaatccactatgttgacttgtgattaaccctggttccaggaatgcctctgagatttccagttcatctattgttccttgtgttaagagcacatccttaccataaatcctgcccttagatcaaactcctactcattccctctgaaacacgtgtaccttttcctgtggtttataatccctgggtctgggggtggggggtaatggt

SEQ ID NO: 141490 - DNA, 231 bp, Homo sapiens
gctgttttcctttcgtttctttgtatttcctcatagtaaataacctggagccagttcaaacctggtatccagttactatcgactgaattgcatttattgaagactcattttagacaattgcaagatgaagcttttgagaaatgatgaagaatctcggatactctagtgtactaaagagaaagtatgctcttaaaatgttcaacttgttttgtcttgtttatatatccgtaa

SEQ ID NO: 141491 - DNA, 190 bp, Homo sapiens
tggaacacagagaggcgctcttagcacatgaacacaaccccagaccccaagaagcatatcctccagcactgtgataacaatttaggaaaaggtcaagctccacacaggcacttaactgagatttaccaaaaaaaaaaaggaatgctaaaggataaggcattaaatatcaaaccagtaacagctggctgga

SEQ ID NO: 141492 - DNA, 197 bp, Homo sapiens
catattttggtaccatgtgagttggataattttcaccactaacaatacgatctaagaaacatgaaactgcagcatcaaaaaagagctttctgatcctgacacctgcctggagtgaactccatctgaaaaatcctggtctattagccctggcaggtgcttctcagatctactaggccagtgtttcacaggcatcaatt

SEQ ID NO: 141493 - DNA, 714 bp, Homo sapiens
gagacttagatgatagagagtccaataatttgctgattgctgtatatatttatctggttgttgaaaaggagcttaagctagaagatgttgggtaaatttccatggctcagcctaaatctcacaatttgcttttcaaatattctgtatgtctatgtcctttcaatcgaggtcatgtgacaaattgtttctgtgatagaagataaactttctgagggagaggcaagttgaccccataatctcaactagtcagagaaatcatttaaagaggaagcaatttggaaactaaaaattagttcactctctattccaaaattaatatcccatgctaatgtgaaaaattgaactatggagtccattttactaagaatactgcatacatgttttctaataaaattacacttttctacatatacatacatttataatgtacatataaattttaacaattttgacaatttggtattccagtgatttccctcttgacttcctgtgcccaaactactttcttttaaatatctcacctgctttatttttttattttcgtcaaaataggtctttaaaaaattagcattaccacacagtgtattgttaatataatgtaatttttgtttaacttaggaattatttgaaattggttccagatgtgaaagccatggagattgcatgtaaataatattgtgttttgaagccagttatactgtgttaagtggataa

SEQ ID NO: 141494 - DNA, 279 bp, Homo sapiens
tggggttttggtctcctcccactcggggctaagggctcagaatgaactggaacccaacctttgtcaggggagcccagcaatgtctgcacgacatacgcccccaaacagcgtgggttcaggaattgtaagtgtttgagaaagaaaaactgttaggattctagtttcgttgaaaagccattttgcctttgtcttcctctgggcacctgaccatccattcttagcccacctgagtattgagcatacactatcgtctctgcagtggaggtgggaggagaggaa

SEQ ID NO: 141495 - DNA, 242 bp, Homo sapiens
aaatgcatatttgaaaccagtgtgcagataatctgatttaatacagctccttttgactatcatttgttgttagaattgttgacatgctaggagttggaagggaatggctgtttatttttaaaacaattttgtgacatatttaaagatataatggctgcactgaatcaatgattattacctatcatgaaactttcattacaatatggataccattttgtcttttagttcttttccatgtgtct

SEQ ID NO: 141496 - DNA, 298 bp, Homo sapiens
catgcccactcggaaggagactggagaaggggggtctcccttaacggagagtgggttgtgttgttggctgaggaaggggcagtggatgctaggcaggcagaattacaggcatcctttttcactgtggaacaggggaggctcacttatcagggtgaccattagaaagtcatcctggcgtcagggagactagcagtgagctgttgcagcagttcagttgggggtttctggaggcaaaagtggtgattataaccctccccaagcgaagcatatgtgaatttccagacctgagcaagccagg

SEQ ID NO: 141497 - DNA, 594 bp, Homo sapiens
acatatgctgccttgttcacctctctccctccacctggctaactcttacatatcctcataacactcaattccagcatcaccccttcctccctgcagaggcaaaaaacaaatttggttttgaagctactgagatctaaatgaccacaggacattcaagtagggaaaaacgattagtagctatccataaagaactagaacgaaggagaaagaaagggctgatttcagatctggacatatcaaatgatagcagaaaacaggacaatccacaagtctaagaatatgtagagggacaagggtccaggatccatgactggaataagaataggcaccgaaatggaaacgttgactggagacacagagaagacaagcatttagagcctgtgtagaaagaaatcaagtggattagtaactagatgggagcaagagaatcaagttaagcacatccccactccactctcacagcaggagacgcgcaggcacgtgtttcaagacagaagcaccaggtagatggctcagcatggtactggttacagaagtttgtcagatgaagaaatgagaggctgaaaataccaggaaagaagctcccagaaagat

SEQ ID NO: 141498 - DNA, 155 bp, Homo sapiens
cctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcagg

SEQ ID NO: 141499 - DNA, 188 bp, Homo sapiens
tgcaaattctgtgagatgagaaatcaaatttgggcctgttagtttatctgaacacaagactttccacatgttgggcccatttatctgtcttagaaaaaatctcaaaaaaaaatgcccttgtgtttccgtctccttcatgtgactgagttcccttgctctgcagtgatgccattgttctgccgctcatg

SEQ ID NO: 141500 - DNA, 123 bp, Homo sapiens
tcttccctcagaagttggcaggaacggcaacaagacaatctgttaggggtgacagctataggctcttctcttttttaaaaataatatagtcaatattcaacatggttttctggggtaaaatca

SEQ ID NO: 141501 - DNA, 391 bp, Homo sapiens
cacccctttgtaaaaaccaggaaatcttgccgtctcacattttactggccaggacacatgcccaccccttaacttgtcactggcaaaggaggcaggtttaccatgaatggctttcactaaccagaatggagctctccccacagcagatggctgtgcagaggagagtgggcaacagagggcgggggcttctcttgccaaggagaagatggagaagcctgtgggccccactgccaccatctgccccagcctctcatatcccttctgcctgggtgcctgcctcagtgtccctttagtccctctttcggtctgtcttgaggggaggccatggcatgtgaggggtatcatttaggctctctgtgttcatttcctgtggctgctgtaacaaatcgcc

SEQ ID NO: 141502 - DNA, 836 bp, Homo sapiens
gcatttttcttttctgagacagcatctcactctgttgcccagtctggagtgccatggcacaatcaatcttggctcactgcagcctcaacctcctgggctcaagtaatcctcacacctcagcctcctgagtagctgagactacagacaagccaccatacccagctaattgtttaattttttgtagagatttgttgaggtctcgctgtgttgtgtgggctggtcggaaactcctgggctcaagccgtcctcctgccttggcctcctaaagtgttgggattacaggcatgaaccactgtgtctggccatgaatgctgcatttaaagcagggatttaagaatgtgtcaaaagtgggaatgaagacatgttgcacagaatgaaaagggtgcccggatcatgtctgtctggctctccatgaccacagacaagtgatttcacctttctgagcttctgtttcctcatctgtaaaatagaagtgccttcttccttgtgctgtgcggggttttgagaagaggtaacttagtttggaaagtgctgagcctggtggttcagagccggggttggaaaccatgccaccgctcttgtttttgcactgctggagagccaggaatggttttctcacatttcaagtgttgtaaaaaatgaaagaataggtgacagagaccacatgtgacctgcaaagccactttttcctcccaggccctttgtagggaaaagtttgtgttttagtttagagatgggctttgaaatcagacgcttgtgttcctgggtgccctctgcctcatataagcctcctgaccttgaccaagtactctgtgatatagtttggctgtgttccc

SEQ ID NO: 141503 - DNA, 155 bp, Homo sapiens
accattctcctgcttcagcctcccaagtagctgggactacaggcgcccagcttagtttgaacacaacctttacacgcttagtttgaacacaaccacatttgtagttgcccaaaaccaggcgcccctggttagccttcagaattgtgcactccctg

SEQ ID NO: 141504 - DNA, 231 bp, Homo sapiens
tgaacccccagaggaagaacggtctgatggaggcgctccccagagcaggcgccgcgtggtgtggccctgttacgacagctgcccgtggtcccacctctcaggtgggaccacggggaggagacaggaatctggagacttgagcaatggtggggaatccattgcagtggagctgaaggacaaatggggaaaacgggggaagagagagaagggaagagactcaagtcagagaaa

SEQ ID NO: 141505 - DNA, 500 bp, Homo sapiens
tctcagaatatccagtttacacaaggaaatattaaaattaaattattgtgaaaatctattttctgctgggaagaactgacctgtgatgtggcatgatgttttctagaaaagcatctcgattttgcctgttcacagggaatcatagctggacctcagaggtctacatgtcgggagatctgttggtttggcaaaatgctttctctcttcttccacccatgtctggagatgcattataattagtccctcctgggttctgttctctatttttctgattttttaaaaagtactttttaatagatgagctctctctgccacccccagtcaagactttgcagtttctgtaatcacagaggtaggaaatcaaaacaacagaggagatttggctctgagcttctgtgtgtgtccctagcggtgggggacattttgcccaacagatttaactggtacctttgtgttctgaagataatgctactccattatctgctattgtgataaacatt

SEQ ID NO: 141506 - DNA, 110 bp, Homo sapiens
catgtggaaacaaaagttagagctaaaatccgtaagaggaaggtgacaacgaaaatcaaccatcatgacaaaatcaatggaaagaggaagagcgccagaaaacagtaaga

SEQ ID NO: 141507 - DNA, 237 bp, Homo sapiens
tccgtatgttatccaagagggtctcctggcccgacacagagcagcacccactgctcacctggtcaggcaggtgctgaggcatcagggcaggtcgctcaccacagactcagccaccagcggcagtgctgggtcgtccagtggcttctgaccccaacgtgtccccagagcacagcttcccatgggccctttcttcccactacagcagaaggcttttttttttttttttttttttttttt

SEQ ID NO: 141508 - DNA, 440 bp, Homo sapiens
gagtgtgcgtggggatgaagagcaagcagggagggagcctagattccctgctgatacaccaaggaaagtctctcccttgcactgccacaccctgtcctgccgtgccagccaagtgtgagtgcccctcatctcctgagaaatctggcgtggccttagcatttcattaggcaacttggtgggaagacacactagaaaacatgaaaggtgagatctctttgattaaacaagaatgtttgggtacaactatttaccactaaaatacacttagctactaggcatcattctaagcaacttaacaaactgtgatttatttatacctctcattagagaagtgctgtatgtattcccagtttacagatgagaaaactgcaacatggtatcttgctatgttggtttccaaaagtggctgtaacaaagtaccctaaagggagtggcttaaa

SEQ ID NO: 141509 - DNA, 295 bp, Homo sapiens
aaggagatcacaaagctagaagaaaagaagggacttctaccttgtttttccacttcctgttttcaattttacttcagttagcagcacataactgggcctagctccagcttctgagtattctcagtaccaaccttgctgtgcctcccctcaagccccaggtgccagcagcagccatgccacaccccctcacctgctgggctgcaccccagggaggtctgagcacctgcagagccacgcccctttggtggaaaccccatcgctacatcaccatcatcaaagacctgagcaagccagg

SEQ ID NO: 141510 - DNA, 263 bp, Homo sapiens
gcataattttggaggcaggcaagtcccaagatctgcagggtgggccagacccaggaaagcttatggtgtcagttccagttctgatgctgtcctgcttgagacccaggaaaagccaatgtttcagtctgatctgaaggtgggaaaaaatagtgtcccagcttgaagacagcccaacaagaggaattctctcctatccaggggaggggtcaggctttttgttttattcaggccctcaactgattggacaagggccacacaaattg

SEQ ID NO: 141511 - DNA, 383 bp, Homo sapiens
gagatataattcacatattattcatccaaagtgtacaattgaatggtttttcaaatattcagagtgtgcaaccattaccacaatcaatgttagaacatttcatcacaccccctcctcaaaaaactatacccaggccaagtgtggtggctcacgcctataatcccagcaatttggattatttctactttttggatattacgaataacactactatgaacattaatgtataagtttttgtgtgaacatatggtttcatttctcttgggtatacacccaggagtagaattgctgggtcatatggtaactccatgtttaagctgtgggagaacagtttagattgttttccaaagcacctgcaccattttacattcctaccagcagtg

SEQ ID NO: 141512 - DNA, 795 bp, Homo sapiens
cgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccct

SEQ ID NO: 141513 - DNA, 599 bp, Homo sapiens
cgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataacacgttcgcgagggataacacgttcgcgagggataacacgttcgcgagggataacacgttcgcgagggataacacgttcgcgagggg

SEQ ID NO: 141514 - DNA, 608 bp, Homo sapiens
cgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagaggtatttgcttttatttaaaagtctgttacttaaaaaactcggctaagcccggtggcttatgcctgtaatcccagcacttgggggggccaaggcaggcagatcgcctgaggtcgggagtttgagaccagcctggccaacatggtgaaacgccatctctactaaaaatacaaaattagctgggcgtggtggcgggttcctgtaatcccagctgctcaggaggctgaggcaggagaatcacttgaacccgggagggggagtttgcactgagccgggatctcgccactgcactccagcctggttgacagagtgagactccatctcaaaacaaaaa

SEQ ID NO: 141515 - DNA, 574 bp, Homo sapiens
ccacctacaagagtcttcttgtagctccatagttttccatgtgtttttctaacaatttctgtctcctcaagtaacctaagtatgctctgtaccttgccaagtaaaagagcctaagtaacacggtatctttgtcaagtccacaccctaaactgttggagtgcctgcatattgcatgggagtaagcacgcatacagtgagccagcatgcagtaagccttcagtaaagtttgctgaataaagctgaggggtgtgtgattactttgggaatgactgagtccatgttaggctggcaaagagtatttctatatttggatcaaggtgtacccaaagttatctgaaaacttgcgggctggagcaaaagtgaagctttgtgagtaagtgaaggaagaaatagtttaagtgcaacattaccaagaagggcctcaactcaaaatatttttgcctccaacttgccatactgcctaaaatatagacacgatattaactccttcaatggaaggcactggctatctaagtgctcacttataaagtatttatgttcagagacaggagtaacacgtaaaacttatcatatt

SEQ ID NO: 141516 - DNA, 645 bp, Homo sapiens
ggcggagcttgcagcgagccaagattgtgccactgcactccagcctgggtgacagagtgagactccgtctcaaaaaaaaaaaaaaaaaaaaaccaaagcagtagataatgaaaacattagctaagtgatcttggacagttaatttttgtggaactgtctgcccatctgtgggatggagatgatatcacatagcttagagagttgaatgtaatgacataatgtatatacagtgcccagggatgtcactgacatttattaatttatacgagatttaatttatagaatcctatatatgtcaggccctgtggtttgagatatagtgataaagaagtcattctttcacagcccatattaagcacttcaaaaatgttagttcctttcctctcctaacacaacacgcggcacattataggtgcttggtgcttgttaaactgaactcactataacacacagagtgtaagctaaataacatttttgctctcctgattctaaattcatttaggcacttactctgtaacatacaaaccaccatttaaagaatccacggatagcttgaaaatgagctcttgcttaatacttctggggccccacctctgaactggcatgtcgctgtgggtattagatgacctgttgtccaggttgaag

SEQ ID NO: 141517 - DNA, 205 bp, Homo sapiens
tgcccaggctggtctcaaactcctggactcaagcatcctcccacctcagcctcccaaagtgctgggattacaggtgtgagccccaggagcttcttctgcatcagctatttctcagttgtcttcagctcaaaataatcttatttgaaagtgacatatttggggtggggtaggatgttctaatcccctgcaataccatttattgcat

SEQ ID NO: 141518 - DNA, 345 bp, Homo sapiens
accgccatttacaactatctcgcctttacaatatcttattttctatacatttactggaaaactgtccatgagcattttcactaaagttttcatattttaaatttgcaattatgtatactacagctactgtttaatactaggctgaggttagagattatccaccttacattattctgagttgatatggagagagatgtgaacatgaaacttctgaattaatatgaacaaatgtctagaaaaatgattatttaatatctgaatgatttattttacaaagtcaatccctagtgggatacaattacaaagagcaacacaggaagaaataaagctgactgcctcactgtt

SEQ ID NO: 141519 - DNA, 479 bp, Homo sapiens
gtttaaagttttgaagaattgccaggctgttttccacagtggctgtaccttcttgcatgctcaccagcaaggcactagggctccaatttcttcacattctcaccacagcttatctttcgttttttggaattaagggtttgattttaacagttgttcagattatatcacattgctccatggcaacagttaatgacatattctagatatacatttgattaaaatatgtactgcttccaagaagcctttctcattttgagaattgagattcagttttatagattcaaacaagaataccaatcaaaatttcagcagactggattggtagaaattgacaagctgattctaaatggtatacagaaattcaatggctcacacctgtaatcccagcactttgggaggctgagacaggaggataacttgaggcaggaatttgagaatggcctgggcaatgtagcaagaccccatctctacaaaaataa

SEQ ID NO: 141520 - DNA, 401 bp, Homo sapiens
ctcatctccctcggcttgcacctcccaaattaagtatctctgacagaggtcacacagtaaggtcacagaggttacgcactgcttacccttgttttcattttttatttgttgttattgttattgtttcattggtattgttattgttctgttggtattgttattgttctggatgaaaagaaacaaacacctgagcaaaaccctaagtccaaaatcaaagacacaacttttggttaaacatggtggactgatcacatgagttattaagaattaattcccataaaaatgattttaaagtaaacaaaagaataaagatataaaggggaaaagaggtagtagagatcatttctatcaggttttgacagctaaaaagtggatggtcagaggccgaggtaggcagacca

SEQ ID NO: 141521 - DNA, 245 bp, Homo sapiens
agggtttcactgtcttgactaggctggtcttgaactcctgacctcgtgatccacccacctcgtcccctcaaagtgctgggattacaggcgtgagccaccgtgcccggcataaagtaaattcttaatgatctatgaaaagaaaatggcaggccgggtgtggatcccacctgtaatcccagcactgtgggaagctgatgtgagaggatcgcttgagcccaggagtttgaaaccagcctgggaaacat

SEQ ID NO: 141522 - DNA, 400 bp, Homo sapiens
ggtaacaaggcacctggcacatagtaggatctcagtgtatgttactttcttatccttgatgtcacacctgaagcaggtcagcaagcaaaggaaacgggctgggagtccaagatctgggtttgagtgtcagcacgtcctctcattagctgtgtgccctcaggaaaaccacttaacatctctgagccccacgtttctcatcttaaaggctggaaataattgcaacttttacctacctcgtggggtggttgtgaggcttgaatcatcaaatgaaagggctttgtaaatggcagaactccatagaatggtagttcctcctccttatcattgcggttagtgataattgtgtatctttttcatttgacttgggtaaatattagccaattcccagtcatgactcaaa

SEQ ID NO: 141523 - DNA, 439 bp, Homo sapiens
taggtttaggatctcttttgggctgggtacatttctcttcataacttaatcttcaaggcagaaaaaccatttaagcaaacccttgttttaatatttgaagagaatcaacgtgcattgaccatttccacagaaagctgaaactcattgcacagaaattttaagtcatggccatgagattctagaatctacatctagaagccattttcaactataatgttaactagaatgccttttagggaaaattaagaagcaaagttctcctggcccctgccctgcctttctctctgtccttctttgcctctggagtagacctgaggaaatttttaatactaacgagaacttggtgctgcgtagcctctgagtctgaaatgcctgagaaagcagtccagattccaactgtaaaacattccttcaccaagccttggaaactaacatacag

SEQ ID NO: 141524 - DNA, 852 bp, Homo sapiens
tatcacacattttaactatatttaagcgtacaatcaagtgccattaattcacagcatctgcatccatcagcactgtctacttctagaactttgtcgtcatactaaattaaaaaatctgtacccataaataataactcccaactttatttctgtaaaattggtgttgatgttcccattttcatttcttattttaataatttgagtcttttcttttttttcctagtcaagctagctaaagatttgtcagttttgtttttctttgaagaaccagttttgattttgctgattattgtttttctattctctattattctattattctctattatttctctcttacctaatctttatttttttccgctagctttggatttgatttgcttttttttctcttttccaaggtgtaaacttaggttattaatttaaaagtttttttcttttttactgaatgtgtttacagctgtaaattttcctcttagtgctgttttcactgcatgccctgggatttgacatgtcgtgttttcattttcactcatctcagtattttctcatttcccttgtgtttttgttccgtgttcctctcttgtcccccttgcaaacacctacctcctttctaagagtcaacttacccttcacctcctgtctgcaatcttgccttttcctgtcttctagacaaggaagttgcgtctgcactcccactgcactccacctcttctatactttgttgcacttactttaccaatcaatcctcctaaacttttgcttctgaccaagacagagtaactgatatcagacttgccctcctgccataaaaatactggaacctgacaatttatgaaacaactgttttcc

SEQ ID NO: 141525 - DNA, 384 bp, Homo sapiens
cctcaggcaggtcacagagcccatgggccttactttccttggccacaaatgcgaccgcttctgggctcgctgtggtatgcttggctccatgttcccacttacatatcccatcactgccccaaacccaaatgcttgagattggattcaacatctttcttcccaaacaggcctttattttagttgaagcttccccaggagagccccaagcttacaactctggagaggcctttgatttccttactctgtagatccaatcgggcctcaagccctgtcactcttcctctacaggatccacaaaatctttccttcttcttcactttatcgccaccttcaccatctaacccaaaatgttaggattgctgcgaagagctctcctcctgccaa

SEQ ID NO: 141526 - DNA, 313 bp, Homo sapiens
agaacagcattttgcgatagtctgagcttcttgggaggagaggcattttgtacggaggttttaaaatcagctaaattaccttctttctgtcattgctatttctaaatccaaaaggtgcttatatttgtccatcttacccagtccctcagtggactgccttgcccatgcagtgcatgttaataactagcagaggcacagacctcaacccttgtaggcccactgcttccttttccacagggtcactggtccctgacctggctaacctggctcccagggctttccctccacctccacaccttgtcaacaccttttt

SEQ ID NO: 141527 - DNA, 394 bp, Homo sapiens
aggattagtaatctggcatgtcaaagttcaggaaaggaaagcagagtgtccacatgtgggagtagtctagcaaggtgtgtgagaaccataacagattgaggagggtgacccctgcacaggaacaaaccagcttgggcctaggtgaggtgagacgtatgtctaggtatgtggatgggtccactgcaggaaatcagagctcaagtgaagtaagaagggcatccatgcagcaagcccatggaagcagagatgggatatttgttatatacaggggactggctaaataaatatattggataatataaagaaagcccaatttcccattgtcagaggaggaatttataaatatagaaagggaaaaaattagaatgaaccctgtagtgttggattggaatta

SEQ ID NO: 141528 - DNA, 98 bp, Homo sapiens
gcacacgggaggcgggcggatagcgcgaccacgtggcgggagcgggccagcccagggcgtccaccagccgtgtggggttggggtggggttggggggca

SEQ ID NO: 141529 - DNA, 810 bp, Homo sapiens
ttttatatagtgggaggggttcttaaaacgactactgtttcgcactgaagtctctgagcttcacagatcattaaaggtttctgaaccacagagaaaggagggcagagttaaggaaataaatcaaaagttcctctgggacgcacaaatgcctacttggaacaggctttcagcatgaatatcctccacattaaacaacagggaggacttttcaaaataaaagcagaaaagagattcattttgttacaagcaatgcactttttccttttggtgtaaaggttatgtgtgctataaaaaatgactcctgccgtgagtgctgcggggaggtggaggctgggcttggggcaggaggtggtggtggtcaaagaaaacaagtagaagtgaatacaacgcctgagaatgctgtgtttgggggtcccccaaacaagtctaaatgtcccgcaatgatttgggggtaggatgtgaggtaggagaatggtatcagaaaggaatttcttctacatttattccttgccatccttgcccaagaactgaaatcatttccccacagccagaaagaactgtcttctttgtgggtgtgcaacacacacagttgcagatctggggaaaagagactgtgccgttttgaaggcagagcctcacacttcttaaggaaatatcagttgtctcaaaaccagcagagggagtacaacgtttgagaagaggaatggccaacccgattcctgaggattcatgtttagccccgacaatggttgtaaagctgagctatctaccgtaacttctgcccttgctctcctgtcacccagcaatagt

SEQ ID NO: 141530 - DNA, 193 bp, Homo sapiens
gggactggagtgagagctgagccctgcaacctcagaatcaccttcggggcattcttccctcatcttgaagggtggtaaaggttctcgcccaggcagctctggtttctgtgctgtggaatcccagcagtctgatgccttccttcattctgtccccaccatgtcccctctggttcaagctggagggggccgcgcg

SEQ ID NO: 141531 - DNA, 317 bp, Homo sapiens
tgtggtgcatcccagggtccacaggaacaggccttgggccatcatgactgtccttaggaggtgaaggagggtggcagccctctgctgaggaccggcatgcccgtatgtcctggcacaggttgcctaggagcctgcagggttgcagcaggccaggcagtccccaggcatcctgtccccggatcctcccgggagccctacgcggcaggaggagccctacgcggcaggaggagcccacgcggcaggaggtgccctcgcggcaggaggtgccctatgcggcaggaggtgccctcgcggcaggaggtgccctatgtggcagg

SEQ ID NO: 141532 - DNA, 470 bp, Homo sapiens
tctttcgctcattacagcttcttcccttcagccgatcagacctctacctccccatgtgtggggagagctttcactgtgactgctttccggtgcctgctgttcccacctagatggttccactgtgcctgcagtttggaggtatgcaccaatccatcttgtactctcaatcactcacgggttagaagcctagaatagatggccctctgatttctgacctgcagggcgcaaactgtctttacctggtgaaatgcagacaggccagctggtcctatgtcccaccaggagagctcttcatttgccagtgtccccaaacatcagtgttacggaaacaacaaacatatctgccacctgctcccaccctgggcaatttccagaatctgaagggccttcttcactatcaaagccagtctattctgctgggcaccatggctcatgcttgtaatcccagcactttggggaggctgaggcag

SEQ ID NO: 141533 - DNA, 165 bp, Homo sapiens
agctaggattacaggcatgagccaccacacccgacctggttgtcctaaaatttaaaagctaccaaattcttatctcaacttgattgctctttttgctcttactgtcgcccagcagcctggcgaaagaaacagcctgggcgaaagaaacagcctgggcgaaagaaa

SEQ ID NO: 141534 - DNA, 439 bp, Homo sapiens
taagttatccagtcttatgcttttattagcagggtgagaacggactaatacagtaacattgggtcataatgaacatgataagcaaagctgaaagagttagttaaattattccagggatcacgtctatcctatcaaacttacttttttccttttgggaatcacttttaaaaatacaagggctttacatgtgcgttactcattatagcagccattacaagcatattctgaatctgacatctaagcaacattttgacatctacgacctgcagagttgagaggcaccaaagagaccatttcacttcacaggtggtaaaactgtggcccaggtaatgtgcgtaaactgttgaggatttcatggtttgaactggaacttctgtctattagattgagtggtatcaaattttatttggaagatgaatattgatatcttactctgctc

SEQ ID NO: 141535 - DNA, 206 bp, Homo sapiens
ctaggagcttcaggagggcagggatctacctgccctgtcagccgctgcaggcctagcacccggcacagagcaggagttcaataaagtatctgtgaatggatgttttcatgatgccagcctggaacttccatagccctgttttccagattcaagaaataactacttctctaattcagctaatctccctaggagaggcagaatggccc

SEQ ID NO: 141536 - DNA, 416 bp, Homo sapiens
aacacacatgcgtcttaaatatttgaggacctactataaaacaggcaatgtactttgcagacatacatcaattcacctaaaaatgttgatgagagatacaaaaaagcaagtctttttattcagttcttttccatttgttgcataaattatatgatcctgcatctctcacaattgtgcttaagatgagggacaatataaactttaaatcatgacaaaaaaaaaatcaggagaaatgcctgctaattaattcaaaaaaataattcatccctgcccttgaggaacatctagtcttgtgggaaagattggtaaacataattataattgaatgtgtacagtgcttaaatagaggaatattaaaaagtgctaaggaaacaatgtcccctgagtgaaaagaatgctttaaagagaacatctga

SEQ ID NO: 141537 - DNA, 417 bp, Homo sapiens
gaaaaggcaggaactggtaatttacaaaagaggaaatacagttcataaacacgtggccaaaaattacttcatcttactagtcatcaaagaagtgcaaattaaagcagcatgacagagagtgctgtgcgccgcctgccccaggaaggaacagagtctaaggactgccctgcgcccagaagcccccactcagctggccgcccttcctttgagggtctgccccaggaactcaactgacacatggcaagctggtgccccaggtctccatcctggtggtgtctaggaagcagagccttgagagtgcctgtcctaccccaggaggggccattcagcagcacttggcaaatgctgcactgggcactccagagccaaggcttcgaggacggagctgcagggagcacagagccgccccatggggag

SEQ ID NO: 141538 - DNA, 231 bp, Homo sapiens
accctcccacctcagcttcctgggtagctgggaccccaggccctctattccttgtgaggagggcagcgggcacgggtttctggatgcagtctcatctgctgtgacccttctcagaggagcagccaccattcctccatcctccctcagagcaccaaatccctgcccctgcccggtctctgaacacagtgctgggctctgccaagccctttccagcacgctccagccctgggg

SEQ ID NO: 141539 - DNA, 259 bp, Homo sapiens
cctcaatccagattctgaacagttataacatgaagaggtcccttatgttgccgtcttaaaaccacacttcctcccttcccattcccctttctgtacctgattcctggcaactactattctgccctccaattctaaattttctttcaaaaaccttatataaagggaatcatatggcatgtgacttttagggattggcttttctcttggcataattccctacagattcatccaagtcatggcataaatcaatagttcattc

SEQ ID NO: 141540 - DNA, 387 bp, Homo sapiens
tattactctccttttatagataaggagaaacagaagcacaggagattaagtgtctttcagcagtgaaagggacagagctggaacccagccccaggcagcatggcctctgagcccatgctggggaggagagggtctccacacagagcagggaggaagcttattgcaggctgcctggctgccaggcccaggaatggagcccatgccacctgactgccagccagggctcctcccaccaccactgtgccttcccgacaaggtaggaaggcaggcagtggccctcaccccaccctccttccttctctgcccctctacaccatgaatcagtaaaggggctgtctcagctccttgggtctctccacccagctaccaacggggcagtccccagaa

SEQ ID NO: 141541 - DNA, 511 bp, Homo sapiens
tccttcagcgctaaaaccagtcttgtcacactgcaggggcaccgtgtttggttttaataatctcatgtcattattagtagtaaaatataaatctgtttcttagaactttttagaaaagaattttgaaaaggttatgaaatggtactcaatgctcatctttcaggaaagaggtggagggggtgttaacttgctaactgtcattacactgcttgttttcagtttcagattaatagcaggtggtatgcagttttcaaagcaaacaggcttttttgttcggttagaaaaagcactaattgtttactgtagcctagaatattttgtgcaaagtgacaaatggcaaggatcacaaaacatttaacatttaaaataaattgatagctggctaatattgtaaattttttaattaaaaattttcttaaattgatagataacattgtatgtatttatcatgtacaatgtgatgttttgaagtatatatcatacattgtggaatttttaaatccagctaatt

SEQ ID NO: 141542 - DNA, 198 bp, Homo sapiens
ccgtctcacactcatccagtcagcatgtcactgacaggctgttgtattgactttttttttttaattgaacatacgttgttttcactgatttatgttttttaaattgaacatacattgttatcactgatttatgtggtcagctgccgaggttttcccactcattaccgctgacctgctcttcatcccttctttcaattc

SEQ ID NO: 141543 - DNA, 375 bp, Homo sapiens
ctgagcccaaagtcaggaaaagccttcccactccccacattcctcctgccgctcctctccatcacttgagtcccaggtgccagtggacaacaggcctctctctccccagccagccctgtctactgacgacagcagtctctcaactgatcttctggtcctagaccccttccttctgtccagggcccttatcaccagctgtgctgccatgggtcctgactttttccctcactggtctcacctcctgtggctctgccctccataccatccaccaggcggaggctccacaaccactcttgggtagcctcatctcatctgccctaggacagagtccaggccaagcccaggtggatgagtttccactgtgtgcacctctcc

SEQ ID NO: 141544 - DNA, 389 bp, Homo sapiens
caaagaagaaatcaaatactaattaagctataccacaggaccgacatgatcacaatgtatattcagaatattttcccattattcaattccattcacaaatgtcatctacagataggagaatataacttgaagcaatttttaaaaagaaggtaagttttgtgtgtactgttgccatcttttctgtcagaatcagacaaagtactggctcaaataaaattcagtgcccttaaaaccaaccagaagaacatatttacaagatatataaccttggaaggtctcagtctagccttaaccaaaggtcactatatggaatgcaattatttttatttttgcaaaaacgtgggctatattattattttgagatggagtctcactctgccacccaggct

SEQ ID NO: 141545 - DNA, 241 bp, Homo sapiens
tctagaggacccctcctacgagcgctactttagagtaatacttatcttgaaacagattagatttggggaggaaagaagggagacaggaagagaaaaaattttctgagagacaaacgtaattattcatttttctctataaatgttttaccaaatcctagtatgttcacttaatctttatactttcattactgttggcagtggaggcaatggaatatattttattttgatggcgatgcttctg

SEQ ID NO: 141546 - DNA, 117 bp, Homo sapiens
ggtgtatatcatattgcatttctatctaatatgtacctgcttatgggaggagtcaacaaatgtttattatttctaaatattcctatttctcagacattaaaagatgttcaagaagta

SEQ ID NO: 141547 - DNA, 320 bp, Homo sapiens
tcatgttactaagtgcaatcaaaagtgcgaagcaaactgtcccacaaagagtggatcaatcttccaggcttcttaaccatccccacccactgacgtatatatatgtctttttccccgtcaatgacagagccaaaagctaaatgctttcaggctcaatctcatattcttctaaaaacatcattagaagagaccataagaccatctcatgtcaaggaaaacacaccaataaggtcatccagttctcctagaacagggatgtctgatagaactttctaccatgatgaaagtattctgttatctacactgtccaatatggtagc

SEQ ID NO: 141548 - DNA, 327 bp, Homo sapiens
attctcctttcatctgtggcctcggaggctccccatgttttctgaggtgcacagaacatggaggggtgctcatctcatgtcagatattggaaggatgtcgtgcaggaaggttcgagggtctcggggtggtcctgagaagccgatgtgataggtgcggcagcttcctcttcccctgagcgggggcttccagagcctccctcccactggtgcccatggggtttgagcctgatagctccgcaggattcagctgctgtgagtcacagccaggatggagaggtctaaggcaggcctgatgccgggcagggcgacatttctagaaaaggtttc

SEQ ID NO: 141549 - DNA, 327 bp, Homo sapiens
tgggagtcctctgggactcctccctttgtgtcatcttcatacacaactcaccaactagtcttgtcgattccattagaatcaatcacttctctccatctccactgctaccaccatcctagttgaagtcatcattatgtttttgtctgtcaacagtaaccactaaaatgtgtggccccagaaaggggatagctggacaatgttccatgcttgcctccctacaatccattttccatgcagcagccaagtgaatatttcaagcataaatcagctcatatccttcctatggttaaaacccttcagtggcttcccattgaacttaaagtatca

SEQ ID NO: 141550 - DNA, 381 bp, Homo sapiens
atctaggatacctgtgagagtgacttgtagattttcaaattttctcctaatattttcacatgcacgaaccgaaaagagtttaaatcatgttgctccaattacttttccaagaaaaagcaccaaaaagaggaaaaccttttcccacatcgtcttcgtggcatccgctagctgaagaaaatggtttggccatgagaaactgatcacatgatttcttatgcttcatgtctgtgtattggctcccattttctcttccagagaaaatggaaaacattttcacattgtccagtaaacaccatacagcaatgcatgcagttatttacttgctttctttgaataatgggaaaaacagcggggtgctgcaagtgaaataagtccaaacgg

SEQ ID NO: 141551 - DNA, 676 bp, Homo sapiens
cccttccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctg

SEQ ID NO: 141552 - DNA, 295 bp, Homo sapiens
catttctcaatcacataccgttcccaagtattctggaaagggtctctaatctcctctctaggcctgaccttcaatacatgcataatgaaatagctgtccacaaatgcaacagcaatgactgtcatggcaaaacctattattcatttcctatacctttcactgcttttctctttcttcagcatctagcacagtgtcattctaggtactgaataggtatctgttaacatctgtgcagcatgcattttaacatcatactagatgttaaggtactgggtaaagttgccaaaagtcccca

SEQ ID NO: 141553 - DNA, 484 bp, Homo sapiens
catgttgccaagatggtctcgatctcttgacctcaagtgatccgcctgcctcggcctcccaaagtgctgggattacaggcgtgagccacctcgcccagcccatgcttgactaatttcttgtttttggtagagacagggttttgtcatgttgcccaggctggtcgcaaattcctgagctcagatgattcccctgcttcggcctcccacagtgctggaattataacagtgaaccactgggcctggccttgcatatctctgtcatactggttactattaccctggcctcaaactgtctgtcagtcacttctccccactagactgagtttttgaggcaagcgttatctcattatccccaatccttggtgtagtacctggtacatagtcatctcttagtcaatatttattttaaaagtaccattgccaatattttgggcctgctttactctgtttcgctaccataaactgttttcctaatccctgaaaa

SEQ ID NO: 141554 - DNA, 228 bp, Homo sapiens
atctggctgggcacagtggctcatgcctgtaatcccagcgctttgggaagccaaggttgaaggaccgcttgaggccaggagtttgagaccaggctgagcaacgtggcaagacctcatctctacagaaataaaattttaaaaattagctgggcatggtggcatatacctgcagtcccagctgcagtgagctataatcgcatacctgcactccagttggaagacctcttt

SEQ ID NO: 141555 - DNA, 216 bp, Homo sapiens
ccgcagaggttgtgagtgtgtgtgtgtgtaggtgttgtaggtgtgtgcatgtgtgcatgtgtgtgcgcacctgcatgtacatgtatgtattatagggcacaggactcatgaagtgacagatcaccatggggtccccaaatccacacccctcaccccagcaactccaaggggtagcctggagataggaagggcacccaggagggagagaagggggtt

SEQ ID NO: 141556 - DNA, 532 bp, Homo sapiens
tgtgtgtgtgtgtgtgtgtgtgtgtgtgaaatgaagactccttcttttgtatttttaggagagacggggtttccccatgttggtcaggctggtctcgaactcctgacctcatgatcctccctccttggcctcccaaagtgctgggattacaggcgtgatccttcaatgatacaagagactgcccatggtagtaaaggatatcgcatatttaaggcacagactcgagaccagtgtgtcttttgctaaaagagaagcccaaggcacagcttgccatgaaaaaaaaatgtgataatacacataaagaaacaaactaaaataatcttgtaagaatgtcatctgaaaacattaaagtgagtaagatgcattatttccttatatctatgtgacattctttgagttattcccaaaaagtctccaggaagaaattctgagtgtggtggcacttctcatgagagttccataggctgaggattttcagaacttgggagctgctgtacacccctctaggacctgcctcacatgacaacccata

SEQ ID NO: 141557 - DNA, 197 bp, Homo sapiens
accgcaggatatcatctcatgccttcccactgccaggtctttccataggaaatgttgcctcttcttattttgaagttgattgtttgaaactcaagtcaaggatttggggctttttacctttgtctcaaaacttatgaccccagttgacctcaatttacatttgtactcaattttggaaaaatacctcttctacctgg

SEQ ID NO: 141558 - DNA, 381 bp, Homo sapiens
ttaatatctcctacaataaaccttttttactaaacaaaaagatgtattcaactgccattctgaacatagtcaatcttgcacctcagcagaaccaattctcaggtaatacacacagcggtccatgctcgggggttaacaacaaaaatgcattgttacgaaggtcaggccatgcgccactgtcactgcaaagagggtcgtggaaaccctgaactcccctccttcagataatcctgcactgctcagacagctacgctccattggttgttaaaaacttcactatgagttatgtgctcttggaagcaagacccaaaagagcaaagaccccaaaagagcaaagaccccaaaagagcaaagaccccaaaagagcaaagaccccaaaag

SEQ ID NO: 141559 - DNA, 433 bp, Homo sapiens
tgacgtcgggagttcgagaccagcctgaccaacatggagaaaccccgtctctactaaaaatacaaaattagctgggtgtggtggtgcatgcctgtggtcccagctactcaggaggctgaggcaggagggtcgcttgaacccgggaggcagaggttgcagtgagccaagatcgcgccattgcactccagcctgggcaacaagagcaaaactccatctaaaaaagaaaagaaaagaaaagaaagacagacagacagaaagaaagaaagagaaagaaaggaaagaaagctgggtgaaagaaagaaagaaagaaaaagaaagaaagaaagaaagaaagaaagaaagaaagaaagaaagaaagaaagaaaggaaagaaagctgggtgtagtggctcacgcctgtaatatcagcattttgggaggctggggtgggagga

SEQ ID NO: 141560 - DNA, 566 bp, Homo sapiens
tagaactgaccctgggaaggtgcatgctcctccatttttattctcactgccaccctgaccattagctcgaggactattcctacatgctcgtaacctcagcaactgcttctacagtgacacaatccagctgaaggacatgcagagagagaatgtgacttcctcaagtggtgaatctcacctgagtttccttgccagtggaaactctgtcatctgtaatgaagtatctcgggtctgtagctaggagaaggaggggcatcctcttcaggggacacgttcctatgaatactcacactggctccatcctccagcctgcaaagcctggctgcctgatgccgtgagccaacacaccacagcataaatgcaacaggaagaaacaatcaaagtgtactgtgagtcttctcagcccccagcaacctaagataagtatcacaaacaagaacacgaggtcatttgagaggattctgctaatcaagaccgaattagatactcaggtatacataatgcggaaatcaggaatactcactttccataaataagaacctgtcaccacttggccctgattagca

SEQ ID NO: 141561 - DNA, 117 bp, Homo sapiens
caaacaagaattgtttggaaccagatgctaaaatcgagagtggtctgtttatttcagttcagagtgttataaaaatgttaataaggtatttttatgtctattacccagctatatttg

SEQ ID NO: 141562 - DNA, 336 bp, Homo sapiens
gagtttttatgatctttgcaattagatcccttttaaaataattatcagtggatagacttactctgaattgaaggtcatatagactacacttaagaacacacacatacagtcttttcatgtgaagtgtggccagaaagcaataagccaggagcagagataatttgatcctctttgtaatttaatgattgactaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtt

SEQ ID NO: 141563 - DNA, 510 bp, Homo sapiens
ctgactggcccaggcactgtctctacctggggtgtcatagagactgctcctctgctcctcagcctaagggttggagcgctcctagcaatgtaaataacaagcgcgttatccccgtcttagcgatgattatttttgcctctcaccttgccactcagtgctcaccttgttaccagccagcaagctttctaccctctagaatttaaaaatcaaatggaggcgaaaacataaagtaaccactcaaagttcatagtccttttattttgaaacgtattttctcaatgtttgcaatacaccaaatctttaaccaatttgatcacacagagatcctagcgcctattcctttttaaaaggaatttctgtggttcacttggttttcatatgtgctctgcatttctctaccccagtgccaattaattctcatcctggggattttttcctaatagttagcaattaattacctgcaaaaattctatccctgacatgggtagatgtataagacccgctatttaa

SEQ ID NO: 141564 - DNA, 121 bp, Homo sapiens
atgtctccattgattcccaccagcacagacccacctgcctacatctgggcctacagacccactgtccctcatgctgcctgagatggaccctgagctcctagccaaggccaacccctccacc

SEQ ID NO: 141565 - DNA, 587 bp, Homo sapiens
tttatttccactcttttaaaaaagcgtattcgcatgcaaggctttattatttttgatgattatggcagtcagtatccggaattctatcagcaaatgtctgaatggttgaaagacggaaaaatcaaatataaagagcatatggtgcaaggtttagataacacgatcaatgctttcaatggtatgttgaaaggcgaaaactttggcaaagtggttgtaaaaatttaaaaaaataggaattatcatgatcacactacatcatttagatcaatcacgttcttttcgcattttgtggttacttgaagaaatcaagcagccctatgagctgaaacgctattatcgtgactcaagcacgcatttggcccctgactctttaaaaaccattcaccctttagggaaatctccagtattggaatgggatggcaaagttattgcagagtcaggcgcaatcgttgagttattaattcagaaacttgcgccgcatttagcaccagatatggatgaatctacctatgtcgattatttacagtggattcatttctcagaaagctctgccatgctgccatttttgttaaaaacgtttaatacga

SEQ ID NO: 141566 - DNA, 508 bp, Homo sapiens
atcaataaagagacagaaaaccttaaaaggaaattctggagctgaaaagtacaataattaaaatgaaaacttagattcaaaggcagatttgaacaagcaaaagaatcagcaaagataggacaatggagattattaagtctaaggaacagaatgacaaaaattgaagaaaagtgaacatagcttgctataggttaaatgttatccctgccaggtgtggtgcctcacacctgtaatcccagcactttgggaggccaaggcgggtggatcacttgaggtcaggagtttgagaccagcctgcccaacatgaaaccctgtctctactgaaaatacaaaacttaactgggcatggtggtgggcccctgtaatcccagctacttgggagggctcaggtaggagaatttattgaacccgggaggtggaggttgcagtgagacaaggtcacaccattgactcccttgcactctagccttggtgacgagcgaaactctgtcgcaaaaaaaaaaaaaag

SEQ ID NO: 141567 - DNA, 323 bp, Homo sapiens
atgctatggcgaaggcagcaccaacactagccagtgaccctgtggtcactcatctaaaacagaaaagggagtgaacaagcactggctctgaggatcagaaggggaccaggcaggaaggcaccgaggaagagccagcttcccaacatctgcttccccaagacctttccagcaactcccctgtagccagcagcccccatactgtctgtccgttagggggaaaaaatgaaaccagatgtcgggtgaggcaggcctgagtgaggatgccggggcagctggtcctggcttgctcaggcgtgccctccccaggggcagtgacaggccct

SEQ ID NO: 141568 - DNA, 303 bp, Homo sapiens
gccccatctccagaactccctcttgatgtaaattttagactggaaaagccaagaaacaggaatgtttgctatttacctggctgaaacctgattttacaaaaattaagagctctataggaaaaagttcacttcactaaaactgatatttaagttatatatgtatacatacattgatttgaggtgttttctctgacctcaaatcaatgtatgtataacttaaatatcagttttaaatatcagttgcttcacagtcaactgaattcctctcttctcaaaccccagctaccagatgtgctcccagtg

SEQ ID NO: 141569 - DNA, 224 bp, Homo sapiens
tatatgtttatggggtgcaatgtgatattatgatatatgtatacaacgtggaatgattaagtcaatttaataaacatacccgtcatctcatatactcatcatttttgtggtgagaatatttgaaatttgctctcttagcaattttgagaaatttattattattaactgtagtcaccatgcatgcaatagatctcaaaacttattccttctaacggaaacttgta

SEQ ID NO: 141570 - DNA, 1047 bp, Homo sapiens
aacttcctacttaacatctgttggcttcccattctattaccttatctacctgtgctaagtgggttagtcctgataatttctgggctgctttgaatggtggctgcttttgaaatatgctttttgaaatatgcgaaaaagcaaacaattaggtcatcattacctctttcattgactgtagagttattccggttctctctatttccactcctttctttgtttttcttttcccactgttcctattttttccttctccttttgtcaaacatacatgaattgtttaatgtagcttagtttagcaaacgtttattgtgcatctactctgtgccaggtattatttcagacactgtgggtagtgatacatagatgaattacatggtctctatttccagaagtttatagctcagttatgttgtatattaggatttgtttgtttataaatgacagaaatctaacttaaattaatcttagggaaaaatagtttattgaatggataatggaataactcatattgctgggaaggggaaggatatacctgggactcggggacaattggaacctggaacaacttgtagttctatcttttgcttttgtttcttattccttattagttccattttttcatattgtcttactccatttgttgggtttcatagttacaggtagcttgcatgtctcacatcacatattgtgcctcagagaaggaaagaactctgaaaggctggacttcacccagtgcctgtcccagggctaacatttattggggttggttgggtgaggacagattacatagcgcagatgtgacagtgaggctgtcttctgtgtttaagagtcctttccagagaagagaggttctgaatgactggcatgcctaaatatatataatgacagctagattttggaagtgcttcaataaaggtacaatgtatttattaggactaagaggtgataaagttggctgtgtgtggaaggggtacacttcacagaagaggtgggattttcaccagaactttcaacaggtaggaggcacttttcagggaaaagtgttcg

SEQ ID NO: 141571 - DNA, 128 bp, Homo sapiens
gttcgtatatttcagccagtttcatgcactttgccctctcagtttgcttcactttctggctcagtgaacctgacctgcaagtctccctgcagtttccctcagcaagtgctcactgggcagccccaaca

SEQ ID NO: 141572 - DNA, 470 bp, Homo sapiens
ttgggaacatatcaaatatgtggaacagaagcttaagtgctgcccataccacacagccttgtactcactgctcctacacatataaatgagtgaagaatggttgaatagaaaatctgcagcaaggcaacaatagtccagtttttaaccccagcttctctgtagctaacatgaataattcatggtaagctggatccttacagtaatttatcgatgagtagtataatcatttatttcaagctgaacacatttctctggctctgcttcatccaccacaagatacttccaggcagctctgggagaattggaagcatgtttttcttccagtatttgcctggtctcatagagcagcaaatagtaatataaagagctcaatctgtatgcacaaaagcagttgatgtagactacttttaggttcaagttttgagcaaacaatatacagaaaaccctttgcaattaatactaagactagg

SEQ ID NO: 141573 - DNA, 528 bp, Homo sapiens
gaccaatctctaatttcgtgtttgtaatgttacattacttaagagtcttcttaaagaaagactcctgccagagtatatcagcttcaagcttcccaaaatcaggatccacctgatcttgggcagagacagaatggcctcccctcgccactcagacttgctcagcaccctcctgtttcttacttgccagagagggtgaggtatccttcctcacctagctttcgagcacccagccttgaagcaccccacatctcctataatctccataacctctccaactgcagttattttatggggaaaagccctcatccctccccatcctctgacctggccgtttcctgtttgtccttgaagacttagctccaacatcttcaggaagttctccctgatcagctgcagggtgagtcatgggctttttctctgtgttccttggctttctgtaattcctgtacattagcacttctcagagtaaattataatcaatgagtcattcccagggctctagagctgcatcttttctattttagaccc

SEQ ID NO: 141574 - DNA, 347 bp, Homo sapiens
tgacagatgatactgagcatctttatttttctttttcagtattgttgtggctattcagtgcctattgcagtttcatatgaatttaaggatcagttttccgtttctgctaaaagaggccattggaattttgatagagagttcattgaatctgtagataactttgggagtattgctatcttaaaaatattgttttcccattcatgaatatgggatgtctttctgtatatttaggtctactttaatttctttcaacagtgttttgtagtttttagagtgcaagctgcatttttttgttgttgttaaatatgttcctaagtactttattttttttggtggtattgtaaatg

SEQ ID NO: 141575 - DNA, 659 bp, Homo sapiens
gagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagat

SEQ ID NO: 141576 - DNA, 209 bp, Homo sapiens
cattgggggaagctgctgatgatttgggaggatcaaaatgtaaatgcaatcttgtgatacaaatagaaagatgttttagaaggatcattcaggccggtgcggggtctggattaaagctaggttatactggtagttgggagaaaaagacaggtggctaaaacatcttccagctgtgaggaagggagggcctgagctggtgcagccatgtg

SEQ ID NO: 141577 - DNA, 249 bp, Homo sapiens
tttttcatttacaaaacttaactaaaattaaaaagaaacatgtaaatttctgaccttgtttaatactgtgccataagtaaaaggattaaacaaaaataataatagctccttcttggtataactgttgctagagttttgcattcaaccttttaaaagtgattaaagctaacagtggcagacatcagagaaaaaggcaactatttcccatgtggaaagctggtccctaaaaaaatgaagttaaacagaaat

SEQ ID NO: 141578 - DNA, 698 bp, Homo sapiens
tattttcagtagagacggggtttcaccatgttggccaggctggtctcaaactcctgacctcaggtaatccacccacctaggccttgcgaagtgttgggattacaggcatgagccactgcgcccggccacgtggttcaatcttaaagtagccaatgatgtggacaagcttgtccaatccaccttattttgtagttgttgttgttttgttttgttttgttttaggcttttaacagcctgaagccatgggttttagtttctgtctctagtggttaagtggaaaagagggatgaggaagaggctttactggcccaaccagaaacagaaactaagaacccatgactgtattctctcccttggataccctttcagaactttatttataccctctcattgttccatatagaattcaagacaactggtttgagaactgtgttttaaggaccaaatatcctctaaatattaaaatgtttatctttcattacgaaataatttcatttttgtaaaaaaaaaaaactacaaaataatacaaagaattcccatgtacccattacccatatttccctattttaatgtcttcaataaccatactgcaattatcaaaatcaggaaattaacagagggagttactactactagataataatgctattatctaatttatatagaccttattcaaattttcccaattgtcctttttt

SEQ ID NO: 141579 - DNA, 119 bp, Homo sapiens
ggtctcaaaggtctcctagctctggcagagtggaaattctctttgcttgcttaaaaaatttttttaatccagagtcaaacatcacccagctccactcctgccagctctcttagcaactg

SEQ ID NO: 141580 - DNA, 381 bp, Homo sapiens
gtacctttttttggcctgcgtctgtccatggtgacaagacccgagagaggggtttgcagtctctaagcgcaatacagtggacgaggataatcctattagccatgttcttgaaacacaattatagcagagagcagatgcaaataaggacagaagagcaacacatcataacctaatgagaagctgattaccaagaaaagaacaaaacgcagcaagactcagccatgaacgcagccccgagtccaagggaccattctgtgcctgtgaaggtgctctttgttcgcagcaaaactgagatccaacagtcctctcagaagacccagataaacgggcgccacttaccacaaacacccacgcaggagagagagtacggtctcatgtccg

SEQ ID NO: 141581 - DNA, 357 bp, Homo sapiens
caggctgcccatgtgacaagaccccgcacaggttttcagctctaaaaagcaaaacagtacaaaaacaacaaaacgccatgttcttgaaacacaattatagcagagagcagatgcaaataaggacagaagagcaacacatcataacctaatgagaagctgattaccaagaaaagaacaaaacgcagcaagactcagccatgaacgcagccccgagtccaagggaccattctgtgcctgtgaaggtgctctttgttcgcagcaaaactgagatccaacagtcctctcagaagacccagataaacgggcgccacttaccacaaacacccacgcaggagagagagtacggtctcatgtccg

SEQ ID NO: 141582 - DNA, 323 bp, Homo sapiens
acacacgcactcagaacacccacagctttaaaacggcaatcttactacaaaaatgacactttgcatttgcacagcactttgttttttgtgtactttacacatttattacctaatgactgtgttttttgaaatctccaataactctgggtggtggtaagaataggcatccttaagccaccttcccagatgaggaaacttatctgtgttcccctccttcttctcaacagccggctgatggaacccaagccctccacaccagcagtggggccagctgcacagagcggccagaagggagaggccccggggccacgcccttctctcta

SEQ ID NO: 141583 - DNA, 346 bp, Homo sapiens
tctttcctgaattaatgcttaggatatagtctgtgcattatgagccattaatgcaagagaactgatgttccacagatgtccactctgtcctctccgagttccccaactcagactctaatccacggaggctggttcaggggtgtccaaatggatatactgattgcctctgacccagctgtaacccaagacctctcattaatcctgcatctctctcatgaggtgagtgatgtctacgtaattaaaacttaaagcaagaaatggccaggagattgaagggtgaggaagctgaggattcagatggctccaacacaacattcaccctttagcaaccaacattgccattcaa

SEQ ID NO: 141584 - DNA, 343 bp, Homo sapiens
tgctggaattacaggcatgagcacccagctgaattgaatttttgtaggcaaataagcgttttaagtatgagaatgatttagtaggaaggaaacaagaacaagttgggaaacccaggttaaagtcctcggtttgcacttaacaagctatttgtccttgggtatgttgctaacaaagagcttttgtcttcagtgtttatttctttaacataaaggatttgaactggaagacttctaagttcaacaaatatatagcctgaattttttgaacaatattgatttcagatttcttgtgactttaatgtctgtaaataaaaaaaaagtctcagattccaatatttgagac

SEQ ID NO: 141585 - DNA, 409 bp, Homo sapiens
aaaatgttcacacctccatagctggaggccccaaagactgataaatatgtagtgtataagctcagttacatgatgttgttaacattaacagttccaagattaaattcaacaggtggtcctaatccccagcacctgaatttcacaaattacagcctgtctgcaatgatggtcttgtctcatatggctgcagactgaattactgttgagattaaatcactgtgtgcttttgttgaaatatatgctgcaagtcaagtcagtgatgagcggcatgtgttgaggcttaaaatatcacttttcatggtcatattctctacttcctctttcacaaactatgtgagctgcaattgtaatttcagtatcactaaatgaaggctacatggagtttcttgtcataatgaaggcattttct

SEQ ID NO: 141586 - DNA, 150 bp, Homo sapiens
caaagtgaaaatgtttggcatgtgtaggaggtggaggagaagcgaacttcagggagatacttggaaaatcccagtcctggaggcagacctcttgggttagatcccacctgtgccaacttcctcctggtactgggtccaacaagcgcctgg

SEQ ID NO: 141587 - DNA, 678 bp, Homo sapiens
cgaggtggctcatgcctgtaatcccaacactttgggaggccaagaagggtggatcacgaggtcaggagttcaagaccagcctagccaacatggtgaaacctcatctctactaaaaatacaaaaaaaaatcagccgggcttggtggcaggcgcctgtaatcccagctacttgggaggctgaggtagagaactgcttgaacccgggaggcgaaggttgcagtgagccgacattgtgccactgcactccagcctgggcgacagagcaacactccatctcaaaataaataaataaataaataagtaaataagaatatataaagagctctcacaactcaataataaaaagaacaattaacttttaaaaataggttaaagatttgaacagacacttcacaatggaagagacagcaatggccaataattatatgaaaaagaatccatgaggaaccacaatttgcaaatagaaagctgaatacacagagactaaattttctgggcatcattaatcaaaacagtgatctaattaacctacccttaaagtgaactatgaacctgcctggtacacagtggagcatgtctgcagagtgtctgacactaatgggcacgacccagaaactgctaacagtaagctcaatatccattacatattcttaacaaacctaggtacagctattattat

SEQ ID NO: 141588 - DNA, 327 bp, Homo sapiens
gctcccactcaaaaagacaggacgctgggcagaaaggcaggtgctgcccatccatggctgcatctatctgcacctgccccgggctggatgtgtggcctgaacagttcctcccatgggagggttcggctggcttctcttcttagcaagatggcttctctttaaaaaaaaaaaaaaaaaaattgttggtgaggagctggccaaatccatacgttgcctttgagtagctgggcaagtcctggataggtcctttctctaaggtgaactttctcagtcctgattccctatctgatcacagaggctgctccctactaggaccagtgacccata

SEQ ID NO: 141589 - DNA, 232 bp, Homo sapiens
gaaaagcaggttgtgttagtgatgatcatggggttttgtggtcattgagtaatgtggactgttgaacttcaagaaaatactgattttcttatatccagcgagcttcctagattttgtggggaaccagtgttctcatcattggaagatgtgctctctagtgtgaagcagtgattttcacatttgccctgtgattcggttgtgtttatgttgtggagcagaaagacctagccag

SEQ ID NO: 141590 - DNA, 358 bp, Homo sapiens
gagcatcatgcctcactgcagcgtcaaattcctgaactcaggcaatcctgccacctcagtctcccaagtagttaggactcctgagtagtagttaggtagcacatgctaccaaacctagctaattttcttattcttattttttgtagagacagggtctagctttgttgcctaggctggtcttgaactcctggtgtcaagtgatcctcctgtcttagcctcccaaagcattgggattacaggtatgagccactgaacctggccatattgaggttttagagcgagaaattactacttatttgaagagttgggatactacagtagtcttcccttatccacaggagatatgttccatgacccc

SEQ ID NO: 141591 - DNA, 201 bp, Homo sapiens
aagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaa

SEQ ID NO: 141592 - DNA, 255 bp, Homo sapiens
gtttgggcaagttactcaacttatggtttgggggaactggttactcggcttgttgtctaattagatctcaaacagaatctgagcaagtcacatgtgcaagaaagaagctccgcctccaggccccactgtaaaccttctcgaagtgcttcctcccgctccatctcctttgccacgcccccagttccagtccatcagggcaagactagctttccactggtccttgtcccctaaggcagaaaactttcctgtattctt

SEQ ID NO: 141593 - DNA, 218 bp, Homo sapiens
  misc_feature (169)..(169): n is a, c, g, or t
tcagagttccctgctttaatctttctctagaacttggggatccaagcagcagaaaataaagaactttccatacctattccagtccccacagctgtcctgactcaaaactaaaacccccatctatgcctcatagagaaatggctccagtggaggccagggacatgggccnctgagctgggtgatccctgtggcttggacaccaatgtgttgagaagtta

SEQ ID NO: 141594 - DNA, 104 bp, Homo sapiens
tcagcagcacgccgacccgcccctcttccccgctgcacaggccacctactctgagtgtgcatgcctggctctgggcggagcacctgctccagctctgcaggccg

SEQ ID NO: 141595 - DNA, 227 bp, Homo sapiens
ggtccccatctgagaactgcctactgccgtgctggtacttctatatactgaggaaataaggttttcccatgttctagcaaatacccgatgtttcctcagcaatgccttcacagtatcctgccccacttgcctcttaatcactccatattatacctccccctaattgcctgccacttaatttgctcagcataacattcctttgacaggcgtcaccatgacagttgtgt

SEQ ID NO: 141596 - DNA, 487 bp, Homo sapiens
gtcatgaggcagatgaacactgtttggctccggaagggaaaatgtgataaagacacattgcttttagaatattcctgtctgggatgcataatccaggcattagacgaaccccaactgaggaatgatggacaaaataactggcctgcattcttcaaaaacaccaatgtcatgaaagacaaccagagacagagaccccattccacgtgaaaggctactcaacagatgtgacggccacatgcaggatgtacccctgaactggaccctgggacacagtgaaacaatgccatgaaggatgctgttggcagttaacaaaaggagagtatgagctgcagaggagaggacatactgggtctgtgtgcaatttcctgagtgcccttggccctggactgccacaggagaacccctcaccctagggaaagacgcccagcagcagtaagcagccgtggcacatgctatgccactatgtgaacaggtttcagaagaaaca

SEQ ID NO: 141597 - DNA, 262 bp, Homo sapiens
cttctctattacacttactcccttgttgatcccattcttatggttttaaatgccatctataatctaacaattcctgcacttcatatattcagttcagaaaactcataaatccagtccaaactcatatcgaattacctatttactatattctcttgagtgtctaacatgcttctcaaaattaacgtgtctaaaactgaacatagccatcttccaatacctacttcttcagcagtgttccctatttcagttaatttctattctt

SEQ ID NO: 141598 - DNA, 118 bp, Homo sapiens
gttgaacttaaaccagatgttggtatgaaggcattgacattttatgtggagcatttgctcgccagaaatatttatattttccttttctattttggaactgtgtatccagtatggacat

SEQ ID NO: 141599 - DNA, 137 bp, Homo sapiens
caaagcagagaacagtaatttctttccttatttatttaacagcatagtggtctcatccaaaaatctcttgaggttcttttaccaggacctgtctctatctaacacccccccaccccacctttaccccaataattgca

SEQ ID NO: 141600 - DNA, 200 bp, Homo sapiens
gcctttcctcatatccaggtatctgctcgccactctcggtgcccactcccccagcaacctgtgtctctcttctcaggaccttccccctggcacctgccctctgccctggcagccccacacctctgtctcccccttttctctctcccaccttgggctttcttccacgtgcacctgtgttcgcacaccctctgtaataatcc

SEQ ID NO: 141601 - DNA, 666 bp, Homo sapiens
ggagagtacgtcggcggtgctctcgggctttgtgctcggccgcactcgctttccagcacctcaacacggactcggacacggaaggttttcttcttggggaagtaaaaggtgaagccaagaacagcattactgattcccaaatggatgatgttgaagttgtttatacaattgatggagtctcattctgtcgcccagactggagtgaagtggcatgatctcggctcactgcaacctctgcctctcgaggtcaagcgattctcctgcctcggcctccggagtagctgggattacaggcacacgcaaccatgcccggctaattttttttgtatttttagtagagatggggtttcaccatgttggccaggctggtctcgaactcctgacctcaagtgatcctctcacctcggcctcccaaagtgctgggattgcaggcgtgagccaccatgcccggccaaatgtgtatactttttatttacacaaatgggatcttactatatgtgcctaatatctcccaagatatcacaagtacagaatagtatctgtgtgtataattcatcactctttgttttttttttttttgagatgaggtcttgctctttcagccaggctggagtgtagtggcacaaacactggtcactgcagccttgacctcctgggcttaagcaa

SEQ ID NO: 141602 - DNA, 843 bp, Homo sapiens
cctgacgtccagccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagaatttacgatgtaggcatgcagttaaaaagtcaacaaaatgaatttcagaaagtaaagaaacaactgagtcatttgcaagatgagctaaaaattaaatatagacaatcatacatcttcagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgtaagatggagaatattaaacaacttataacagtgctctgtagatgtgttacaaaatggcaagaattaggaagaaatgacaagaattataaagaccctggtgtgttctctgtgattcttttggcagtgatttactggtgtgggtaatagtttactgctgcttttcttgcccactttactggcctagattatatattgaagaacctgtaaatatttttaaatacatggaggatttctttctctcaataagaaacttacttatccatatattaaagctttccctg

SEQ ID NO: 141603 - DNA, 775 bp, Homo sapiens
ttctttgtatttacttaatcttattttattcaatagcaaaccagtctctttgcctgctacagagccatcgatgttttctttggttcttggaagaactgtacttcgaccttatataatcctcagaaaggcaagatctggactacgaatgagtcacctgctaattacaccaatggctgctcctgccttgaccagtcacagagtatcaccctatctcggtatgctgctctgcttgtcgcgtagtaggtctataaatacttgttttatgaatgaatgtatgaacaaagggaagttagtcacgtgtaagggtgggtagcctgcgataaataaagtgtagactaggaggtctcaaaatactttttgaactaagcccttaatcttcactactttggactagaatggaaatgtcaccaacgccttcccaattaatttgtcctggctgtaatgactgaaaccagaacttccctttacacccatgacctctacaggcatctctttttcctctgctcaagaacagtaactgctcactgctgtgtctaccacataggccccagagcaaggggtgataggtagggctataggctcccgactcccgactcccggcagtgcctctctccaaccccccacgaggctgggacagctccctccatctcagcagtcgctaccaagcacccgacccactctcgcccacctcatccctcgatccccttccctccctctcacagcattccgcgtaagactagcccagccttccgagccccaccaccagttttcccac

SEQ ID NO: 141604 - DNA, 558 bp, Homo sapiens
cctgacgtccagccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagcaaaatatacttcagactcatgcttagactggaagtagaacattgccagctgaaagaacgaatgccagatctacaacattctgtcactgagccatacataggtctgtgatttgttttccttagcttttcttaataactttgtttttgcaaaataaatatttttttgaaatg

SEQ ID NO: 141605 - DNA, 1689 bp, Homo sapiens
cctgacgtccagccgactggcggcgcggtcgcccgggagaccgggaaagccgtttcacacccgtcctagtcgaagtcgaggtgagggacgatggctttcctcagcctgggatgacccggtcctccaaatgcagttccggagtggaggcgtgctcgcacccggggagagagccagaaagctgagccgcggcgccccagcgagagcacgaggccccgggtctggactccgccaccacgctcctctgcggccccttcctggtgtctgccagcccgcggggcccaggcgcggtccgccttcctcccagccccggggaacgcgcggctctgcttcctcacccccgcaccctcctcctcctcctcttccggccactgcaggtccagggggaacggggttagaaagggacagatttgaaagccattccagcagttttgtctggccttgcggttggtttctgtgtggaagagcctgccgcttcaggaaagtcttaggatgtgaacttccgccttcacctgcccctgacctgctcgttgtgggtgattcacgccatgggaatggttctttacgtaagggcttgaaagctgaacgtgagttaatggcctgacgtgacactagtgtgagaaacggaattggaaacgaacaaggacgtgtctgcattttaaaaaatgtcttttcggtgatcttgttagagaggaggttcacaaacacccacgtagctgcagccacttatcactgcacctcttgccaaagtgcggtccacatacgtgcaatgagaaaggattaaagggacttgtttgataacacacgcaaaactatatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactaggtaaagaaaagtcttttgctgtttttggtgactagttatataagtacatgaataaatgtttacatttttacttataattacaacaaa

SEQ ID NO: 141606 - DNA, 1390 bp, Homo sapiens
cctgacgtccagccgactggcggcgcggtcgcccgggagaccgggaaagccgtttcacacccgtcctagtcgaagtcgaggtgagggacgatggctttcctcagcctgggatgacccggtcctccaaatgcagttccggagtggaggcgtgctcgcacccggggagagagccagaaagctgagccgcggcgccccagcgagagcacgaggccccgggtctggactccgccaccacgctcctctgcggccccttcctggtgtctgccagcccgcggggcccaggcgcggtccgccttcctcccagccccggggaacgcgcggctctgcttcctcacccccgcaccctcctcctcctcctcttccggccactgcaggtccagggggaacggggttagaaagggacagatttgaaagccattccagcagttttgtctggccttgcggttggtttctgtgtggaagagcctgccgcttcaggaaagtcttaggatgtgaacttccgccttcacctgcccctgacctgctcgttgtgggtgattcacgccatgggaatggttctttacgtaagggcttgaaagctgaacatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctgtgtatgatatgaggtaagaatctaaattcatcctgtttcacgtggatattcaattgttccagtgctgtttgttagaggccaatttttccttattgaattgcctcagcatctttgcctaaaataaattcaccataaatgtaaaggattatttttggattttctattctattccattaatctatatgtcttatgtcagtgccacactctcttaagtactacagtttttaataaattttaaaatcaagaaa

SEQ ID NO: 141607 - DNA, 886 bp, Homo sapiens
cctgacgtccagccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctgtgtatgatatgaggtaagaatctaaattcatcctgtttcacgtggatattcaattgttccagtgctgtttgttagaggccaatttttccttattgaattgcctcagcatctttgcctaaaataaattcaccataaatgtaaaggattatttttggattttctattctattccattaatctatatgtcttatgtcagtgccacactctcttaagtactacagtttttaataaattttaaaatcaagaaa

SEQ ID NO: 141608 - DNA, 621 bp, Homo sapiens
cctgacgtccagccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaaggttgagtatgtttttcttttctatcatttatttagttgaaagacagctacaggaaataaatacactttgaatgtttttctaaaatttctctacatcaggtatagtttatactttaatgcatttgtttcttaattatattaataattactaaatataattattatagtttgctttcttttgaggcatatatttactatctgaaaaattagaaaccaattaatttagtaaccacca

SEQ ID NO: 141609 - DNA, 1619 bp, Homo sapiens
cctgacgtccagccgactggcggcgcggtcgcccgggagaccgggaaagccgtttcacacccgtcctagtcgaagtcgaggtgagggacgatggctttcctcagcctgggatgacccggtcctccaaatgcagttccggagtggaggcgtgctcgcacccggggagagagccagaaagctgagccgcggcgccccagcgagagcacgaggccccgggtctggactccgccaccacgctcctctgcggccccttcctggtgtctgccagcccgcggggcccaggcgcggtccgccttcctcccagccccggggaacgcgcggctctgcttcctcacccccgcaccctcctcctcctcctcttccggccactgcaggtccagggggaacggggttagaaagggacagatttgaaagccattccagcagttttgtctggccttgcggttggtttctgtgtggaagagcctgccgcttcaggaaagtcttaggatgtgaacttccgccttcacctgcccctgacctgctcgttgtgggtgattcacgccatgggaatggttctttacgtaagggcttgaaagctgaacgtgagttaatggcctgacgtgacactagtgtgagaaacggaattggaaacgaacaaggacgtgtctgcattttaaaaaatgtcttttcggtgatcttgttagagaggaggttcacaaacacccacgtagctgcagccacttatcactgcacctcttgccaaagtgcggtccacatacgtgcaatgagaaaggattaaagggacttgtttgataacacacgcaaaactatatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctgtgtatgatatgaggtaagaatctaaattcatcctgtttcacgtggatattcaattgttccagtgctgtttgttagaggccaatttttccttattgaattgcctcagcatctttgcctaaaataaattcaccataaatgtaaaggattatttttggattttctattctattccattaatctatatgtcttatgtcagtgccacactctcttaagtactacagtttttaataaattttaaaatcaagaaa

SEQ ID NO: 141610 - DNA, 1021 bp, Homo sapiens
ttctttgtatttacttaatcttattttattcaatagcaaaccagtctctttgcctgctacagagccatcgatgttttctttggttcttggaagaactgtacttcgaccttatataatcctcagaaaggcaagatctggactacgaatgagtcacctgctaattacaccaatggctgctcctgccttgaccagtcacagagtatcaccctatctcgatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctgtgtatgatatgaggtaagaatctaaattcatcctgtttcacgtggatattcaattgttccagtgctgtttgttagaggccaatttttccttattgaattgcctcagcatctttgcctaaaataaattcaccataaatgtaaaggattatttttggattttctattctattccattaatctatatgtcttatgtcagtgccacactctcttaagtactacagtttttaataaattttaaaatcaagaaa

SEQ ID NO: 141611 - DNA, 303 bp, Homo sapiens
acccaccaccatgcctaatttttgtatttttactagtgatggggtttcaccatgttgaccagggtggtctgaactcctgacctcaagtgagccacccaccgcagcctcccaaagtgctgggattacaggcgtgagctattgtgcccggctcgcctagaagttttatcatttaaaattttatatttacatttattatctgctttgatttaattttcctaaatggtgcaaggtatgcattgagtttatttttttgtggatggatttacaatttttccagcaacagtttttgaaaagactgtcctt

SEQ ID NO: 141612 - DNA, 236 bp, Homo sapiens
caagagcccacctccctgcagtctgctcaagggaaatcttgtacaatttgtgtggacaatgaaatttataattttggcttcaagcttgggtgactttctcctctctgattataggaaaaaatattataattaaattaggattacgcactttttcccctcttcagtgtccttacataggacagacatccttcttgtttggtgaccacagggaccagtgacatcctagttttcttgga

SEQ ID NO: 141613 - DNA, 177 bp, Homo sapiens
gaaagatacccaaatctggcaaagaaatccaaacaccatcttagaaaaataatagatcaatagtctttcagtcaattccaaaccagtttttgtttcaaactcttggaaaatttgaactaaatgtataatttttaacaggataaagaatagctttatttggtaaccaatagcaatctc

SEQ ID NO: 141614 - DNA, 729 bp, Homo sapiens
aagaaccatcatctctgttcagccttgtctctcttctgtggaatcttccccatgttgcataactatcttggagggagacatgttctctcccatttatataaccttgttctcttctagagaaacagctctgtgttaaagacacttgagggaaaatggcattactgatgagatgatatttagttgtcccttcagagccaaagggcagtgattcaaaaacatttagggaaatagaagtaactctttgtaagctaaccaaacagtgacctgaactcttttaccttgtgatttcttatgagtgcttagtttagtcgcctgaagatcaatcttgaaattaacaggctattttggattataacaagattatttagagactcaaacattccagagttcctttagtagatgacttctatcatgacaagcaagctaaaaggtcagtggtcccaaagtggggtgcacatgatctattgaggtacagaaaaagagaataataaaaatatataaatgtatcattattaataaatataatctttaaaaagatgaatttttatgaatgatttatattattcacaataaattaataatgattatgtcattcataaataaaaacatagatatatggtagtacatgcttaaattttatttaaactagtaagaaggtgggatcaaatacagtgaaagtctaatggttaggtaacactttggctgtaataccctcttccctctaatcaa

SEQ ID NO: 141615 - DNA, 488 bp, Homo sapiens
ttgggtgttctggtggcccttcccctcccagactgagctctgtctaggattatcaggcaggtgttcaaataaataatgcagctaaaaatacttccagcagcaactgggacttctgtagctctgagatggtcggagtatgcatttcagctactcgagcaggtgtgcagtggctccagaaacttagaacagacacacccctgacacatcctcaacatggaccaagacctcatttccaatggagaaatgaaacaaagcatttatttcatctagtcttacctggaaacaggtgtgccttggctgaaggcgtcagaggtagagctcaaaaacaagttaatagtcattgtctaggggaagatggtggtttcagagcagtaagtggtattaatattacctgctccctgtccaggacttgttcttcactaagaagtagtacctagcataacttcagtgagaagataatctataataacataataataacaactgtt

SEQ ID NO: 141616 - DNA, 481 bp, Homo sapiens
agtatttgctttatcaggttgaggatgaggataaaaaaatatgaaagactttataagctaaaagagttataatatcactaagcttaaaaagaacactgctgcttggcattgggatatggaacgatattattatagtagttctgtgtgtattgcctgtggggacaaatccacaggagtaactagacaggaaaatgtatctgagaggaagttctccctcagtttaaaggaattaactaaattggatgccattggaaagtgcagacagctcagagatccgtggtgtgttaatctggtactttgttatgtttcagaacttgctcaagcctcctgagcacacttgtgacttccaggcattgttcttgttgtcccttttccaggccacacaggactgcataagggcgagctacagttcatcttacacattctatcgccaatgaaaacctttcatagactgaagccatttgggacagaatctgtgttt

SEQ ID NO: 141617 - DNA, 379 bp, Homo sapiens
agaatactatatattaacaaaagtgaaaaagaaacatatatgagtacaatttagcccactgttttatttagaaggaccagaaaggaatgacagtagaaaaaagagacagtttgactaatctatattatgctaactaggtattaggtgctctgagaaacataataatgaataagacatggattctattatcaagaagcttttacagtttattagaagagactttagtgtaattaacaaaagtaactgaaaatctggtattttaaagtacctctgtatgttttaacatggaaagatctccaaacacatcaatgaaaaaggtaagctggccaggcgcggtggcccacgcctgtagtcccagaactttggtaggccaaggtgg

SEQ ID NO: 141618 - DNA, 151 bp, Homo sapiens
tacagatggcacagtcctgagaagaaccagcacattctaccctgggcagtgtagggaggtacagagtaaagacttcacacctgcattctgtggtagaccctcatggaaaaactgggtggtggccagggaggcctaggcacaggcaggggag

SEQ ID NO: 141619 - DNA, 154 bp, Homo sapiens
aactaccatttcccacttaaattagagagctaagtttcacccatctagtaaacaggggacctaccagattctacaaatgttaactgataatgacatcactctcaaatgctgtttcagcaggacagagtgggcccttcctcttccccctacctca

SEQ ID NO: 141620 - DNA, 737 bp, Homo sapiens
aattcttagccccttgatgaccatgatggcttattctctttcccaattttgcatgcaaaatgtacgaatatatgtatgtttttctgagaggcaagtttagggttctcatgggattttaaaaagagataggtgactccccaccttaaagttatctgctggtcttttagaggtaaccagtgagaaggagttagctattttccaagggtgttttcatttggtaatggaagactttttgctgtggttctcatccaggagtattccttagaattgcctttaggattgttgaatcataaacatgcctgtgtccaccttatgcttaatactgactcagaatctctgggatctgggtctggacatgcatgtatttaagtagcttcccggatgattctgattcatagctcgggttaagaactccaccttaggaagttaggtggaaaaatactggatagtagtttctcagacaaaagtgtcagcctaggaattctgaattcctcatagtcctgaaaggacagttctttgggtttgatgtttgagcagatcataatgttaaatgatataaccccctggaaggcaggctgctgtgttttagagggttattctaggttctagtcccatctttaaccctttacattgctgagtgatgtggaacaaatcactgaattaaataattgtctctagagagcagctggggattttaagcaccctggagagaggtgcagaccctgccaggatgataa

SEQ ID NO: 141621 - DNA, 469 bp, Homo sapiens
tgtagtagagatggagtcttgctctgtcacccaggcttgagtgcagtggcgtgatctcggctcactgcaacctccacctcatgggttcaagcaatgctcctgcctcagcctgccaagtagctgggattacaggcacgtaccaccatgcccaggtaatttttgtatttttggtacagacggagtttcaccatgttggccagaatggtcttgatctcttgaccttgtgatctacccacctcggcctcccgaagagctgggattacaggtgtgagccaccgcgcccggccaggggatttctcctgtgtgaattcgctggttaagtgataattaactgcagttaaaattcaggtcaagcatgtggctcatgtctgtaatcccagtactttgggaggctgaggtgggaggatagcttgagtccaggaggagttcgagatcagcctgggcaccatggtgaacccctgtctctaaa

SEQ ID NO: 141622 - DNA, 101 bp, Homo sapiens
gcccatcccacatttttttatcagtgtccccagcacaggccctgtgttgggcacaaaacaacctaaagagaagaggcagggctgcttccctgaggggctcc

SEQ ID NO: 141623 - DNA, 440 bp, Homo sapiens
accaggctgaggtgcgacgatgtagttgcaggaaaacaaacttaacacgcccactaattctacattatgctcctaccccccggcagcctctccaggcccagaactttctccagtcagcctctacagaccaagctcatgactcacaatggcctatttaggcccataccctatgtcacggcagcctccgcagatgaggctactgcctcacaacagcctccacaggcacagctccatcgttacaatgggctctttagaacccagctcctgcctcccagccttctctccaagccctgaactttctcaagtcgacctcaccagacctgttgagatcttcttcacggtgtggctgtagcagaaaataatggtgacatgatatggctagacagggggggcttggtttaccctggttcacaagtgtcacgtgaggagaatttggaagt

SEQ ID NO: 141624 - DNA, 404 bp, Homo sapiens
cctggcttgctcaggtctcccaaagtgctgggattacaggcgtgagccaccacacctgggcaacttgtgctaatattcttaaccttcatgtgaatcattcctgccctcaggctagcataacccatacagccttccttataggaagatttcctactgggagtgaatttgtccagtgattcccccaagatatcccccaatcaaatattttaaaagtcatcatttacatgtaaaaactatgtaacaagcatggtagcagcagcgttaaagaaatggcagtatggcccctgtaagggaaggctccagaagatgagccgcactcagcctctaggtcacagctaccttaggagtttgcagttgttcctggggaagtcagtagacaaagctatctctcaggcctgggcaag

SEQ ID NO: 141625 - DNA, 516 bp, Homo sapiens
cttaagggtgaggaagaaagagccaaattagtaacaatgaaaatggctaaatctgcatacccacaagttctcttaactcctttcaaatgcctcccagctaagtgaggaagttccagaggtttcccaccggtgttcctttaggtatatttccaagttccactggagcctccctattctcctgctcctgacaatgagcatttgtatcctcaagccatgtagaaaacattctagcaacaaccagtacaagcattagaagtgcagaaaccaggccaggaacagtgactcacgcctgtaatcccagcactttgggaggccgaggtgggtggatagctttgagctcaggggcttgagaccagcctgggcaacatggtgaaaccccatctctacaaaaaacacaaaaattagccaggcattggtggcacatgtctgtagtcccagctactcaggaggctgaggctggagaattgcttgaacctaggaggcagaaggttgcagtgagctgagatcacatcactg

SEQ ID NO: 141626 - DNA, 353 bp, Homo sapiens
ccccaatcccacaagagataccctcactctgtccttggaaactagcacctcactcatccccccaggtacctagtactattcagtatttctttccttccttctctctctcactttcaaagatgaagtgtatgtatgtatttctttcctgttacagagaagttacaagaatagttcgataaataccctatgcccatcacctaagttcactaattgttaacattttgctgtgtttgctttttccctctctgtccctttttctctccaagttgctgatatcataaaccttcatcttaaacactttagtattatatatggtagcaagggcattcccctacattactacagttatgacc

SEQ ID NO: 141627 - DNA, 411 bp, Homo sapiens
gagtgggcaaacagggctagagcaatggaaactgacaagaccactcagtcagtctttattgagagccttctgagtaccaatcagggtggtctcagatccactttggaagtcactgatccacctgactcgaggtgctgagcaggtctctaccaggccaatgttgggggtagatggcaagaactgcctctactgagctgtgacagagaccctggtgggtctagcagtgcagtgaggtcttagaattcaagatgtgctttaggcctctgcaaaggaaaagctggtcctctgctaagccacaggaaagaaacacagtcctggggcggaactggtctttgagagaatagggtcaggtctgtctctgattaatagggtgtcagacaaagcttgcttgggtatcagtatcagcactgg

SEQ ID NO: 141628 - DNA, 558 bp, Homo sapiens
tccctaaactcccactgtttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcctgagcccaggagtttgagaccagccctgggaacataatgagactttgtttctatttctatttaaaaaaataaagaagaacccatcactgtgaactcttgtgagaatccagtgaggagacgtgtgtaagtgcctgccacagtgcctggcacatggttggaaccccagagtgtatatggtcccagtattattgtttctatgctgtgtcccaaaaggctgacttatgtcaactgtgggagcccaccatttcagaaattactgaataacctgtggaatttccccttagttacaaaggttactcttttaaaaactctgtcctcgg

SEQ ID NO: 141629 - DNA, 195 bp, Homo sapiens
gtacaagctcggtacccatgtatgtacataacactctaagaaagatacaaagaatataatataccatttctgttccataagactttatgatctagttggaaacaagatatagatgcaaaaaattttgcatacaaaacaatatgggttaagtggtacatatattatgtaatatgactgatacaaaatataagtgga

SEQ ID NO: 141630 - DNA, 304 bp, Homo sapiens
caagcgggctgcggtggctgagggtcgtgcgcggcctcagtggtgcggtgggacacccgagagaggcgtcccgggggagcaaggcctggggtcctgcagtggaggtcagcccccaattgtgggcgcagctggagagggggcgccctggggttcacgaggccttgaagagcgcacacccttggccacgccctgcctgccgacccctcccggttgtttccctctccggtgaatctggatcacagccctcaccgcccctccactggtttcctgctggcaaaggcagaggggcgctcagcaggagctc

SEQ ID NO: 141631 - DNA, 231 bp, Homo sapiens
gttgattttgtttttaaagttggtgtcagagcagctacaaacttttttcagcatccctgcctggctgccaactggagctctctgttcacttcctcaccaacttgaaccacccccaaactgagagtaagctggagttagacagcggcaggaactgacacactttcaagaagggtttgacaccgcagaaaactttcacttctccaacccttccacccaggggctctggccctt

SEQ ID NO: 141632 - DNA, 503 bp, Homo sapiens
tgagtctggtagaatttatttttcataaggcaggagacaggccaaataatgtcagtgttctgtgagtctttgtgttccttgacctctcccctccccaacacacacacatacctctccttccttttccaaccaccctcagattttccaggacacacaccttcagagccacatctcaactctggtcatccctacagtgtaacagtagaatgagtgtagtagtcctcccagttgtcacattttaaatagggcctttgggaagaaaccaccagtggcactgagtgaaaaggaggctgaggcaagggggactattggcagctcttaggtcccaccagcagccagtggtccctcagccttcctacagcgatacagtggtagaccagttgtctttgctcagcatatgttttcagaggcagctgaatgtttgggttgtatttttcacagtactgatgtcagggacaccaaagggcaggagcatagggaaagggctcttggctgactaatga

SEQ ID NO: 141633 - DNA, 285 bp, Homo sapiens
gtcgaagctgcagtgagtcaagatcatgccactgtactccagcctgggcaacagagcgagaccctgcctgaaaaaaaagaaagaaagaaaaaaaaaaactgtctcctcaaaaaaattagatgtagtcagcccagttccagtcttcagtccaaggtccttccattcctcagtgcaaacatttgggataaatcttagggaagggtgcaatcaacttctctttgcctctggtgccccctggtggactataggggttcaaacatctctatttccttcatttccagcctc

SEQ ID NO: 141634 - DNA, 404 bp, Homo sapiens
tagccgattgtagctagatagtgaacaatttctcaacaatcactgatcataataagcgtttacaggcactcccatatcccaaagcagaactgactattccccctcttttagtcctaatgttaccagtccacagttctctgaagctctaaagtttttttcatttttctctttattgttcagattgaaaaatttctattgacctatctttattcactctttcctctttcatctccattctgttattgagtccatccgcagctttttaagttatagttattgctcttttagttctaaaattttgtttcctctttaccttttacttctttgttgatactttagtgtaacatttgttgcagaaatgttcacagttgcttatgcaagcattttcataatggagggtttaa

SEQ ID NO: 141635 - DNA, 354 bp, Homo sapiens
tgtagaaatgtgattgggcaaaaagcgtttgatctcagtgacagactgaatggagaaacccagcaaggcctgtgcagatgcttcttggcctctctgtgcagcattccctcttccaggatatagggcaggaccccttttaaaatggaagtcttccaacccacaatcaggcaaggtaggtcagagaacattttaatgggaagaggggaagattagagtcctgccttggggagaaaaagaagcgggtgaaaggagggcaggagaaagtcagagagattcagtggcctaaagctctccaacattttaacaaaagactgtaataagggctgtaggagtcataagcgaggaaccgcggat

SEQ ID NO: 141636 - DNA, 436 bp, Homo sapiens
acaggcccaagctatcctgctgaaggtgagaaacgtagaacagagactagttgccccagttatcccaacttaggtcaacctacatcagccaaatcaccccagacatggagcaagtccagccaaaatcagcagagctgcctagtcaacaacaacacagctgactacatgagcaagcctagaccagattagctgaacctcaaactcttgagttcaataaatgcttctagttatacatcactaaggttttgtgattgataagcaccattactgtgacatcaggtaactgaaacactatcttattttggtaggtgaataaagaaaataatttttattcttccgtttatgatgttaaaaggtgacaacaggctgggtgcaatggctcacacgtgtaaccccagcacttgggaggctgaggcgggcagatcacttgaggtca

SEQ ID NO: 141637 - DNA, 478 bp, Homo sapiens
tacctttggacacatgctgtctaatgttgaagtctattttgtgtgcatatatcttgtcttcctgagtagatcatcaatttgaagggaaaattcatatcttttgattctctgaaaacccacaggtgtgtcacaatgctaggaacatagtggttcatcattaaatacttatatcactgaattccttaattcagagcctctaaaaagagtagaaaagttagaaataaaaatagcaaaagctaaaaggaaggtgcagattcaagaaatactctcagttgtacctgtgtgggagcttcttgagaccaggaaagaccacatggggactgaccacaggacatttaaaagagagaaagtcaataggagggaggaaggaatgctcacagtgttctttggaggaatattcagactcatggaaaagagttagtctaacaagcaaaagagtgtaggctataaaggtagagagaacctagaggaaaagaaa

SEQ ID NO: 141638 - DNA, 360 bp, Homo sapiens
cttttatttcaactcatttcccacaaccctgtctactggacacttccaattaaatgttcactctcacctcaaaatgctttgagctatctccattctctcctcataaaactggccactgcaccaaaactttcccttctctcttcttgacttctaattgacttttaatttcatgccaagccatctgggatggaagcctaacgtcagtatcactttcctctcccttatttatatatttacgtaatcactaagcttcgacaactctttattccagattctctacgcacatctcttccttatgcatcttcacagccatgactctagaacagtttcattttgtgaattattataagaccctcccat

SEQ ID NO: 141639 - DNA, 1730 bp, Homo sapiens
agcgggttgagattagcagtgacataaggcagaacatccagtcagcagttcacataaagacctcagagttttggttcaacacaagctcaaggatgggcattatcatgtaatgggggaaaaacaacatttagattcaaacaaacccaatatcaaatgctaatttcaccactacattgctatgacccaagtctttgtctcataaaatgggcatactcactcataaaatgggtgagtatgaacaagataacacatgttgagcatgtgtgaacagtgcctagaatgcatgggagatactcagtaatccacaccccacatccctggaacctggcacgatgccccccccccatcaatacatttagtaggagacatcatagcactttccaaataatctattgaaacattcatttttgcctgtcctctttatttaggatgccggaagaaatgggaagacattaaggtttatgtgctaatatttgagtcctttcatggcatttacatggcagagccaaaagcagaagttgacaaccatcagaagccaaaccagccccacaaaatacctagccttcaagagagaaattggaccaatctatgaaaaatgttgctggtgtgtggggatggggaggttggaaagttgctgagacttcgggaaggaatggaggctcatgacagatacttgtgccacattccatgtagaccttcctaaaatgtggcaggcctctaatgggcaccatcagaaagccatggcaactgacgatcaaaagatctgccttgaggccatggtccctgtgcccaagctgggctcagaaatcatggagtctcccgccttcaagggactgtgtcgatttaggcagtgagcacagccacagccgcccgtgtggatgtggactgaagtccagttctcttcatgggtgcttggctgtgagacacctctaagactcttgcacaaccaagcagcaggggaagaaggatattagaattgaatgtgatgattgagatttaatttactggttaaatgggtggggacatgcagcagatgggccgattgtaaaggaataaatataacatttattttcatccaagtactagggagtattttttttgtatgctttgtcagagatcagttggttgtaactatttagcttcatttctgtttatcacaccataattcacaattgcaaagatatggaccaaactaagtgcccatcaattaatgagtagataaagaaaatgtgatacacacacacacacacacacacatatacacatacatacacacaccatagaatactaagccataaaaaaaaaatgtattttgcagcaatttggatggaactggaggccattattctaagtgaaataactcaggaagggaaaaccaaatactgtatgttctcacttgtaagtgggagctaagctatgggtattcaaaggtatacagagtggtataatagacactggagactctgaaagggagagggcgagagaggagtgaggaataaaaaaatagtatactatgtacactattcaggtgacaggtaccctaaaatttcagatttcaccagtatataattcatccatataaccagaaaccacttgtacacctaaagttattgaaatttaaaaattgtaaataaaaatcccacatatattagggagtataattcacactctctatgaagtaaaaagggcttatacagtaggccaaactcaaccctaccactgtgatttaa

SEQ ID NO: 141640 - DNA, 478 bp, Homo sapiens
caggttctgcagggtgcactgcctccttttctttcctctgggctgcattaggaggagggaggtgaatggggagaaggaatcaatcttcctgtgttgacattttccagaccctgagaaacgttgagttgaaagataagtgtgaaagcatctctttcttttgatggtgtgtgagatgaaaagcacttgctaatagcccctcaggtcaaagtaacacatttgacaaaaaggagcctcaagcttttgcttgtcagtgtccatatttgattggaaatttcaatctgagatttggtgcttggattttcctagaatttgccaattacttgttgctctggttccagctgacttttagtcttcctttgggtactaccactgggtgcagtttgttatcagtgagtagctcttctctatcgggctgtgtaaatgtacccctatttaattcattcaacaaattattttttaaatacttattgaatctggg

SEQ ID NO: 141641 - DNA, 370 bp, Homo sapiens
cagatagcagctgtagccagtcaaggatcagatccccttaaggacgaagtgcaatctacagaggtttggggaggagaaaaggacaccacaaaggaagagctagagggtgaaagaggccaagcaggaaatgttgccacagaagccaaagagagagcacagaagagaggggagcggccaacagtataaagtgctgcacagaggtcacgtaagatgaagacctgagcgaccatggattcagcaaacagcaggtcatggtggctttgttagagaagccaggctgcagttggacaaggtatgcatgggatattcttagaagaaatctaactgcagaaaggaggagtgttctggctttataaccatgcacagaata

SEQ ID NO: 141642 - DNA, 162 bp, Homo sapiens
cttcccactgcacatgactgggtgaaccagggcagccctctctgtgtgtgtgtgcttcataccagctgagccactgaagcaggccctggtcagcctccatttccttgccattccctgtggggctcatagcccctccttgtgcttgggcccccacttccccca

SEQ ID NO: 141643 - DNA, 395 bp, Homo sapiens
gaaaatggctttcagaaagttccaactacccgataggagttttgttttcttagacaacagacaagggtccctgccacccacagcacttctctcttaggctatgcagcagcactgaagcgtgctgactccttgactctgagcacccaaagacaagagtcaaaggaagtagataggggccatagagggacagatatgactcatgactacacaggctcactctcaaagtggctagattccaggaaaggttcccaggaagcagagggaagccccagaacctttcactcagaggcaaaaatagggtggctgagtagggatggggatgtgtccagtagctgtggacctgccactctcttgctaaacagcagtcatgtcaaaaacagcttaggtttccaaaa

SEQ ID NO: 141644 - DNA, 223 bp, Homo sapiens
ccgcccgcctcagcctcccaaagtgctgggattacaggtatgagccacagcacccggccagtagtcttgtcttatgggctgtgtcccaagatggggagggctacagtagagtggttctgcaaatgctcaatgccttccccaggcacactggatccttaaaacacagttcacggcagacccactcctgctggtgggctggggctttttgagctcatatgccttg

SEQ ID NO: 141645 - DNA, 487 bp, Homo sapiens
atctcttgaccttgtgatccactcgcctcagcctcccaaagtgctgggattacaggccacgtgtttttgcaatataaattagctcatgatgattgataaataggagaatgatgtcattataatgcaaaagttcatatacagttttccctagcatgttaatgatttggactgccagtaagcctcagtttgtaaatcaatcctatgcatcccacattcttcaaattagacttgatctggacttgcaataaatctgtaaactgtgaaggaaagagataagccagtggttgtagttcagtgtggatagtcctatgctaagggaaggcacagaatactaggaaaattcaggggaggtgatgagaaagacaggatgggtagggtgaccagaaaaggcttccaaaggagattgcattgagttgtgttttgaaaggtgctagctagattaagaagctgggaaaggcattcctggcaaagggaacagagttgataa

SEQ ID NO: 141646 - DNA, 231 bp, Homo sapiens
atttacttggtggtcagtaaatggaatcgattatttaaacaatggattcctttgagtggagatacagtgttacgttttacttatctcatttaatcttaagttttgtacatctttaattttttaagaaacagcctttttgggattttggtacaaaattatttgatttcagaatatttatatgtgggtgtatgctgtgtgattaacttcttaaaagtacaggagatctcagtt

SEQ ID NO: 141647 - DNA, 234 bp, Homo sapiens
catttccctaatgaatatcatttcccttttgagcatctctccttcattcattggccatttccatatcttctttggagaacgctttgtccattttttaattgtgctgtcttttttattgagttataagaattctttatatcatgtagatatggcccttaacagatacttgatttgcacgtatttcttccattgtgtagattgtgttttcactttcttcatggtgacttttaaagc

SEQ ID NO: 141648 - DNA, 255 bp, Homo sapiens
tgactgaagttttactcatctcccaaaatctaactcagacattgcctcctctagaaaggtttcccaaaatgatcagccacccccttcgtccaccacttttgcaatgcttctgttctttatgaatacttttattacctttgccagatgtataacttgtttttctgtctgccacccctactagcctgagtatacggagaatataattgtatatcatttccatattgataaaaaagtgattgaataaacaaaacaata

SEQ ID NO: 141649 - DNA, 491 bp, Homo sapiens
gaacggtctcccgatccaccttgaaatagattccaaccctgctctgaatggcattgctttagcaaagccccagataaaatttgagttcagtgaccctcctagacgtggcccatgatgatgcatatatcccctatccctttctccctgttgggtctttggctacgaaccccaggcacactttagcttaaagtcagattttgtaaagtttaatttacctaagtgaggaggaagacacaacctccttctcacatcatcctcttctcatatttacacttaacacctgaaggtgctgcactgacagcgtgttcagagggagaacgcgctttggcggtggataatcacacgctgtgaagaacgtgagaagaggagagtcatgagctattaggcggtgccacagtgccagctcctgcccaagcaattccctctagacagactgtttagggaggctgttaccagataacaccaattacttctaaaggaggaggggtgtt

SEQ ID NO: 141650 - DNA, 504 bp, Homo sapiens
ggaaggtattcttgatcacagtgtccagtgattgagataatgtgtgacatatttccattaggtcttttctaccagaaagctatgcaactcatcttactgactatattctactaaaattcaaattccataacatagcatactcacagcttgatttttaagggcttataatttcttgagtcagactgagaatagttaagatggtatctatttcataaaacatactttatttgcttaccaagttctttggaaaaagctcacaagattaagaaataaatctgtcatggtgcttcttgtctcccccaagctgcctgagatacaggtggcatagatggacttgggcccataagatcttttaagaatacttttaagagtattcttctatcagtggcttaaactgaggtagagatttctgagaactgcacaggtggagtgggatgccctcccttggatgtggagctacccgccgttgggcacttggaaggaaatggccagtggagacggtgc

SEQ ID NO: 141651 - DNA, 450 bp, Homo sapiens
tgggtgacagcagctcagggttagatggtgcagtctgcagcagctgctgaaacacacactctctctccttatgcgccctatttccagagtgtcactttggtccccacggtcatagatggcttctgccttctaggcgctgagtgcacggtcggggcgagagaagacaaagggaaagagacatgtatcagccaactctgattcaaagcacaatatgtgctatgggaaaacaacagttggccaggcatggtggctcacgcctgtaatcccagtgctttgggaggctaaggcaggaggatcgcttgaggtcaggagttcaaggctgcagtgagctatgatcatgccaccaaactccagcttgagtgacagaatgagaccttgtctaaaaacaaacaaaccaaaaaacgctcattgatttttgcctgattagaagtgtaatatgtgctaatttta

SEQ ID NO: 141652 - DNA, 210 bp, Homo sapiens
ggaaacgccaggcagagagactgacgtgagcaacggctggagtccacctggagatgcccattagcgtcgcactgaagtctggaggtccctgccagaaattcggatggagatggcaggtcggcagtctagaggcagaagggaagtctggctggagatgtaaattccggagtcatcagcccaggatggattttaaaaccactggactggaca

SEQ ID NO: 141653 - DNA, 812 bp, Homo sapiens
aggttctttcccctgcacagcccgtttccctttggggcccagtgaagcatctttctcatgcatacttttttcccagaacgaatgatttggctttaaaaagggcagacatccaggggaatatgcccttatctgctggtgccagaaagtttggagagagaacaagcagttgggttatcaagagccttaggcacagaattaataggaacacacgggcctaggacttggccctcttcagacagagcaatctggcatttggcactgttctcatggcccacacaggtacacccacacatgggcatgcgtgcacacacccacatgcacacgcacacccacacaggactgcactggctccaggcacaggcgttcttcactatgcagactttgttccaatgacagaaacagcctccttgcagaattcctataaagcttataccccgtctcttgcaatgctgggaagcacagaagggaaaaattgactggatgctgtctataaatgtacttttgtcacaaaggtggactgaaccttttcttgaatcccaggggctaaagaaaaagaaagaaagaaaaggaagcctttaaaaggtataggaggctgggcacggtggctcccgcctgtaatcccagcaccttgggaggctgaggcgggtggatgacctgaggtcaggagttcatgaccatcctggccaacatggtgaaaccccatctctactaaaaatacaaaaaattagctgggtgtggtggcaggtgcctgtagtcccagctactagggaggctaaagcaggagaatcgcttggacctgggaggtggaggtt

SEQ ID NO: 141654 - DNA, 540 bp, Homo sapiens
tactgatatataaaagaaacttaaagtctattttagccttttacctctgccatttagttgcagagcaggaaatacaaccagatctcctgatgatcaatttagtagtcttattatttgtactgtggagatacctaacaaacattcagattaagaaattaagtttttatacagttacatagaaattaaacagcctggtcctaaatcgcttttgggcaaagaatgaaattaacacaggtttttttttttttttgagacagggtctttctctgtcacacaggctggagtgcagtggtgtgatctcggctctctgcaacctctgcctcctgggctcaagcaatcctcttgcctcagccttctgagtagctgggactacaggtgtgcactaccacacctggcaaatttttgtattttttgtagagactgggcttagccatgttgcccaggctggtctcgaactcctgggcccaagtgagctgcctgccttggcctcccgaagggctgggattacagggatgagccaccatgcccagcctcaaaaaa

SEQ ID NO: 141655 - DNA, 748 bp, Homo sapiens
cacaagcatggacagattttggatatttttatggttcaatcttggtaattgtttgtgtctaggaatttgttcatttctcctagacttttgtaaattttcagcatacagtggttcatagtagccaccgatgatcctttgcatttctgcagtatcaattataatgtctccttttacatatctgattctatttatctatgttttctctcttctttttagtatagctaaaggtttatcagttttgtttatcttctcaaaaaaacccaactttttgtttcatggatattttgcacttttattttatttcaaattcatttatttctgctctaattcttatcttttctttccttccactaattttctgttcattttgcttttgcttttcttatttttaaagatgcattgttaggttacttatttgaggtttttcttttttgttgtcagcacctacaggtatctttttagtgctgctttcactgaatcagttaggttttggtatcttatgattttattatattttttgcaagaaattttttaaagtttaaaaattttttcattgatccaatagtcgttaaaaaatctattgtttaatttctatgtttttatatggttttcaaaatttctcttgttattgatttatagttttattccagagtagttagataagatgcttaatattatttcactttttttctaaatttttaaaaatttgctttgtaacttaatatatggtatctcctcaagaatgatc

SEQ ID NO: 141656 - DNA, 391 bp, Homo sapiens
gtcagggttcgcatgttagtattagtgtgtctctcacttgtgtgatactgtgacgtacatatggaaggccagaatttctaaacatgagcactcaacacaacagacccaccttttggctctgcaatcctcagagcccaagagaaccttccggggcttctgtgagaatgtgaggaaagtaacaaacagcaagtgtctaggagaagggttcacctggattctgcaaaccaagtttacttgtggagctttcactttcctgttggaaagggagtcagacaatagacctgacctccatagagcactgcaagagggagcccctgtgagtcagataaagcaccggatgctgatatgtgtcccgtgtgacgctggccacacaaaaagttctacgctgcct

SEQ ID NO: 141657 - DNA, 109 bp, Homo sapiens
aagctaagactgtgtgttttaaattggtttaacaaactaatttatttgaccatcttaatctggcctttgagccagattataatgatagtgataatgatagtgaatattt

SEQ ID NO: 141658 - DNA, 263 bp, Homo sapiens
ggccagcctctcctgagcagctaggcccaggggcctgggagtgtgtgcagggaggggccgacatctgtcgttttacccatgctcctgcccataccgcccccacctcagctccctgccctgggcaggaggtggctccaagcagcagtgggagggtttggagctggaggcccaatcgcctagaaactgcacagtggtagctggctggctatgggagcgatctgtggggtaggggtcagccaggtcgtgttgacactgtacatgag

SEQ ID NO: 141659 - DNA, 185 bp, Homo sapiens
ccatctcccacccaaggcagcacccacctttccaggccacgaactccctgccagccacatagtccttgtgcaagcagagaccccgggtgaagttaaagctctgggcggaagtgaagcgggaggtgaatatgtccagcacagcctgggagaagggcccctgtggggtgaggagcctcgttcgcagc

SEQ ID NO: 141660 - DNA, 276 bp, Homo sapiens
gatcaagagccatacccctatcagagccatacccctacccacctgctgaacagtttcatgtttgatgttgttcccacagagtggccttccctgaccaccctatctcaggctccctctggtttcctctgtgagtatatccccttcactgccttcacagcacttcatcacagttcgtaattttatatacgtgtttgtatgtgggaacatttggacacacacacttctaatatccactattgcattctaacctctccaaggacacaaggggatctcttt

SEQ ID NO: 141661 - DNA, 860 bp, Homo sapiens
gcggccgactactactactactgctcgaattcaagcttctaacgatgtacggggacatggccccagggtcagtgcttcccagaaacctagctgactttgatggtcagtagaactcatttgccaccttttaaacaaaaagtttgtagactttgcaggctctccatctgtctcaccaagctaggtgcagttattgtgcagaaagtttgcttaggggcagaggaagccttatctacgtaagtatttagaatttgttaaaaaaaaaaaaaaaggaaaaaggaaagcagtttatagatgaatacttaaatagtttcattttgtacaagtcacctggttttgttcccatgtgttaggaagaaatgagttggacagaattagaagtcttgtcactgaagtaattaaagttattacagagcagcttttttagattagaaaggaagaagctagaaattagtcattggttgctttcattatctattatttgctttcattttatttttcttacaaaactgctatcattacacagatcgtatacaactacaagccttttattttattttattttatttcatttttttttttaaagacagagtttcgcctttgttgcccaggctggcgcgcaatggtgcgatctcggctcaccgcaacctccacctcccgggttcaactgattctcctgccttagcctccctacctggtagctggaattataggtgcccgccaccacgcccagctaattttgtatttgtattagagatggggtttctccatgttggtcaggatggtcttggaactcctgatctcaggtgatccgcctgcctcggcctcccaacgtgctgggattataggcatgagctgctgcg

SEQ ID NO: 141662 - DNA, 521 bp, Homo sapiens
tcaatccttcaaactctatccttcatttttatctaccaatctcccctcctctcaggcttcttgctcagaatgtagatgccaaagaaagctaaagatgggaatatacccatgggctccagagaaacctttctccagttaccaaaattttctttgggaattattgaactcatacggattgtaaagaaacaaactgcccagacacggcagctcacacctgtaatcccagcatttgggaggctgaggcaggtggatcacttgaggtcaggagttggagaccagcctggccaatgtggtgaaaccccgtctctactaaacacaaaacttagctgggcgtggtgatgcacgcctgtaatcccagctactcgggaggctgaggcaggagaatcgcttgagtccaggagttctgggctgtagtgcgctatgccgatcgggtgtccgcactaagttcggcatcaatatggtgacctcccgggagcgggggaccaccaggttgcatgataggcgggggggggtaccgagct

SEQ ID NO: 141663 - DNA, 364 bp, Homo sapiens
ggaaattctaaagcacaattgtaatcgaggtgagaggagatgctcctttcattttgcttttctgttttcttgttttttaaaaaataaaataaaataaccacactgcctccctcaaatctcagcatttcttttttcccagccatttaaactgaagactgagttttaactccttataccctggacagggcttgtcttctgtggtttttcattcctttctgctcctagtaataaaacgttctgtctggctgggcgcagtggctcatgcctgtaatcccagcactttgggagaccgaggcaggtggatcacttgaggccaggagtttgagaccagcctggccaacgtggtgaaaccccaactctacta

SEQ ID NO: 141664 - DNA, 204 bp, Homo sapiens
agctctttttcttttaaaaagaaaaagggaaggggatgtgcgttttatgcaatgagatcgctgcaaaaggtttgtattcgttttgctcagtgctaatccccacattcaacctccacgctgctgtcgctgagtcagcgccgttcctttaagtgacctgattctgtaattccattattaatattatgaaaatggctttcctctaca

SEQ ID NO: 141665 - DNA, 459 bp, Homo sapiens
ctgttactgtcagcctaatgtccaagccacttaccagctctgtaaggcccacctgacctggccccggccccccattgcctgctgctgtctgcctcacccctagctacatcccaataccccaagactgcagagctcttcagcctgaggcctgtgcactaacaaagccatcttccccagatccaggtgctcaatctttgctgaaatgtcacattcccagtgaggccatcaaccactctatctaaaataaccccatacccgtctccttcaggttctgtccctttccttgcgctgttttcttcatgtctggaatcaatttccactccgtccatgtttttgagcctgtactgtgtgccaggcactggtctaggcacaggggaacacctgtcaggtgctgttgagaaaaatcaagcagtacaaagggctgagaagtgatgggccgacctcttagaaagggtggtc

SEQ ID NO: 141666 - DNA, 543 bp, Homo sapiens
  misc_feature (505)..(505): n is a, c, g, or t
  misc_feature (520)..(520): n is a, c, g, or t
agttcgacggagactctcctggaatatatcattataattccaaggagagcacttaagatttttatttcaattagtaatctttctagatgaggtgattattttaggtaagaaatgctgtgtgttttatcaattgggtttattgagtcaaatattgaaaagaagagggtttgggttattcttgtagttaatgttactgttgatttaaacattaatgaacgtaaaaggacaatcaggctggagataaaattatttcttaataactgattttaaatcaacttgaatgagttaaaattcacactcaacaaaatgcacccattaaaaacttttatttctagataattttagacaacaaagttgcaaaaatagtacagagaattttcatgtatcctttattttactttccctagtgttaaaaacttacaataccatggcaggggtgagctcctgcacctggcctgtatccccgtttctaatgctgtagcagaaggatactgtcatccctgtncacgtgctgtgtgtngccgggaatgccctcccagagag

SEQ ID NO: 141667 - DNA, 127 bp, Homo sapiens
atgggatgatctgaaagtgggtttctcagactttcctgtcacctctctccttaacctatgggccctttcctccagccaccaccactgcctcctctatgctgagtctccttatgcaggcctctggggc

SEQ ID NO: 141668 - DNA, 836 bp, Homo sapiens
atatttctgctcataaaaacatcacctaatctctaaagaccccaaacatatttttattaagcattaaaataaatgtgattgttacatacatttaggaaagattcataaaaacaagtaaggtaattatttgcccagttttttgatgaatcagtgagtgacgggggtcatagtgctggtgggttaaatcaagaaataaatgtttacaaagtgaaaattgtaaggagcacctcctactaccaagcagttcaaaaacaagctgtcacaaatatggcaggctccttgagcgctatcatgccacacgtatccattactgtcatgtacctgtatgattatcatctaatttgccaatttttatttttacaaatatttgtatttgtacacttattttccaacttgttaattccagttcagtgtcttgggtggctggagcctgtcctggcagttcacaacacaaggctggtactgaccctgggcaggactccattgcatcacaaggtgcacccacatacacccacacttacagaatctggggcaatttagacccacaaatttacctaacacgcatctctttgggatgtgggaggaaacagaagttctgggagaaaacccatgcagacagcaggagaacgtgcaaacttcacacagacagtggccctggcctgcaatcaattctttttcttatcaactttataaagaaaggatgttgagaaaaacaatgttatttgaggacctgctgtatttcattgaaaagttttatgtaaatgaggtttcagaatagaatcttgttttcacatggatttatctgaagtacaatttttctcttttttattcctaaa

SEQ ID NO: 141669 - DNA, 210 bp, Homo sapiens
ctcagaattcctttcatttctttcccaaatagcattatcttttctatcagtgaattgtacctcccacatttcataccctcttggcccatgggtgaacatgtgacccatgccaagacaataatagtttctcttgggtgtttaaaccttaaacatgtactcaaatgagtagaaaatggtcagacctatgatagtccaatggtagtaaaataa

SEQ ID NO: 141670 - DNA, 224 bp, Homo sapiens
tgtgtttgagctgtctaaattcaggagttggtatggtctgaaataccaaagaaacagaactccgagctcttagcatttatttgacttagtagttacatttatatctataatattcaataaaagcctccaatatgtgcctgggagtgtacatgtacatgtgttaggggaaggagtatatgggaactatatgcaggcacattcagtaagtcctttaagaatacaga

SEQ ID NO: 141671 - DNA, 303 bp, Homo sapiens
ctgaagtctatgaaatcgaggcttgaaaaacagtacaaaaaaattaatgaacccaaaagttggttttttgaaagaataaataagattgacagactgctcgttaggctagtaaaagagaagattcaaataaataccagaaatgacaaaggagacattaccaccaaccccatagaaataggaaaaacattcagagactattacaaatccctctatgcacagaaaacctacaagatatgagtaaattactggaaacacaacctcccaagactgaaccaggaagaaattgaaaccctgaacagacca

SEQ ID NO: 141672 - DNA, 128 bp, Homo sapiens
aaaatgatagaatcttggatttggaagtgtagtttacattagaggtccacaaccccagtccagatgtcagtactggcctgtggcccgttaggaaccaggtgagcggcagctgagctagtgaagcttca

SEQ ID NO: 141673 - DNA, 364 bp, Homo sapiens
caggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatga

SEQ ID NO: 141674 - DNA, 298 bp, Homo sapiens
atttttaaatactatattaattatatataagacaatttaataacatataattttttatcattgctataatcctaatagaattttccaaagtagtttatttcctaggttgtaaagcatgtattatagtctactaacctgaaagcttactcatccctcatgagatagctaaagggccagcccagcaggacagccttcccaacattctgagccttgctggaaactctcatcccatcctattttagcatgctaacatttctctttaccacattatggaataaatttttactttacatcgctg

SEQ ID NO: 141675 - DNA, 343 bp, Homo sapiens
agaaaacaaggtcatctattgaaaaggttgtggagggaacaaacaaagaataaattcatctataatgtgatgtgtaagtgatacatgctaacaatggttagcatttataaatggttgaagggacggaggagtggtgatggagagggagtcgtcagggaagacttgctatttaggaaaattttgagcagatacctagagggaagagcattccaaacagagggaactgcacgttcttgtgctttaaccatcctaaaacacagtcccgactctatcacttccctcgcggggtcaacagcagccacgtttgactgccattctgcgctctccacgaactgtctcccac

SEQ ID NO: 141676 - DNA, 263 bp, Homo sapiens
aaaccactacctattaaactcatgtagcattgctaagagtatctacggaattttcacatcgatgttttcttgcgaaagtggaaatcaaaagcacagagaccctctttaacaatgaaccgctgataagcaaaatataattataataacattccacttacgtgcatttgtgagcattaatttacatcaggctttccaatttaccaacatttatagaatttcttactagtgagagttttacaaaacttttgaagtaattgttaaat

SEQ ID NO: 141677 - DNA, 513 bp, Homo sapiens
gggataggtgaagtgggggcattaaaagtgttaagagccgagtcaggttcagatttgtaaatgccttgttgcagctttcctggagggtgttcagcttcatctcctagagtatagaggagaggaaggattcccacaggtcagcctagcttggggactctcccccaaaatcagaagcctgtgccttctcctactcttgggacaaaactcgtgtttgcgtatagtaaagtcccaatttttcctgagttcaatgtctgactgccttcactttggattttttttatttctttaaatctagatcttcattacaaaatcttgtggggttgattttgtgtggatggcacttttgctgtgctgctgtttaaagcttaggttggttactgttacccaacctggctgccagagtgtggggtttaaatttgtgagctggttggggggcagaaagaaaggaaacatatttgtactctatagggataaacatctctaccttcatggtatgtccacaccaagtccccg

SEQ ID NO: 141678 - DNA, 420 bp, Homo sapiens
ccttcattgtatctaggaagtaactaactggcttttgattttacaggctcataggtggaagggacttgccttgtgtcagatgagactttggactgtggacttttgatttaatgctgaaataagacttcgagggactgttggaaagacatgattgtgttttgaaatgtgaggatataagatttaggaaaggccaggggcagaatgatatggttgggctgtttccccacccaaaatctcatcttgaattgtagttcccgtaatccttatgtattgtgggaaggaccaggtggagataattgaatcatgggggtggttttccccatcctgttcttgtgatagtgagttagttctcacaaaagatgatggtcttataagaggattccccctttgcttggccctcactttctctttcctacctct

SEQ ID NO: 141679 - DNA, 304 bp, Homo sapiens
tttcgagtcccagtgggcatttatgattttggcaattagacaggaaagagctccaggaggaactccaaatacccatcctttatggaggctcttaatttgcttaccgaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagca

SEQ ID NO: 141680 - DNA, 447 bp, Homo sapiens
taactaaccatatacatgaggatttatttctggactctcaatttaattccatttatttatacacctacccttgtgtctgtaccacactgtcttgattactgtagttttgcagtaagttttgaagttgggatgtatgagccctccaactgttctttttaaagattgtttttcagtttctgtgaaaaatgcctttgtaagtttaataaggatagcattgactctgtagatcacttttggtagtatggacatctttaattcttccaatccatgaatgtagatctttctatttatttgtcttcttcactgtctttcttcaatgttttatagttttcagtgtacagatcttttacctccttagttaagtttattcctaagtatttcatttttgtaaatgagattgttttcttcatttctttttggatagttcattgttaatgtatagaagtg

SEQ ID NO: 141681 - DNA, 355 bp, Homo sapiens
gagagggacgctgcaacctccctccatttgtaagaactatataacaaatttcaagaatccctcaggactctctttgaaagggcagcccacgcccccaaccaatgtcaggacgtcaaggggaggtcgtctcacatcggcttgagaggcacagcccgtccgacatgccacatccccaaaggacgcccctccctgcgactgccctcacagatgcactgatgtgacttatggggactgctgcgatgcagtctgttaacactggcaccagctgccacgggcgagtcatctcaggaacctgaccttggcaaagcgtgtttcacactcgagcacagctcatccgggtggcctcgagcagggg

SEQ ID NO: 141682 - DNA, 244 bp, Homo sapiens
ctgccttggcctcccaaagtgctgggattacaggtgtgagccactgctctcggctgaggtttagcttttttacagtcttgtaaagccattctaagaactttgccaagagttttgaacagaagagtgacatagtctgctttcagtttcaagtgatcctcttgcggttttaggaactcagccatgatgtctagaatcctgggtcagactgctagatgctggaacgtgtgggccagttgcccaagcc

SEQ ID NO: 141683 - DNA, 469 bp, Homo sapiens
atgggaaccagggcatgcaggactgtggcagagtgctcctctgccacctgtgcagcctccattctgggtctccatgaagcttagagagtcatgacccttggctccctttgtctgccattaatggatatggctttgacaacaggcaggatgactggctgttcttttatacaactcacagtggtatgtagatgggcatgaatatttattgtctccagatgatgtcactcttgataaagtgaagttggacatcaacattctgtaacctcagcacatgatctcattgctactgccaggaatgggcaccccactctccccagaggccccaggacaggctctttaggagggggtgaggtcaggcaaacatgctgggtctctcctgctccccatctacgaaaagcaagcccacagcaagcctctaaggtgctggactcagggaactgcaacgctaggtacggtgcatctcttcatg

SEQ ID NO: 141684 - DNA, 186 bp, Homo sapiens
ccttcacctcacagttatgatttgctattgtgagaatatttaagatgtattttcatagcagttttcaagtatacacaatacattatgctaagctgtagtcactatgttatacaacagatctctggaattgtagatctgttttattttagacattttaataggtgtgtagaagtatagaaatgcagt

SEQ ID NO: 141685 - DNA, 306 bp, Homo sapiens
agggggttcagacagaaaatgagaagtggctgtgagtcacaggatgttctttctagatgggccttgggaaacattccatcggtgcctgaagccaggaagtggagtgaatctggcatttctttcagaagccctcttgtctcctttctcatcccagccagcccatgccccatgtcctgtgactttagggaagcttctggctactcagagctgctctctttaggatataacaacaacagagcacgagaaactggaattctggtcctattactgccccttgccagctgtgctttcttaggcaagttactt

SEQ ID NO: 141686 - DNA, 572 bp, Homo sapiens
accaaaagccccaggcacctctccaagaccccctacagaagcctaaacagcccttacattcattgcctttggacctacccgaagtcaacaagttccaaactcgtcagaaactgggagaagtctcagccccaaatcaatagcagccgttgtcagctcctcccagctcaaagtcccccagagatcggttccctggtctgagtcaggaacgagagactgaaaagcatggggatctggtgctttttcttcgtagggttagtcgctttccccaccaaaaaacctaccaactgaaagatcactgattggatgggtcaaccagcctcagctaccagatgtctttgagatggggagccagccccctaaagctgagtctctgtgtgtggcttccaaatacctggtcccctgggtgcagacagaagagaggacgcagaggctggacatctcccagaggagggggagactggctggtcaccagataatcttgcttccctctctgatgtcataggaacatgaacagacttggagatgctgattgaaagtacatgtcacctgaaggagacattggttccagagcc

SEQ ID NO: 141687 - DNA, 257 bp, Homo sapiens
aaggaaaaaaatgtgtcgtgttagccaaagagcaatgtgctttctcttttttattagacagggtctcaatctctcacccaggctagagtgcagtggtgctgcacagctcactgcagcctcaaacttctgggctcaagcaatcctccagcctcagcctcccacgtagctggaacttcaggtgtgcaccaccacacctaatttttaattttttgttccagagatggggtcttgctaggttgcccaggcttgtctccaac

SEQ ID NO: 141688 - DNA, 267 bp, Homo sapiens
caggggagggcaaggaacgccgacttctgggcaccatcagagttgtcgtctctcaaggacccccagcatcgcaatcacaggggtgctggttaaagtgcaggtcctgaggcccccaggaaatctgcattttaaacaagctttccagctgcttctcacacacattaaagttagaggacaacacggcccgagctcagtggctcacacctataatcccagcactgtgggaggccaaggaaggcagatcactcgaggtcaggagtttgagac

SEQ ID NO: 141689 - DNA, 219 bp, Homo sapiens
atagatataggcatcaatgagctgatgcacgtaaagcatttagcatagttaagaaagttcagtgaataagggctgcaattatcccctactctccacctaactcagaatgaatgacatcagagctgagaggaaccttgctgatcacccacgcctgctcctcactgacggctggagacacagaggcccagggagaaaaagtgagccatcaaggtcacacag

SEQ ID NO: 141690 - DNA, 531 bp, Homo sapiens
gtgctgacttgtgctgtgagcatcatgtgaggtgaccacgtgtgtggacaccttaactgctgagtccccggctgccgcccccgccgtgctgccagcttgtggggcagtgtttgtgtgcggccctatgccctcagccctcctcctcaagagctaggaatgtcgcctgctgcccctggtgttccccagcccacagtgcccatgcagccagctcaccagggttcagctgagtagcgaaggacccctacccaggatgtgcaggcaccaccgtggtggggctctggcgccccaaggtgcccgacccaggaactgcaggtgggagtcctcattttgggacacacggactccctcgctgacatctaagaccccatatctgcggggcctcagggtctttgctgaggcctaggagaggaagggtttccttcttggaaactgccaacccaagcagggaccccttcctcaaacctccttccgcttaacttcccttccctaaaggcactgtggggtctcagcctatggtggaatcaggagcgt

SEQ ID NO: 141691 - DNA, 427 bp, Homo sapiens
ttttctctctgttactttggggatgacgtagagtttataatgtagtttaattgagcactcaaggttaaagtatttaatggcagaattggtgatcatgatacaaagagatctttaaggacactggtattcaaatttttaaagttaaattccaattttaagagtcagttttttatatgattactattaagtttggcattttgagacatgtcttaaatcgatatctgtaatacttacaaacatcagtagagagaatcatattgtaaacacatattcttgctgtagggtacattttaaatgtctaaacactaatcaatatagcaaaattaagtattgactaaaatagctttataataagtaattattggtttgctcttttagaaattagacattttcactttgggaataaagagtaaatttactgtcatga

SEQ ID NO: 141692 - DNA, 536 bp, Homo sapiens
tcctgatgagcaaggtggttcagtaggagaatctgagaaggttctgtgtattgtttaggtgataaggggtatgaggcctgtctcttagtgtgctcttttttatccttaccttactccttgttctcattcccctagttttttttgcctactcagagtagatatttttgccctaggcattccacagggctattgtgtttaattggggttcttgccccttgagaaagtaggcaagtccaaggaggtatgagcaggtggtggggcagccacctttatccaaggtagactgccatctttgggcaccatccccagctctgctgccagccacctgtgtgatcctgttctttctggggacagctatgaggaagaggaaacagctgatggggctgaatgatagtgtcatgatagaacactgctatagggacaccctatagaggtcaaagcccttaagttctctcgctcccatgcctggcctggaaggctgaggcaagctgccaagacagccactgcagggtgatagaaccctgggaggaggggct

SEQ ID NO: 141693 - DNA, 886 bp, Homo sapiens
ctaatgtccaaaaccacacagatttagaaccaaaacaaaacttttgttcttttttcaataaagtacctcaggaatttgctaaaatgcatattatcaggattcatagacagataattgcatttgtgtgatctcagctgggactcagaaaacatatttttaaattatcctatcagaagattctgaagcagatggtccatggagagtttttgatgatatatttctctagaataataatgtgtttctcgagacacctattacactagcaatttataactttaatcgtaaagacagtgtcatataacactttctcaataaatatttttgagtgaataaatctacataaaattatttaaaatatattgtttatttccaaattaggaggtgtaaacactaatagttttataaaaacctttcgatcggtctcaaaattgcaaataatgtactcttaaaaataaaaattttgtgattttttttataacattaaacttaggtttgcttataaaaaaaaaaaaaaaaaaaacaaccacaaaaaaaacaaacacaacaacgcaaacaaccaacaagaaccccccgcagcccaccccacccccaggcacgtgtgatccgactattaaaaatacttgtcgacggaggcgcgcaaaatatgacaaccagacaaggagtttatctgaagcatgttaccccatgaggtgggagcagattaaattgacaacgcacggagtgcgacaaatcagtacgcatcagcatgtagcgagtataaatatgagcgtgaggcgacgatagctaaacaaccaccatcggaggtcaggaacacatgtggctgacctccacgacaagaaacatcactccgggtggacatactagccgcacaagggataacctgtgt

SEQ ID NO: 141694 - DNA, 350 bp, Homo sapiens
ttcaaagtgggctgtgtgctgcctgcacactttcccagcacagagcctgaagcccggcacttacctgcctcacttctcccctggggtgtccgagggccctctcagctctcctgagtctgatctctggccccaagtcttcttcatacatttcctgcagttgagagggacctggtagccaggaggctaggagagcgaagggtcttgtccagaccctcctcctcgcccatgtagcaccttcattgctctcctcccttactgtggtcagcacaattgacagaatgagcttactaaaaccattccacggctccttctgatggggatctggccctagcccaccactccaacaagag

SEQ ID NO: 141695 - DNA, 169 bp, Homo sapiens
ctaaagtggtcatgaaaattcagtgtttgtagccactcaaactaattgttccattgaaaatataatgaagaagccataaaggaattcacagatttttcaaagtgctggagcaataaatgatccctcgtgtttcctctttgaaacattattttctgtgcttcacagctct

SEQ ID NO: 141696 - DNA, 225 bp, Homo sapiens
aactcctgaccttaagtgatcagctcaccttggcctcccaaagtgttgaaactgcaggcatgagctgctgcacccagcccttatgtagcttttggaaacaagtgaggagtgaacttagggctttatgggaagcatcaatacattacatcaataaaccaaatgtgagccaacagaaagcttccgggttggggtgcagtctgggctcaccacagctctagcagcgac

SEQ ID NO: 141697 - DNA, 497 bp, Homo sapiens
gccttcagggcaaactggggtggggcagcactgggcagaggctgtgtggcaggccagggtctcccagaaggtggtggctggccgggtaagcccagctcagatgctggggagacatgggggcatggcacacaggccacactcagcctgggatcaggccccgtctgaggacaccgggtccagttttccctgggccaggcccttggaaaggaggagggagttggggagggagaacggaaccctggttctccgacaggccccatccacccacggcctgtgggctccagggagagcatggccagggtgcccaaggagacgaggaggaggctcctcatgcttcatgacccctcctgctcgttagggtttatcaacatcatttaagatcagccttgtgctgtgggttcctggcgtgctgtggataacactgtgcccgggtcagcccaggcatgaggggcggggactaggctggaaagaggaggggcttgcagagggctgggctt

SEQ ID NO: 141698 - DNA, 801 bp, Homo sapiens
ccagttgtgtccgatgctgagctccaaatgccctcttggggtcttcctcccccatcttctttcccagctggtatgggggtccctccgtctccatgtttccatctcacaccaatcccagcatggtagattcgatagtagcacagaagtgaatatcaaagactagaatcagagaggcctgttgtcaagttccagctctgtcacttacatgctgtatgattttgggcaagtgacttcactcctccgggcctcagtttcctcgtcttgaaaatgggaggagttgaaataatgtccaccccattggattgtggtaaagggttagtgagtaaggacaggggaagaactgagcgcgggcagtttcggaagtggggtcgcagcacccttcctctcttccccttagctacactgtttaatcgacgcctgcaggcttatgcaggccttggcggggaggcagcagggagagacacattggacccaagctcctctgagcacacgattgttctgggaccgtctgagggtcactttgtcctgcgcttataaagcaactttttccctgtgaggtggaagaaactcacctgtacctgctgcttggtgggcagcagtgcccagggcccaggcagtcagcctctcgtcacttactgcgaaggacaggctgggaggatgcaagggaggacccggggggacggtgggggccaggagtgcccagtgacccattttgacatccgttcaccctcaacatccagctccgaggcccccactgacagcagatttaactgcccagatagacggtttcatttaagcggc

SEQ ID NO: 141699 - DNA, 361 bp, Homo sapiens
actgtgggatggaggatggggctgtgctggggactctaaccagcccctggcctgagctcccccagaccaaagaaagcagccactgtggtctgctttcaggcttccaccccagcaaggggcaggctgctggtgggctcattggcctggcccaggctgagctgatgccactgctggaataccatcacctccaagcgtgtgctcttgctcctcctgccctgtgtggcctcgtcactttggctgccagtttctaaatggcactggctcgtggctgatgagccattcctgtctcctccggggcagcgcctcacattcatctcccctctagatcacttccacctggcttcagcctccagaatcaatg

SEQ ID NO: 141700 - DNA, 301 bp, Homo sapiens
gagaggaggggggacgctggctctgctcctgagatgccccatctgggacacggggacagtaacacaagtcccatggggaggatggggacgaccgcgcctgcccagcccgcagcatggagcctgcctacaacggccccactggtatcatccttgagaggagtggggccgctcggggccaccaaccacagagatcccagcagcttctcggttggagaaatacttcgtgaaggaccaaaatggaaccacaggcacaaagcctggggcgcgtgtgttggaggcagcacaggcagggacaggattg

SEQ ID NO: 141701 - DNA, 697 bp, Homo sapiens
aggagagccccatcttggtgtagacattcctttgcctcttgtgtttgttggaggtattcagcttgtctaatagcactgtttgcatatctcttgcttttgggatatgcttcttccatcccttggctcagaagacagttttctaatctagatcccatgagccctcgagggctcaggtttaatctgggagcccaccttcatggcatcagagctctgagaccagggtctgtgaggagtcacttagtccacttttcttcacatcatgagaatgtttctgtacccctgtatgcccccagagaatatgtgatgaaggagttgagggtgggaggttatcttgaaagacataaaagcaagttgtatccttgtaagaggagaggtgattataggtcctcttgtcctgttctagattttagtgtgattcaaagtccatcctacctaagatacttatagctcagctctccagctttcatgaccatggtttcccccaaacagtacagaagtacacgaaataaaaaagtgcagctctacttcacccccacctccctctccgtaaagtacacacgtgtgtatatatatatacacacacaaacacacacctatatctatatttttaaaacataaatgagagtttgctatacatgttctaccccttactttttttcaatcagtgtatgatggagatctttccgtctcaggagat

SEQ ID NO: 141702 - DNA, 195 bp, Homo sapiens
cctcagagggaggcaggcatgtgctttggggagccgggggagcagggtgagcgcgctcatctttcctgctgtaggagatggtcttcaggagtgtgagagttctaggtacagctgcacgtatttgctaggtggcacattttggtacctaaaacattttccctaagaagtaacaaaccacccgtcgaacaccccctc

SEQ ID NO: 141703 - DNA, 349 bp, Homo sapiens
tgataaaaatgttctgcagtcaagatagtggtgatggttgaacaaccttacgattatgtgaaaaatcacaattgtgcaattttaaataaattttatagtagacaaattatctctcaaagtttcacaaaaacataaggtattactttcacagttccataaatttgccaacttcattttttgtgatcaaggaagatctatagatattcatgtaaaagaaaaaaactaaaacataccaaagaaacaaacattctccagattttcggacactacccaccttcgctggatgctctgctccccactttagactccaggcaccatgacagaagtcagggttctcagatgccccatt

SEQ ID NO: 141704 - DNA, 154 bp, Homo sapiens
gctgggattacaggcatgagccactgtgcccagcagacatctaactcttaacgatgttggcctcagaggtgactccacagttcatccccagcatgatacagggcttttggtcagtgacttattgtgagaatgagcacccagctaacctgaaggt

SEQ ID NO: 141705 - DNA, 420 bp, Homo sapiens
ggagactgcaggactgaggacaggaggctttgggatagtacagtggttaagagcacaggtttaggagggtccagtctgcgctggaccctggctgggccacttgctagatgaatgaccctggagaagttgcttaaccacactgagcctcaatttcttcatctgtaaagtgggaatgatacccaccccacatgattatgtgaggatcaatgtgaacatcttcgtaaaatatctgacacaatgacaggctctagaggggcttagaatggcagctgccatgactgcctttgtcaccgtcactgtcctcattatgtgcatccccggctgcatccttccacccagctcacagtagttatggggcggatgcagggaaggtggagttgccagagccagtgaccccaagtgtgaatctgatcgcattac

SEQ ID NO: 141706 - DNA, 384 bp, Homo sapiens
ggcacgcagccagtgcggggcagagccggggttagagctcagatgagaacatggagacccccaggacgaaggcctttgcccacggccaccctcaggctggctccatctgtcgggggtgctgaccaccaggaggtcctggggttgggaattaaccaggttatgccagcagggtcagtctgggagaaaggcggccaggcgagggcagcagctgtgggtaggggcctggtcaggggctttgtctcaggggtggggctctaggcagcagcccaggtgtgtaggagcctcggggctgttttggcatcaggcgacagagcggcctcatccggagggtcagggccatgcatctcttctggaggccccgccagaccctgctcatcccctctt

SEQ ID NO: 141707 - DNA, 655 bp, Homo sapiens
tgcaatggctcacacatgtaatcccagaactttgggaggctaagacaggcagataatttcagctcaggagttctagacccgcctgggcaatgtgatgaaaccccatctctacaaaaaaataaaattaaccagacatggtggcacgtacctgtgtggcacgtgcctgtagtcccaactacttgggaggctgaggagaggtttacttgagcccaggaagttgaggatgcagtgaaccatgatcacgccactgcacttcagcctggatgacagaacaagaccctgtctcaaaaaaataaaataaaagaaatattcatttgtctagatggtttttagtttctcacctttagtaatatggtagatgacattgatttttctgatattaaacctttgtattcttacttgatataatttttaaggaaattattttatcaaatattaaaattaaaagggtaacatgcagaaacctagctgtatacagaaaaggcaatattaccactatttggtgaggtgtgctgcgtgacgataacctgaaaagaagcactaggtcataagactggcttcagttcctctgagaatttacaagagccttttctggggagatcactgggcaagaccctgagcaaattctgagaaacattgggttatccataattag

SEQ ID NO: 141708 - DNA, 102 bp, Homo sapiens
tcccgaggcgcacgcacacacagacggacagagacagaaagagagggccacggaaagagcgagaagggagagagagagagagagagagagagagagagagag

SEQ ID NO: 141709 - DNA, 119 bp, Homo sapiens
gtcagaatgacaagccccacgtataattcatatttttagacttaactattaatattttagttagaaaaacttgagacatatgcacagacacctgtaaacaactacttgttcactgaaaa

SEQ ID NO: 141710 - DNA, 135 bp, Homo sapiens
gcacctgccagtctgcactgggccctatttgctatatggactgaccagccccaggggatgcccagagctctggacctggtagtcgtctgcctggggaggctgaggcctggcagggcccccagcacatcttgctct

SEQ ID NO: 141711 - DNA, 418 bp, Homo sapiens
atctagaaaggaaggagggatgcaccctcatcccaggcagaggaaggaggaaaggacaggagggaattgtaagagggaaagaaccatagctatttctaagtgaccagagcaaaaggtgggcagtgacaatagcaacagagaagactgagagctagaaggacccagtgtccggttttgttttgttttttaaattaaaaaaaaaaagtttttgggggccaagtgcggtggctcacgactgtaatcccagcactttgggaggccaaggcaggcagatcacctgaggttaggagttcaagaacagcctggccaacatggtgaaaccccatctctactataaatacaaaaattggctgggtgcagtggctcacacttgtaattccagcactttgggaggccgaggcgggtggatcacctgagg

SEQ ID NO: 141712 - DNA, 489 bp, Homo sapiens
ccggcccccccttccaattcctaaagaatccgttgttactgtgggaagaggcctggagaacaaagccaagtatgccatacaaaggcatggcaggacatactaaggtacaggtgctttatttcatccagatgagaaaccatggcaaagtgctgtagggttttcaagaaacagaaaagccatgctggaaaataccactccatctcacagcatgcctcctctgcactcccactatctcagtagttagattaacttcataggaatatgttacagactccactgcaagcgatacttaataaccatcactaatatagcttttctaagtcccacaattagtatggtccaatgtctttctctgccttttgttaatgatgtccacaaagtaaattaaactgtactctgagaagcagagccttcactttcatgtatgagtgtggggtagaatgtttcaaaactgcaatgtggaaagaaatgtctcaaatactcaaaaag

SEQ ID NO: 141713 - DNA, 161 bp, Homo sapiens
ctgccatttgcattgtattttttaaggctgggatataagtaatagaattaaatccgttggtaggcaaagtgtgctatgaattgtggcagttttctgaagaatttaagccaagaggatatttttggtttgactaagtaatataattcaggccaaaatggctt

SEQ ID NO: 141714 - DNA, 203 bp, Homo sapiens
aatttgagggcctcttgcaaaaaagcatacaaaattcacattcatatttgctaggcccctccctcttaggacttatttctaacagttttcattcgtaattttatattctttctctaggaacatctgcccctgtgcccacttcagtgttaaccatgtgctgagtgtagcatacccattagcatctgctctttccagcagcaccc

SEQ ID NO: 141715 - DNA, 552 bp, Homo sapiens
tttttcatagaaatgctacttccagcagtatggaggagtaggtactagcaagaaggtgacatcagtttacaaagaaaacaccagtagactgacagccaacctgtcaatatcaacagtggcagctagaagacaatgggataatattttcaaaatgctgatagacaatgtccacataaagctgtgtggtcactcactataattctgtgaaataccttcaaaatattgacaaaaataaggacagttttgaacaaaaactgagagactaaaaggaaattctaaagcattcagctaaaagattccaacttattattgctgagttaaaaatagaacccaaaatgatgatctgagctgtaatatggaataatgactaaaaaaaggcattttataaaagcgtgcacattttcttcttaaaatactattaatacggtctgattgataggatttttatacaatgatagagctgaagtattagactgtaataacatttaaatttggagaggacattgggagttagtttctaatgtccttatatagtttgttaattatacttgt

SEQ ID NO: 141716 - DNA, 966 bp, Homo sapiens
  misc_feature (614)..(614): n is a, c, g, or t
  misc_feature (701)..(701): n is a, c, g, or t
atttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaaaaaaaaaaaaaaaaaaaaaaaaaaaaaaaaaaaaaaaaaaaaaaaaaaaaaaaaaaaaaaaaaaaaaaaaaaaaaaaaaagagagggggggggcgcgcaccacaaaacatccccgcgcgggggggccccacagttgcaagcgaccaccctgttcttttttaaacagaaaggggcgcccacaaaaggggaggagctattaaaaacagaagccggaggacgggcgcggtaaaaacaccagggctggagagggcaaacacagctgtagggagcgcacatctgggagaggagacacccnacatcggggggggcgggagaacaatctggggggaccacccaccgacggcagatattaatagggggcgagggcgacaaaaaaaacacnggagaggggagtcgagtgggtaacacccccgccgtcctattcgtgggcagaaaaaacttcgggccacgcagatagatctatagcgcataattattacggcgcgcagcctgatctatagaatatggcaaacagtccgcatggtccgcactgaagcgagtggtcaagtacgcaggaatgtagctggaccagtcataactagcagctaaagctctgccgacagtggcagtacgcatgcacccaacagaacacgcagcaccagcagagc

SEQ ID NO: 141717 - DNA, 397 bp, Homo sapiens
gagcaagtgccccacgcagaggccctgaggcaggcacctcaaagaaaggtgatggcttcaccagctgagctcctggatctgaatagctttgtcagctggagaactgcacaaagggtttgatgttttctaggataaggggaaggatgactgctttcacaccggggtaatactagacactgtgctgccgccatgggatttcctgtgattcatttcgcaaaccagccaagagttggattttatttgcccatttttataaatgaaacatgcagaggttctctgactccctcagctatacagcttataaccagcaccatcaagattcaagattcagactctgctccagggtgcatttcaggaatagctgaggaggagcacctggtgacaccctccctgccca

SEQ ID NO: 141718 - DNA, 454 bp, Homo sapiens
atggcgaaaccctgtctctactcaaaatacaaaaattagccaggcctggtggtgcacgcctgtaatcccagccacttgggaggctgaggcaggagaattgcttgaacctgggaggtggaggttgcagtgagccgggatcgtgccactgcactccagcctgggggacagagtgagactccatctcaaaaacaaataaaaaaaaagtgtcttcattgaggagtttggtggaaaaccctaccagtttttttatttgtctgagaagggttattttcaccctcatttaaaaagtctttttattgtaaatttcaagcatatacaaatgtagacagactaaactccaacatatatcagctcatggccaatcttgcttcaatctgtacccccatctattccccacccccaaaatttaaaagataagtactctttgtttaaaaaaaaaggatactacagttat

SEQ ID NO: 141719 - DNA, 434 bp, Homo sapiens
tcccaggttctatatagcatttcttttctggaggtctttaaaaatattctgggagatctgtctggaatgcttgagtacattcatttattcctgtatgcatagagggcccagggacctcccaggctctctgagccctctgattcttagagggttaaactattatggaaacagacattgcatctgtgtcttctcttgtttcctgcatgcagcagtgacctttggagtacattgttcaggagaccgacccttttctaccatttgaagtctgctattctcatctctctaccaaaagagaaactaaacttcattgtcgtgattaaggtcacagccaacagcagttaaagaagccgttggtcttcccactcataccgctgccctctccctagctctcaggaggaagagctctccaaaatggaagtgtcttgggaaagaaa

SEQ ID NO: 141720 - DNA, 368 bp, Homo sapiens
gaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctca

SEQ ID NO: 141721 - DNA, 191 bp, Homo sapiens
tcactcaaaaatcaaccacttcatagaagtacaaagataagattttttcatagacttttcccccaacattcttttctgaaaaattcaaatatatatacattaaaatcaaacaaattatacagtaaatacttatatacatactacatagattcctcaattaatgttttactacattttccttttctcttaga

SEQ ID NO: 141722 - DNA, 545 bp, Homo sapiens
ctttttagttgcctggaccaatgcacttgctctttgtcgcaaccatttgggttggaaaacaatggatacattagctgttggccagggatgatgaataaactcagttgttagaagatgattcacagtgggcacccaagtctcaggattaagaccaaagccttgttgtgatttgtgagacttgaggtcagagataatctccttctgaatcccaaagtactgggcaagaattatttaaatttcttttgctgaagattagaatttgtgctataattttcagtgaaatttgaatctgcagatggacaacaaattggatgagagaaagatgagctaagagacaagctgggcctgaattcatttataacactcccaaatttgatttattcttagaattgggaacaaaggttttgggtgggacccaaactctaattttataatgtatggcaaaggaaaatataactacacataaataaataaatagttaaaaatatttttccactggaaaaaagaacatttctttttatgaacctgaatggataattcattcc

SEQ ID NO: 141723 - DNA, 421 bp, Homo sapiens
gattccttccacatgtttttaagtgacatctaagaaaattttttttgtgtttaagtagcttccagggattaatttctgctgtccggtatttggtatacatgctttcagggccattgctagcttttccagtgcctttctgcaaattaggcaaaggtgcccttctgggaaaaagcaggttttctaggaatggtacccctgtgtaaagaaaaatgtgctccttcctctggatgaggaggagagcctggccagtggattgcaggctgtatttcagcctctacatatcccacaaaactgcacaacgaagtttcagcccttcacttgtccccaaagctgtacaaaccatacacaaaagctttgtagattttaagttaaaaaacaaacaaacaaaaaccttggcatacagacaaagatcattcagttt

SEQ ID NO: 141724 - DNA, 1091 bp, Homo sapiens
tttattaccaaaggatcttattttgttacagaacacaggaaattgttaaaccttataatgttgcaaaccatgcattttccttttctcttttccataagatttttttattgtagtagtgccctggcttgtaaacagtggacatcactgaaaggatgaaatcaagtaggcttgtttcaaagagactcctgtgaatcaactatgaatatgaagtatctcccagaacaatgttgagtgtttcaggagactctgaaacagggcacccattttttttttccttcctcaaaatagtctccttgaaatgtgagcaaagaactatgatgatgcagtccaggtatctaatagctcaatcaccaacaccgctgagaattgttcttataccagcaaaaagttcaaatacaataacctgggcaatgccaacagaagacacttttaatcatttgcagacctttcttgttgcaggaaagtgagggcaaaaacaaactggtgaaaaatgttcaaaaatagatctttttgatgttcatagccagtattcagtatttctgtattgtttacaattgggggaaaatgtctgttaaggctaatcatctgagtgatttgagtagcaattaaaccaaagggaaacttttaataagttattttaagccctggtttatggctagttcccttttgctcaggaaaaatagtactactttatggtttatgaaaacctatgatttatgttgcatcttccggggaaggtttaacagtacaaggagctgaatcctacctgaaattattaatgcttaatatattgcttctgtttgattgataaaggtgcttaatcaattgaaaaaaaaacgcataatgcttcaaggtaaaattccgttgattctgaatttaaaaagatactacagaatgcgtcagttctcctgttgtatttttctcagttatgagagcaaggctattttgtcagtttagattttgtgtctttttctgtcagtatgtatggctccctaattgaaaacatcttaaatgaactaatcaaacacttattgtgtgaaagctgaatactttaaaaagcaaccttaattataaactcatcttggagtagc

SEQ ID NO: 141725 - DNA, 701 bp, Homo sapiens
tgagggtggaattgttagtgtcctggggctgtttcttgacttggtcaaataaaacatctggatataggtaagaagtgccttaattgtaaaggagtattgcaagaggaggaaagcaccaactgtaagatatttgtggatctcacagttgaagcagaaaaggcctttctttcatagggaggagcaaacatgattcaaggtgggaggggaagggcacgactcctggactaaatcagatccctgatcagagaatgtttcaccctgaagtcagcctgttcttaggaggggcataaagaggggttgaatgttgactcaggctgtgggtgggacaaacctcaggcaccttggagaaggggagaaatttaagcaactttggttaacacatattttgttttgaccatcgaagataaaactctttatttaattgcttatgagggggaaaaaaaggaaataggagagtttgtggctttgtgatacctaaaacagggagcatcatctaagtcataacaggaagaagattctttgcagtaagctgctcttgaagaacaaaaaggaagggggatttctttcatcacagctgcttcccagggttaactacctactccatcttttccccactcctttctcttgccctacacatctcttccattaggctgagttgtatcttttataataaactggtcaatgcaattacagtctttgct

SEQ ID NO: 141726 - DNA, 352 bp, Homo sapiens
tcccagctacttgggaggctgaggcaggagaatcgcttgaacccaggaggcagaggttgcagtgacctgagatcgtgccactgcactccagcctgggcgacagaggaagactccgtcaagaaaaaagagaaaaggcatcaggtatgccagggtgtgcgggaaaaggcatcgggtatgccagggcgtgtgggaaaaggcatcgggtatgccagggtgtgtgggaaaaggcatcgggtatgccagggcatgtgggaaaaggtggtaagattcctcagcctcccagggttgggaagcctctggccgagtgaagcataccctgggtgggttttaagacaccagctttccagtccag

SEQ ID NO: 141727 - DNA, 373 bp, Homo sapiens
cagccaagcagcagatgcagagtcccacgcgctgcctgtggccatcaagtcgatatagagcctcgtggcggcttggcccttgtgaatcttccacgtatcgatggcgcacctaccttgtgccaggcgcagggatcccacaatgtaaaagaagaggaaatacactgcgacatgtgatatggagagacatgaaacaaatcagcagaggcaagatcatggagtcactgaaggctttcaagcaagggattattagcagcccaatttgctgggttttagaaagacaccggctgcactgtggccgacagaggaaaagccagagacagggagatccgccccctaaatgggagagggtggcctgaactagagtaaccgcagg

SEQ ID NO: 141728 - DNA, 122 bp, Homo sapiens
aggaggcaggggagaggggagagatggaggaggaagagaggtaagaaggagggggagagagtgcgagagaacaggatcatgtaggcaagagagcacgtgtacccggaacaatggttagaaac

SEQ ID NO: 141729 - DNA, 356 bp, Homo sapiens
gcggccgcctactactactactgctcgaattcaagcttctaacgatgtacggggacatgttatattcttcagttcactagtttctttgaagccagagatcacccttgaggtgatcttattatatttgcctttcaggcatttgctagagggcccagaaaataataggatttaaatagatgttttttgataaattatttctcatatgacaaaatataccactcttcattaggatgagaaatttaggtctactctaaacagtgtttcagcattgcttggtaaatagaactctaaggagtattactgaggcagagattgcagtgagccaagatgccactgcactccagcccaggcgacag

SEQ ID NO: 141730 - DNA, 434 bp, Homo sapiens
tgtatctgatgcagctcctctaaagtaacttgttctttacacagaatatatatttaaatatttgttgaagcaaacattgaaaagattgaattaaaagaaagttatttttgtaataaaacttttgggataccaaattgcatcactgtcacaatagaattcatgatgtcctgacttttgcatgggctggaccagatgtttagccattttgtgaccttcctctcattcaattctgaggaatgtcaattcagcttggcttctgttagttggatcaatatcaagatcaagaccaagtaaaacatcccagcataaaggacaaagacagatcctcagtctttatataacagatcagggaaagaaggtgtaagggagccagtgtcctcagcacagggcaggaaactgtgaatgataaacagaaccactgtggattctgtttc

SEQ ID NO: 141731 - DNA, 453 bp, Homo sapiens
tcccaaatgtattatttctagtccagacttttcctctcaactccaggtctataaattgaattgcctacccctctttcgtgaggatttacgtctcttcaaatttaacatgtcccaagataaattcttgacttatgcttctactaaatctacttctcccaggtctttcccaacttagtaaaagttcaggccaaaagctttggaataattaccaaatcctttttctctcacacccatagccagtacacatgagtaaaagctgtcacttccatattcaaaatatattcaaaatctgattactgtccaccaccccaatactacaagaaccattacctttcacctggatcactccaacagtctcttcccttagtatcttatagtatactctcaaaacaaaagtcattgttatattttaaaaatgtaaattcacaacatgtcttttattgcctcaaaact

SEQ ID NO: 141732 - DNA, 262 bp, Homo sapiens
cagccgtgactgaccttagcttggcctctacattcttcagaccgtgggtttcttcccccagccccaggggtgggggctttctgaagccttctgtgctgcagcagagagaggctaagagactggcctgaggtcgctcagcaggtccgggggacagatgggtctagaattcctccttttttgtctccagtttctttccatgatcctccatcctaggtggtctctctctaggcagaatatagccttccttattcctgaacgttta

SEQ ID NO: 141733 - DNA, 343 bp, Homo sapiens
catggatcgggggtgagtggggggagtcacagacttcttggccaataccacatttctctccgggatttagactgaatgaaataggatagcttagttcgggttcagtaccaacaacattttctgttctggtttggttttacctctgacatttgagacttatgtaggtttgattctggcttcaactggcttattaaaagattggggttgcagacagggaaaaagaaaaaccttcagattaggtctctgattcagtaaaatattaatggttgggattggtcctgaccgaatgcagcagacaatgtgatgataagttgtctttggttcaactccagctctaatcttg

SEQ ID NO: 141734 - DNA, 500 bp, Homo sapiens
acttagataagaacctaaagcctcctctcaaatctagaatgtcttagtgggaaggtgggagataaggagcttgtaaatagcaaaatcaagtgggattttgagtttacttgtccctgttctacccatagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctattaaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaa

SEQ ID NO: 141735 - DNA, 204 bp, Homo sapiens
attattgcttcagtggaatacttattcacccacattcagagcattgaaacttagctgacagcttttatttacatcagctttgatatcttccactttcacccacttctggggcacaatctcataagcacaactgaggtttgtcatcatcagattctttcaacttcatttacagtcaccatttttctttcttaccatctccctgaa

SEQ ID NO: 141736 - DNA, 509 bp, Homo sapiens
atcaaaaaggagactcccgaatagtcaaaggaaattagcttgccgacctggcagccaagcaagccacaaaaacattggactctgaggctttcttagccccactaatacctcacaatgatctgaccaagttccaaccttgctataccaaaggagatttaaagtgagccaaggaatggggattcacatcccagccctggcccatccaggctggaaatgtaatctggaaggtatcgtattggttcccagtgccctccttaaagatatagtgagctagtttcatcaaagcatccattacagaaaagatgcaacccttcaatggcatgtgagttcttgattgaccccgacatgcaatggggtcattcaaaatgtgatctatcaatgcatgctttgtgcccaaactgccctaaaactgaccccacccctgttcaagggtacaacattgaggagactctccatgcaaggactggcaagttaatttcaccacaatgccacgggtgcctggaggctac

SEQ ID NO: 141737 - DNA, 430 bp, Homo sapiens
gcagcctatattttttaaatattcgtttgttttctgtatattgttggttgttttttctcatgtgagcaattatcaaattttatcatgggttctaaatagaaactgtctttgaaaagtgtgttgatgtatatttactttggtcatcaataatgttaacattctaataattcctcaataactttatattttggataagtaaacttgattttacttataagaagaaacattccaacttctggaaaacccagtgtaaaaaattctttccacttgttcatttgttccggatcagcttgtagaacccagcaaattaggctaatgtaaggtattctatgtttagatttttggtttggagaatttcaattttctggtaagaaaaaaatgaaggcatattttattgtaagggaataatgtaataaaaataggaatagct

SEQ ID NO: 141738 - DNA, 319 bp, Homo sapiens
gcaagctctccttcagtcctcccaacgactataagtgaggtgttaatatgcctgttttacagataaggtaactgaggatcaagaagttaagtgatttgttcaaggttgtcactgcagcagttttgtggtttcctctctaagatggagagaagttacaccaggacttagtgcctgggaagcaaagaggtgaaattactcggccaggattgcacagctgacagtgatgataccgatggctgtgcttttagtagctgttaggtaccaggaactgtgcttggcccttgacacatataatttcacggaatcctcacagcagatt

SEQ ID NO: 141739 - DNA, 613 bp, Homo sapiens
ggtaagaagtgcctttcacctcccgccatggatctgagtcctcccaagccatgtggaactaagactctgccttgctagcagaattgctctacagtttttctctcctttctggctttggagacacaagatgccgtgagtcctatgcctgcaagaagatgaattttgccaacaccccagtgagcctgaaagtgaatctttctccacatgagctttcagatgagaagtcagtcctggctgaccttgactgcagccttgcacaggactcagccaaagctgtgtctggattcctgactcacagaaaccatgagacaataaatgtgtattgttctaagatgctaaatttgtggtaacttgttacactgtattaaagaagcatacactagtgttcttaaataaacatttgactatggtgttggtgttcaggacatccacccaggaatctggatggaagatgccatagtcttctgacttccctggattggcacacatacacattgaatgctgacttttccaaagcaaggaagaacaagaagaaagaaaagaagtgggctctatattcctattattaagtctaataatgtgcacgtttgaattattgaccaggacatttgtg

SEQ ID NO: 141740 - DNA, 618 bp, Homo sapiens
tttctaggccacagagtatggagacggtgatgcaatactactcttgtgattatatttcattttagaagactctgccttgctagcagaattgctctacagtttttctctcctttctggctttggagacacaagatgccgtgagtcctatgcctgcaagaagatgaattttgccaacaccccagtgagcctgaaagtgaatctttctccacatgagctttcagatgagaagtcagtcctggctgaccttgactgcagccttgcacaggactcagccaaagctgtgtctggattcctgactcacagaaaccatgagacaataaatgtgtattgttctaagatgctaaatttgtggtaacttgttacactgtattaaagaagcatacactagtgttcttaaataaacatttgactatggtgttggtgttcaggacatccacccaggaatctggatggaagatgccatagtcttctgacttccctggattggcacacatacacattgaatgctgacttttccaaagcaaggaagaacaagaagaaagaaaagaagtgggctctatattcctattattaagtctaataatgtgcacgtttgaattattgaccaggacatttgtg

SEQ ID NO: 141741 - DNA, 509 bp, Homo sapiens
aagaaattagtaacagaaagataactagcaaatccccaaacgttcaaaaagtaagcaatacatttgttaaaaaaaaaaaaaaacctacaggtcaaagaataagccaaaataaaatctgaaaaacatttttgcataaatgataatgaacatgtaacataccacaatttgtgggatacagctaaaatgtgttgagaggaaaccctatagtcttaggactaaacatagcctagtttcccaattattattaacaaccaattcaaaatataagttatgttagggtacttcaatctagttagctgccattcaacaacttttttagggacagatttatattagactacttaaattattcctagataatgactatgatatttcctttctctttgtatacttttttaaacatggattaatcttaatcagtaaaatttcatcataagcaaaacccattaaacaaacaatatctttgtttatctacagcataaatatacatacacagtattctacagaat

SEQ ID NO: 141742 - DNA, 453 bp, Homo sapiens
atctccacatccctatctgtcggcctcacagatttgagataagtaccaaagatagcatcaggaaaattgtttgggaaaactatgaaggattgcacagctctagtatgttgtgttgaatgaaggatgattagctggcaaatcacatcgtatgtctcttacaagtcctgcttcatttgtatttccttatttggaaaggctccaatttagaactgcaactggattttttccaaaaaatacagatctagcatcttgcctttctgttgaatagaattttttaaaaataacatttagaaggaaaaagaggaactttaaggaagaaggtgtcaatcataaaacaaggttgctaaagtcttactctcttctcccactatgcagattgcctactatgctcctgtcactttttggctagttttaaggcatttccttttagaactcactttcaggaactttata

SEQ ID NO: 141743 - DNA, 415 bp, Homo sapiens
gggtgatttgctttattagatattaaaatttgccacaaaacaatgaaatagcatgagaaaagattagaaacaaatacagaaatagctacaaaaatatataaaagttatatgacaaaatagacatttatgtttcagtagcagaatgacttacttaataaatagcactaacgtaattagccagccattcgggggataaatataaaagaatgttaattcatgctattcaaaaatatattccaaatagaatgaagtttgaaatgtcaaaagtaaaaattaactcactgtaagacaaaatgaaaaaaacaacttgtacgatcttggtttaggaaaaatcttcctaattattaacaaaaaaactcccaaagcctcaggaatcatagtgaaaaagataatatatttgattacatgaaaatta

SEQ ID NO: 141744 - DNA, 130 bp, Homo sapiens
tggagctcacggagcctctggtcctaggctaggggcagcgtcacattctcaggcaggggttacatggaaacatctcagggaagagcgttccaggcagagggaacagcaagtgcacagaccctgtggcaga

SEQ ID NO: 141745 - DNA, 754 bp, Homo sapiens
agcggaaaaaaaaattatgtcagactattcatattatttgacaagctgcatttttctatttcctggatcatggatttctttccattaccagcgcagagctctgcctcaaacacgactaatatgtattcataggacttattgttaagaggctcatcctctgtaacttgcctggtctctcatttctgtgaatcaaaatgggaaaagcgagtaatgtgaaactgtattttgacaaatgaacagctgagaggtcgagtttgagaaactgtttgccattcctcctgtcgtgtacctaagtaggcccctggctgaactgggctcctagggaagttcgttgcagggcctttggattaggcacatgatgcacctgagggagactcacctggacgcgacgactcatcgagctcctgagaggagagaggttgattagggtggatgctattctctatgttccccaggagtgcgagagtcaacaaaatcccagccatcaccaaggaaaccattaaaaaatcccagcactttgggaggccgaggcaggcggattacgaggtcaggagatggagacgatcctggctaacttaaaagtatacaaaattggtcaggcgtgcttggtgggcaccggtaatcccagctactcgggaggctgaggcaggagaatggcgtgaacccgggaggcgtagcttgcagtgaaccgagatcacgccactgcactccagcctgggcgacagagcaagactccgtctcaaaaaaaaaaaaa

SEQ ID NO: 141746 - DNA, 177 bp, Homo sapiens
gtcactgcattagcaagtgtgtgtgatctgaaagagatctgtgtgtgtgtgtgtgtctctaaccgtatatctacagatgtgagtgtttgtgactctgcacttgaggctgtaagggtgtcagggtgtgggtctgtgcatgagtggggctctgacagtcgctgaggaagatgcctgagg

SEQ ID NO: 141747 - DNA, 408 bp, Homo sapiens
aacatattgctttaactggacaatctgtaactttgtaaaaggactctcttagtagccttgaagcctattctaaattattctaatagataggagggtttctatactggccaataagtaaagatatgatattcccaggaatatctggtacctaggaaacttctggtacctctccactcttattctagagtgtggtcctccctgccaggcaatttcatttcctctaggacagtataaatgaacaagccccagtgatttgccagggaatacatcacaggtcaatagcatcatttaattattttgagttccagcctaattgtgtttcacattgcctgttctttcctaccaccaaaagctacgatgatgataaacacactccattaatataaattgctttttcagataatggaa

SEQ ID NO: 141748 - DNA, 428 bp, Homo sapiens
ggctaatttttgtatttttcatagagacagggtttcaccatgttggccaggctggtctcgaactcctgatcttaggtgagccgcccgcctcagcctcccaaagtgctgggagtacaggcgtgagccactgtgcccgtcccccatcctttctgtctctgaatctgaggactctggggacctcctaggagtggatcacacaggatttgtccttctgtgcctggcgtctgtcatagagcacgacgtcttcaaggcgcatctgcaccgggtcctgcatcagagcctcgttcctgtttgtggctgggtcgtgttccagtgcgtgggtggtcgcaccgtgtctgtcaatggacgctggttgtttcccccgttcggagttgggaatcgtgctgctgtgagcaattgtggatgtgtttttgtgtggccgtgtgttc

SEQ ID NO: 141749 - DNA, 260 bp, Homo sapiens
tggattaacaaagcctgaggatacagaatatttgaaatccacacagaaacttggtgcccttcctgtcaccgcggaattagccctgggatttacagtcatgcactgcatactgatgttttagtcaatgatgaactgcgtatgcaacggtgttttttttttcctgagacagggtctcactctgtcacccaggctggagtgggaatgcagtgtggcacactctcagttcaatgcagcctcgacctcccaaggctcaagcaatc

SEQ ID NO: 141750 - DNA, 460 bp, Homo sapiens
ttaaaggagagagcacagaacattcaaggaactgaaaacagatttctctggattgaatacatgctgtaaccagagaaataggaggaggtgagaaggagtcaagccacaaaaagcttatatatcacttaaaggcatttaatcaggaaagagacataataaaatggacattgttgaaagactcatgagtatagtccagagaaaaatggaagtaggaagggctagatgcagaaatatcagctgagaggtactagaaagacccaagcaatggcagttttctcctgaattaaagtggtgagagtattaaggaaaaaggatggagtcaagaaatatgcaggatgctgattcaatagaacacacatggcatctgcgcaaaacaaaggaggctgcacttctaccttgggaacaggtggatgggggtgctactgaggctaggaatccagaaggaagatcctaacttcaa

SEQ ID NO: 141751 - DNA, 535 bp, Homo sapiens
cagtggtggccacatgaaaaagtttgattctgagacatcacatgccattaggccgagaaaaatggttccaattcagcaaaagctgacactaaatgtatttcacttactgatttcagacttccctactttttgaactgagaaaattctttttataagaaggatcatagagatgtagagaaataaagccccagaattaaccagaattggtaactttttttttaatagcaaaatagttttatccttcaatttgcttgaatttctcgttttcttttccaggtgacaaacccatggggaaatggagagtatcacacctcctaaaatcatgataatgtcactgagagaatctggctggttatttaaaggccctactttcctatctttagagacaacagaaataatcaaaagagaaaaagaaatgaactatctcaggtgcagaggtaaaagccaatgagctctaacaaactgctgcgtaaataagaattcagaacatttgggaggtgtcccttactttgatttacacttacataaaaaaata

SEQ ID NO: 141752 - DNA, 174 bp, Homo sapiens
tttttcttggagaatggtacgagaaaccaatctgggcactaggtatgttctttgctgctggagtgtcattgcttctgggctctgtccgccagagtaaggaaatacacatgtagcttgttttaatatagagaatgattgctatgatcattttaaaagcatataaaatcgtaagag

SEQ ID NO: 141753 - DNA, 458 bp, Homo sapiens
gtgttttgtttccttttcataaactgtcctccactaaacagctcaagatgattctccagccaagtggtagaaaccttctctcccctaagggaagaaggaatgcttagggaaacgtgtagacttggttttagtatcttctcctctttctccctcttattctttccttcaggaataactgagtggcaaagactgaactaactgttcctactcttctagctgtgtgtctcttccattgagagcctacagtttcggcagaaatctattttactcttctggccaattttctcttagtcttgatggttcgtttaaccccccatctttgaggaagaaagttggggaaggagggggagtacacggaaggcatttggggctaccagcacctagccagtttatttagggcaggctttataactcatccctttacaagctaccattagacataaaaatcaaggctcaaa

SEQ ID NO: 141754 - DNA, 451 bp, Homo sapiens
ttttccaatacaagcagagtgtctgagctagaggtaatgtaagagaatcttaggggccgaaccaaacaagttgaacctctcatcctcggggaagccagcagtgacatgccatcactctcaacaggaaggacccagaggcagcccacaggcctgacttggtgactacattatgacacacccagaaatcaagggctgtggaacactcagctggccatgagcaagactttttttggggtgggggtagttctggactctctcatggcttcaacctgggaggcacatggaaccctcagggtagagggaagcccagggccctcgatggaggccactcacactaggccttgagtgctgtctgaatggtaaaaattaaacagacctgatgcggtggcttatgcctgtaatctgtaatccaagtactttggggggctgaggtggaggatcacttaaggcc

SEQ ID NO: 141755 - DNA, 755 bp, Homo sapiens
acccacgcgtccggacccacgcgtccgcattgacaaactatgatactaatgacataacattttaatgcttttattttgagaaaacagatggcttgtaatctaatctaagaccgtagtttatgttctatgatttcatttcaaggtttttctcttgcattttccttacatggagaacatcaaggctgtaaaaaatcagaaaattttaggttctctcaataggaaaggaagaccattgctacaaaatactttttcagttatagatattaacttaaatgtaggaaaggattaagcttccaaaagagggttaaaattcaacaggacaagttattcacacgccagtacatccattctcataatagaggtatctttcattaaggatggacttcgaaagtaactgaaacacctgtgtgaagggatgtgtgtgcctgtttatggggaaggggttaagagaagaagaaagggattaaaatatcatttctctttatatccagactgaaaacagtcaaaactaatacatttatacataaaagggattctcaaatacaccctgccaaatataatttataaagaagaagaatggcttataaataagtcaaatataataaaattgactcattgcaaagtaataaagctccatctgatagcattgggaataccaacttatgatttcagcaaatatttctgatttcactttagaaacagccttatattcccttaattatcttacctgataaattatctcagtaagtccaaag

SEQ ID NO: 141756 - DNA, 3504 bp, Homo sapiens
cctaagataaattggtaggaacgtgtaaggtaatgttaccactttcctttagtattaaattttttatggttataataattgaagtgtatacgtgcatacacttcacaaccagtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaataagaattttgctgattgtttatatattttacttcatttgagattaaggttcttttaagtagattcaggcgttctttgttccttatcaatttattagcaaatatgacaaatgttttaaaataaatatgtgtactttagttttcacattacttttt

SEQ ID NO: 141757 - DNA, 3348 bp, Homo sapiens
cctaagataaattggtaggaacgtgtaaggtaatgttaccactttcctttagtattaaattttttatggttataataattgaagtgtatacgtgcatacacttcacaaccagtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagtta

SEQ ID NO: 141758 - DNA, 3450 bp, Homo sapiens
cctaagataaattggtaggaacgtgtaaggtaatgttaccactttcctttagtattaaattttttatggttataataattgaagtgtatacgtgcatacacttcacaaccagtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggctttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaataagaattttgctgattgtttatatattttacttcatttgagattaaggttcttttaagtagattcaggcgttctttgttccttatcaatttattagcaaatatgacaaatgttttaaaataaatatgtgtactttagttttcacattacttttt

SEQ ID NO: 141759 - DNA, 468 bp, Homo sapiens
ggcaaggcttgtctcgaactcctgatcccaggcgagccgcctgcctcggcctcctaaagtgctggcattgcaggcgtgagccactgcgccctgcaatgagtctgttttatagtttctctagaattgaaagagttccactcaaaattgagcttctgtttaccatttagtttgagcatgtgacgtgaattattcctccacttgatagtggaaagaaagaggtgcagaggtctgtaattaggctttaggctgcattagagttgggattgattgtggctagcataaactccaatggggatgaggtactaggacattaattttttatttctcagtcaaagaacagaagtcttgagggaaccatagttcacagattcttttctgctgctcattctttaaatctgggactgagggccagagaaaaatgtcctagggcaaaaggcagatagatgttccttacgtacatctgggatg

SEQ ID NO: 141760 - DNA, 419 bp, Homo sapiens
gaaggtaggtatgtaggtaaggataggtgcatcttcatcagaccccagaaaccgcgaaattgagtacttacttaaaatggcacagatatgattgaaattagaatccaattctccaagatcacaataagtgctccatacaaccaccaccacaatcacaaccacgacaaaatggtctaattatgtggatggattactgtgaaagcagttctagctcatggtgacagatctgtttcaagggtctgtcacagtgcacagctaagaatgacaaatttgtaggagcactaagccatcatttcatggtgtaaaagccattactcacactcaatcattactggccagagttttggaggaatgccaagcacaaaaaatagaagttcttgaacttcacaatagtgaattaaaattccatagaacagccc

SEQ ID NO: 141761 - DNA, 304 bp, Homo sapiens
aatttttttatatttttagtagagacggggtttcaccatgttagccaggatggtctcgatctcctgacctcgtgattcgcctgcctcggcctcccaaagtgctgggattacaggcatgagccaccgtgcccggctggggttgtccttttcttaataatatatgaatactctttgtcagttaagaaattaattagaactatgtctgtcatatgtgtggcaaatattttcctagttgactttctgtcttttatcattgtgtgtgtgtcggctttttttcatctatagctgctttagaatttttata

SEQ ID NO: 141762 - DNA, 206 bp, Homo sapiens
ctagacacagggaacggtgttcttgaatgtgggaacattctgagtaggaaggtgtaaataattctctattagagagagctttttatacctttggtcttagctttttcctttatctgcctccatatttctgtttttagtccagattttcttatctctatcctgtacaggcattacattatagagtgatatattaatgtggtagattg

SEQ ID NO: 141763 - DNA, 149 bp, Homo sapiens
cattccaccagtctctgaaaggggtgactcatggccctttgcagaagcacttgttgatagtacaggcttccctccctgacattccagtggcaaatcaaccctttgctggcctgactaaatttatagtgggctggccccagcagctggtg

SEQ ID NO: 141764 - DNA, 220 bp, Homo sapiens
tgtaccgtagggagtgatctccagaatatgtcttgagttgaaaaatacaaagtagagattcaacctgagaaagctgattgaagaaaataaaaaaataaaaatgaaaaaaaatgcaaagtagagaaaagtatatatggcatgctgctgttaatcgaagaaaggaggaaagggaccaggatgaatatgcacatgtgtgtgtgatttgttacatatatatgtg

SEQ ID NO: 141765 - DNA, 524 bp, Homo sapiens
tctactttaacaaaaacagattttcttattttatgagcttacacctctctcatgttcacataccaaagagctataactacatccatgactacaaaattgatcccaaaccagacaaaatgcaagaaacagaagcatcagctactctggtctaaatgttgtatgaaaatcttgttggctgattcaagtgggagaaaagcttgaagttataagcatcattttgactgttttatacccagttgcacaatcaaaaagtgcctcatttatcagtccctgctctcaacacaacaaacagatgcttgtaatttgaattgtatgactctggtatcaccaccagacactagatccttgaaagcactttaacccttgatagttaaaataggatatttatctccctgcccccaaagaattccatgtcttaaatgtaaagtcagaatttacaatgcagtagaatccttggggtagggctaggatccacaaaacagactcccaggaactagacagtgaactaactgaaggattatcat

SEQ ID NO: 141766 - DNA, 515 bp, Homo sapiens
ggaactcgtagaggcggcccacgcgctggaacagcaggatagctggtgctcatacacttcctgaggcagcgcccgatgaacacctctgacccagccggcggcgggctgcccacccagcctgggggtggcccgccatacttcctctgcccgttcacctgcaccaggcgatgcctgtctgcctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagccttggaggttgaggctgcaatgagccatgatcataccactgcactccagcctaggcgacagagtgaggcccatgtcaaaaaaaaaaattatccccaacatttagcagcttaaaacaaaaaacatttattat

SEQ ID NO: 141767 - DNA, 452 bp, Homo sapiens
ggcacgaggcctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactct

SEQ ID NO: 141768 - DNA, 386 bp, Homo sapiens
gtctctcagcatcacttttcttttctcatcagtaaaatgaacgtgtgtgaccagaccccggggtttctccacctccagatagtcttgtatggccccggtggttctttcctgatcttcgtaccgcctgtactgtgatttacttcctatttaacatttcaactctctttttaaaagtttgaatacttttaaactttttattttgaggggactttagacttacaaaagagttccaaaaatggtacagtttccctgtatccttctctccctttccctgcagtgaacatcttacccagccatgggaccagtaccacaatgaaggagttaacgctggtgccgggctgctgactaaactacaggctttattcaaatgtatttaaccagtgttc

SEQ ID NO: 141769 - DNA, 841 bp, Homo sapiens
acccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccgcccgtgtcattggcaaagctggtctcatgaaaaccatttcctaaaaaagggcagcgaaagggtcgcattcttgtgcgaactgatctgtcaagatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcctccgacttgctcagccacagtcaggatctagtctggtctttctctgttgacctttttgtgtggcaggagtgggttttcctgttccccaggccctctaatatttccagacataaattccaggaatcccatgcttccctcttgaggggccatttcagcctcaggaaaggccttcagagacttagaaggaatgtcgtgttccaaggaatgaagaggcagccttgatgtgccgtgtttgtcaggactggccttgggaaaggtgaaataggacatatttttgcctttttttctgcaactcttttctcttgacttttactgaggtggtccaagccc

SEQ ID NO: 141770 - DNA, 325 bp, Homo sapiens
cctcctgccaagcatgcgttgttcacttgctggttttacctgtgagcattacaaaggactgaggagtaaaaggaatggcctattgctgagaccaggccaagcctctctagaaagtaacaagattacctgcctctagtggagcgtgccacccctctgcagaccctgatccatcgctgctgtcagcacgtcaagttttagcacctcaagggatcagctcaggtttatttttcagtgacacctgactcttctctttcctagagtacttaaaacttatgccttcaagacactaaaaaccactcaaggatttgagctgaaagagttgcct

SEQ ID NO: 141771 - DNA, 132 bp, Homo sapiens
tatctcctaatcctattatgagggttaaatgcaataatataaaaagcccagcattttaaatgggaaacattatgattctcccaagaaaatttctgtgacatgcttctaacatattttggtggcacttcattt

SEQ ID NO: 141772 - DNA, 304 bp, Homo sapiens
cctggaaaaggtcagatactcttctagcacaggggattgactgaaggtcaaatagcaggagattccagagctacacggaggcagagcttactgccccaaaacacagaacctcggaatctcagaggtggctgtcaccaagtccaattcccacacaattcttgcatcttcaaaacaacatgctgagtgtgcaagtctctgctgacatactcaggtgacgagctcactcccccgggaggtgtcttccactaattaacattcctcagctagaaagttcctccttacattcacttccaatcactttttt

SEQ ID NO: 141773 - DNA, 207 bp, Homo sapiens
aatatacagcaaagaaggcaagagccagggaaggccctagggaagttctggacaagaagttagttcccctcacaactgggcagccccctctctatctccccagcagtgtgtccccctgacttccttgtaccctctggcctttggtttggccaagggcacaccctaccagtccaataaaaccaactcacccaatcacattttccatat

SEQ ID NO: 141774 - DNA, 507 bp, Homo sapiens
tatagctgttctagaggatacccgttcgacggtgtctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacgtatttgtaccagaatctgataggtcagattataattgtacaggaggaactgaggtacttgccaacagtaacagaaacccttcgacggtgttctggtaagcacgaaggtgcttgtgaacagctaagggcatgtgtgtggtggggtttgg

SEQ ID NO: 141775 - DNA, 673 bp, Homo sapiens
ggcagaggcgggcggatgacttgaggtcaggagttctcaaccagcctggccaaaatggtgaaaccccatctctactaaaaacacaaaaattggccgggcgtggtggtgggcacctgtgatcctagctagttgggaggctgaggcaggagaatgaatcgcttgaacccaggaggtggaggttgcagtgagctgagaccgcaccattgcactctagcctgggcgacaagagcaaaactccgtctcaaaataaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaaggcttcagggacacgagaagggacacacagcaagtgtgttccatgtggcacctggcacagagctgggcgcacacgcacaggcacgcaagaacaagggttgtcaggaaattgagctgaggttgcacagaaggcttgtactgcctctcctaacttactgctgagaccccatctgtcaagccaatttctatactcaagagggcagcagagagcaatgaatggccctcattcatttgagatcttcagcaccgggccaataaccaccac

SEQ ID NO: 141776 - DNA, 710 bp, Homo sapiens
ggacgcgtgggctccagcctaggtgacatagcgagactttgtcccccacaccaaataaataaataaataaataaaaaataaaacaggagttcaaactctctaactccctagactttagagaagtttgtttggtgtgtctgggataaatgagagcttcccgcccctgtccccttttgaaacggagtctgcactccagtctgggcgagaagagtgagactgtctccctgctgcccccaccttccccccaaaagtaattatcatcaggtttgagtatgttaaatcagggatgcatcttagaggaggtaaatactatgtttactttttagaggaaatgaatttttgagtggggaagatgggaatgtcttcttcaagatttattgtgggcagcaggaatttaaatcttcataatttgtttatgtacttttactttgatttatgaagtaggagagacagaagatgctgggattacgggcatgagccatctcgcccggcgccattgatttacagacggttaagggttctcttgcccaacatcagttggggaagttagtcttcaaattttacttaactatagccagtttagccaggttgcacacctgtagtcctagctgcttgggagactgaggtgagaagattgcttgagaccaggagttccaggttagcctgggcaacatagtgagaccctgtctcttaaaaaaaaaaaaaaaaaa

SEQ ID NO: 141777 - DNA, 842 bp, Homo sapiens
tctcaaaaaaaaaacaaaaaaacgaaaaacaacaaaacagtctgtggctgggacagcgctgttaaaaaaagtaattattaggctgggcatgatggctgtcgcgtgtaatcccagcacttgtggggccaggacaggcagatcagttcaggagtttgagaccagcctggccaacttggtgaaaccccgtctctactaaaaatacaaaaattagctgggtgtggtggtgtacacttgtaattccagctactcgggaggctgaggcaggagaatcgctggaacccgggagatagaggttgcagtcagtctagatcacagcactgcactccagtctgggcgagaagagtgagactgtctccctgctgcccccaccttccccccaaaagtaattatcatcaggtttgagtatgttaaatcagggatgcatcttagaggaggtaaatactatgtttactttttagaggaaatgaatttttgagtggggaagatgggaatgtcttcttcaagatttattgtgggcagcaggaatttaaatcttcataatttgtttatgtacttttactttgatttatgaagtaggagagacagaagatgctgggattacgggcatgagccatctcgcccggcgccattgatttacagacggttaagggttctcttgcccaacatcagttggggaagttagtcttcaaattttacttaactatagccagtttagccaggttgcacacctgtagtcctagctgcttgggagactgaggtgagaagattgcttgagaccaggagttccaggttagcctgggcaacatagtgagaccctgtctcttaaaaaaaaaaaaaaaaaa

SEQ ID NO: 141778 - DNA, 220 bp, Homo sapiens
attccacctgagggtccattgttgcagccctgttcctggaactagtttgtatgtgtgtgtttgtctttcagattgttagaaaaatagaacccgatgatctcatataattgggggatattgtaagaatgaggcctcagctcttccttcttgctcagccattctgatgcctctctcacctctctgttggcctcttgatctctttctctgtatttcatcttca

SEQ ID NO: 141779 - DNA, 522 bp, Homo sapiens
gataaatttgactatagaaaaataggttcactgagcaacaacccaaagtcaaggtcaaaggacaacatgctggggaaattatctgcagctcataaacaaagggctgattctcctaatatatgaagaactcctatgcattgatgataaaaagaccaagggccgggcacaatagctcacacctgtaatcctagccctttgggaggccgaggtgggtagattgcctgagctcaaggagttgagacccacctggcctacctggtgaaaccctgtctctactaaaatacaaaaaattagccagacatggtggtgcatgcctgtagtcccagctacttgggtggctcaggcaggagaattgcttgaacctgcgaggcgggggttgcagtaagctgagatcatgccactgaactccagcctgggtgactgagcaagattccatctcaataaaaaaaaaaaaaaaaaaaaagaaagaaaaagaaaaaggaaaaaaagaccaagaacatgtattaaaaagtgagcagaaga

SEQ ID NO: 141780 - DNA, 411 bp, Homo sapiens
cagacactgtcagactaaaagcacttaagaggactgcggtataggttttgttctttccaacctcgaaaacttcacatgggtccttctcacctccttcctttctctccagccctgttctgcttcactgtcccgaatctgcttcatactcccctcctccatgaagccccccaaccccccaccaggctcctcaacatggatatctagagtttctagctgctcctttctctgccctttgtgtgtctttctggcatgcaatttgcagtttcagactgggggtgccacaaaatgtggggccatttctcttccttactcatggtttgcctatcccagtatccaaagcatggtccccgacacagagggggctcaaggaagggtaattgacggcatgggctgggggaaacccaggggcag

SEQ ID NO: 141781 - DNA, 858 bp, Homo sapiens
gtcattccaatgtatatcaccacttctttaagcgttttatgtcatgggagacattaaccagtgtctaagaagcacatagaagccagaaataaagatgtatgtgccaatgtttttctttaaaaaaaaaaaaaaaagaattggcaacttacatttgtgtgtgtgtgtgtgtgtgtgtgtgtgtgtgtgagagagagagagagagacagaatgtcattctgttccctatgctgaagtgcactggcatgatcttggcccaccacattctctacctccacagttcaagcaattctcctgcctaagcctcccaagtagctaggattacaggtacctgttaccatgcctggttaattttgtttgtaaatgtaacctgtatttatcagaatctagcaattgaagtaatgtgttcttattgtttctttcagttatgtgttttcattttgcccaagatgaggttacttcgtggtgtggtaaagtgtaccctggtatttatcagaatctagcaattgacagtacaggtgtcttatggtcttctcacaggattatgtgtttcatttgggcccaagacctttgtccagagcagagcctaaagattccttcaaagagtgatagtgaccagtatatgaacctcgtgaaattttggccaatttagagttaaccaaacgcttgtgacagtgtggctggagggtaagtcccacagaggtttatggctcaaccatgttgcagctacccaaaaagatttcaagggacctagcgaacgcccatatttgaatcccgactcacagaataggaaaccctccatttaatgtgaattaaaggcaaccgtgaataaacggcaaccgaataaagacatcaacacat

SEQ ID NO: 141782 - DNA, 567 bp, Homo sapiens
ggaggctgaggcaggagaatcacatgaactcgggaggcggaggttgcagtgatccgagattgtgccactgcactccagcctgggtgacagagcgagactccgtctcaaaaataataataattttaaaaaaagaaactgaggtgctgaaaaatatctagtcccaaaacttgtaagggtcagcgtggaacttgaactcagtttggacccagagttcatgccactaattatccttctataattagtgagtgctatttattctgaaagtacatctactattgaagatcatctactgtgccatccgatatgctatgtcctggggctttgggatcaagtgacactttggttctgccttcttggaacttaagttttagcagaggagaccaaaattacacatagtttcctaaataagtatattaaagtattgttggaagtactttgaagaaatgaggtacgttgtgtgattgaaccagggaggaacatctaggggataatcaggaacaatttttctctgaggagaaagcaaagaaccgaacaatgaatagagttaatttggtccaagaggcagtg

SEQ ID NO: 141783 - DNA, 272 bp, Homo sapiens
gtctaccttgtttatgtccatacttggagggcataccgttcttattaaatgccagcaactcacattttaggcagcagtaaagtcccctagctgtgtccatgcagtgaatctcgttgggctgtaagttagctgcaataaataacattggctctgcactccacttagagaagatgggttcactgtgaatcatgttgttggcggtttggactttaagctgtccaggttgtttatggtggtgtttgccagcatgtagacctctttcaaacaattta

SEQ ID NO: 141784 - DNA, 509 bp, Homo sapiens
aggacttgaataggcacctcaaaagaggaaatttaagtggccaataaatattttatttcagtcatcagagaagtgcaaattattttattatacaccccaaattaagaaccctgataatattagttgttgataagatgtggagcaactggaatgttcttacactgctgttgggaatgtaaattgctgcagccactttggaaaacaacatgacatcagtaaagtagaagataagcagttccactgtcgggtatgttccctaaagatactcgtccacatgcacaccagcatccatataaaaaacatttctatcagcattgttcatgatgaccccactggtctatctagagtagaatggataaaataatcatggtgtaatcagaaattgtaatattaatcagtaatgaaaaggagtgaggaattttcacttaaaaatggttaattttatgctatatgagtttcatttcaattgaaaaaaacaatgaggccaggtgcagtggctcacacctgta

SEQ ID NO: 141785 - DNA, 170 bp, Homo sapiens
tgaggaggaatttcaatggccaaggttttatagatgatcttccctttttctatctttcttactctagctggtcgactcacaaatctatcatcaggcaccactcattgaaatgaataaacacttcctaggtttgaaaggtctgaaaggccagacttgtaaatctaccattt

SEQ ID NO: 141786 - DNA, 130 bp, Homo sapiens
cagtttttatcaatacattttgtagatttttatagactagtacagaagttgccaaactatggcccaccgcttgttttttaaaataaagctgaagtaaataacaacgtcattgagatacgatttatgtgcc

SEQ ID NO: 141787 - DNA, 129 bp, Homo sapiens
aatggggtcagggagaagaggcttttttcatttaatacctttctgtactgttgaaattttctaaccactttcatgtactatgcattctttcttaaaatgaaagtcactgggaactgattatcttgtgga

SEQ ID NO: 141788 - DNA, 406 bp, Homo sapiens
atctcatcccgcacacggagaactaactttcccaaaacacaaaatggctacttatttatttaggcagaagtcacgctctgttatccaggctggagcacagttggtattcataggcacaatcatagcacactacagcgtcaaactcctggactcaagcttttttatttcttcttttctgaattttaagtaacacatttatcgacattctgtgtcccaaactaaactacaaactccctaaaagcagagactgttcttgatcatactaggacatactgtagtacagtatatgctgtcaaatcaaactagttttggttattaatagaaagttataatttcctactttacaacatagtactttcctagaaaacaagctgaaagttaaatatgcaaaagtcaaatgattgac

SEQ ID NO: 141789 - DNA, 755 bp, Homo sapiens
tcatttgtgacatcataggtaaacctggaggcattatgttaagtaaaataagccagacacagaaagacaaataccacatgttctcactcacatgtggcattttagaaagctgctctcatagcaggagacagcagaatggtggttaccagagacttgggtagttaggagagagaggaatggggagatgtggtcagaggattcaccatcaaagataggaggagtaattttttttttttgtgagacagtctcactctgttgcccaggctagagtgcagtggtataatcatggctcactgcaacctccacctcccaggctcaaggaactctcccacctcagcctcccaggactacagtcatgtgccatcacacccagctagttttttgtattttttgtggagatggggtttcaccatgttgcccaggctggtctcgaactccagagctcaagcaatccacccgccttggcctcccaaagtgctgggattacaggcctgagccaccgtgcctggccaggagaagtattatttcttttttaaaattgtccagaatctttgactttcttatcactgaaggtagcaactttctcagtgggccagctctgtgatgtttttctgagacttattcctggaaacactgcctagagcctgctcctccagcccttccaacaatttcataaacacctaactccccacattaaattcctgtttcaacttgctagaagaggctcagttatctgcaattctaccgacacaaac

SEQ ID NO: 141790 - DNA, 408 bp, Homo sapiens
aaaatcacatggatatagaggagagcacatcagttgatggctcagaaaacaggggttctagttcttgcaattccattacatagttttgtcacttggtcccaggacatctattggaagctatctctaagatgctgtataacttgagaagggcactgggatgagtgtgtaatttcacagactttgcgttgccccctggtggtattttaccttagtccaaaactagagctgtggtcactttacaacctgatcctgtgatccagtggtgacctacttcatggataaggattatcctctagggagccaaactttggtgcttttaaccagcagttagttaatagagaagctcagtgaaagtgggacctggaagtttgggaaattagcacatcttagttagaagcaagaagtcac

SEQ ID NO: 141791 - DNA, 688 bp, Homo sapiens
acacatacttggaattttctcgctcttgcagtcctgtttcccaatgactctcctgtgaaagggctaaaagtgctctgctgtaacaggacggcgggcacccccacctgctctctgtactctccagcaaatactagaacggcccattgtagtaaaaactaggagcaactctctactgaagaccttctaggtggcacctattgtgcgaagcaatttctctttgatatttcagatcctttcttcaactctgagcagtgggcttcatcttgaaaatgagagatgagaaaccgtgtcagaaactgtaagaaaaattgcacaagatgacattgttaggaagaggtggctggatttgtctcactccaaaatctgaagtctcaggacttgatacctgcaggagggaagaagccaactcaggccagggctgagagtaggtggagaatatggagtgtatctctgtatttgcctcttccctactctcctcccctccctgggtgctgaaagaatctcaccataacattccctgatttctttgggggatctagagtgttatcagtgggctctttacttaatttttactttcatgtctagatctctgttcatgctcttcttatactttacaacaaatctctccttttttgtcttgaactcttatctccagaatagtgatgacactggttctaggactttcccc

SEQ ID NO: 141792 - DNA, 415 bp, Homo sapiens
gcagggacatacttatgttcaccgctcactgttgggaatgtaaacttgcccacctttatttgaggacaacttcaccatatctttcaaaatcagaaagaacatatgacactggtaaaatgtgcttttaggaatttatcctatacacttagatattccttgtgggagtagatacaacattattcattgcagtgttcgtgccgtaggataaaattagtgccatgatcttccattaggagatgccacaaaatcagagactattcagacagtggaatcacacacatccctagaagagggtgcaaacagtctcactgctgacatcaaaccacctctgagatcttccaggtgcacaaaccaaggctcaggacagcctggacagaccctggttgattctggggacacattttactgtgaattt

SEQ ID NO: 141793 - DNA, 278 bp, Homo sapiens
gatctgctaaagtggatatcaaataaatacccaaacttcttttcttgaggcttgtgtgcccacctggcccattttggtgacaaggaagactaaacagatcaactcgctattcaaaggaagagcatttcaggctatgtgaattgtttcccattttctgctttgaaaatgatcaccataatatttccgcaggtgtctgaagggcatgttcctcaagctaaactactggaacacaaagataggtctccaggtgaaagaacttggagctgattacatagacg

SEQ ID NO: 141794 - DNA, 491 bp, Homo sapiens
gcaggagtgaatgtatgtgaaatgatcaaagaagccaatcaaactgggggaacaggagggacagtagggtggcaagctgctgatcttatgggactaagagggagtgtggcctaaaggaacatgcagacacatcctgaggtctgctggagtctccacaggcctcctgcctgcagaatgcttagcttggtaacacactttattactgatcttcaggacatggtgaggaatggggcaagagtccatggaacagggaccagaagaggtagggtagggtagttgggaggtaggtgtggagaacagtgcaaggagaaggaaccatgcatggtaagggtgacacagcaggatccttgggtgtgtccacgttctagaacctcaactgttgccacatctgtctgtccagacatcctggcagcagtaatgccctgagagcaaagtgccagtgcctaggcctgcttgacacaggactgccagattaaatgcagccccaccag

SEQ ID NO: 141795 - DNA, 299 bp, Homo sapiens
tacagtttgcatttgtcatgtcccttcagtctccttaaatcctaagtaacacttgaaagactctttcaggaccctggcaccattggagattattataggccacctattttgtagaatatccctcaatttggctttagtattttctcttgattagatttaggctacgcatttttagtgagaacagcacagaagtaatggtcatttcttctcattatatcctatcaggtggtacacattatggatgatgttcattttgatcccttgattaaagtagtgtctgccctcctcactctgcttag

SEQ ID NO: 141796 - DNA, 302 bp, Homo sapiens
gagtgaaggtattacagtaacagatggaaggggtggggtgctgataacagacggcagcgtttgaatgtttcagaggtagtagagattggtgacagcaaggcctagggtggtgatcctcaaacttcagtacgcattggaagcacctggagggcttgttaaaacacagactcctggccccagcccacagttcctgattcagcaggtctgaggtggggcctgagacattgcatttctagcaagctcccagatgctgcacttgtggctcagggaccacaagtgaatggaagtactaggtaaggtgg

SEQ ID NO: 141797 - DNA, 385 bp, Homo sapiens
cctgtgtactattcatctttctttccctgaacaccaagcagtgtctgacccatggcagggactctgggaccatctgctgagagctcaagtgagtgaatgaatcaatgaatgaatgaataaatgaatgaatggggtgccctcccttgcaagcagttttggtgtagagaacatgaaataaactttggagtcatattaatttgggttcaaatccaggttttgtcatttactggctattgactttgggcaaactcctcaacttctgtaaatgtgtttctcatatgcaaatagatgtaataaaatcaatgtcaagggctcacaatgcctgtaaagtgcttagtataacacctctaaatgctcaataaattgtaactacttctctcttcac

SEQ ID NO: 141798 - DNA, 592 bp, Homo sapiens
aagtgtctcaaagtcaagtgtctaaaatttgaataaaagaatggtgaagtggaagttccaatccctggaagcttgagcagcagtatgacatccctacatgattgatggtgactccatctcccttggctcagccatccatgatttcacccaggcagttcactgtcccttcatcctggcccagtgcttacctggtgccatccctgtctttagggctcatcaagttcctgcaggagtacacacagaagaaaatgtttccacagccccctgccatgtttccaactctaatttgctcccaaaaagtttcaaaccacagggtcagtacccaggacactgatggggtccattgctagtgggaggggtcattttgtattatagatcagtgctttggtctctccttcatctcttgcatccatgtagaatgcaggccaggtcagtccatttgaatctctcccccacctcactttctatcccacctttatactggaacataggctggggtttgtgctccagatccaggcagcttcaatttagggcagagagaggagaaagtcccatttaaacatctacaaattcactttctccaatctagttt

SEQ ID NO: 141799 - DNA, 281 bp, Homo sapiens
agtagagatgaggtttcactatgttagccaggctggtcttgaatgcctgacctcaggtgatccgcctgcctcagcctcccagagtgctgggattataggcgtgaaccaccatgtcaggctgcctgttcctttttcaaagcaggtgagcacacagcagttttaacaataagctaaagcaagctcttttctaatgagagagttctgttaaataaaggtcaacaagaaaagtaacaacactcattgtctcttgtttacggtccatctgagcatcatgcaaactt

SEQ ID NO: 141800 - DNA, 412 bp, Homo sapiens
gggatggccgtgctgaatcaggatctcaggcacccagcattgttttaggtgagcattccttctttttacagagtggactggcatctttgttagcagcttgttctgtatctttcccacgtgtagcggttcacaatttaaaaacaatcctcgcagtaccaaaaactgatttcagagggttctagaaagatagtggggcaggaagaccaggaattcatctcctcacctagacaacagttccactggcagaatctgtctgatgtaactattttggaactctggagtctactgaaggtttgcaacttctaggcgggaagctgggacggttaatttcagtcagtttcagctctgctgcccactgccttcctcagccctgtggtgcagggtgtgcggtgttcctggaacagtgtgcgtg

SEQ ID NO: 141801 - DNA, 177 bp, Homo sapiens
tttcttcctcctccaggctgcccctgcttgtctccaacctctgtgttcctaatctcacttgcttctctcaaaatgttcctgtctcacattcctttcctgggtttgatagataaggggcactagctagttagggagatggattactccacaggttaaagtgacttagagaaagtcact

SEQ ID NO: 141802 - DNA, 904 bp, Homo sapiens
ctcggcacttttaactgatttacacattgactttttattttttttgagacggagtcaagtgattctcttgtctcagcctcccatgtagctgggactacaggtgtgtgccaccacgcccagctaatttttgtatttttagtagagatggggttttgccatgttggcccggctggtctcgaactcctgacctcaagcgatctgcgcacttcagcctctcaaagtgctgggacatttttgaggcaaatactgagcctatggaggaattccggtttagtatttttggcgctctcaatagagaacaccatatttttgtcccttaaatgtaacaatcacaaggacatcttctttgaggaattggaagagaggcctgaagggtagagatttcagataaaaagctgaagagaaagagttaaagaagcatcctcctgaagttactaaatgtatggctcataaatctatgggctctatagggaaagggttaactgccaacttagtaaagctggggaattttagcgtgagcatattagttgaacaatgtgaaaaatcagcaaaactgctgtgccatgagcagcgagtccctgaaataggctctcatttactttccatttcttctgctttccagtctcttctctttgaagcagctcttgattagtttctttttaattgccatttaattgggaaacaaaattagaacacttatttgatatcagtgatgaggtttctctttccattctgctttgatctagttttgaaaaaccaaaagttgaagggagaaattaaaaaggaactaaaaagatttcttatttccaagagctagctgcagctataagccatcaaataaatagggaaagaacgactcttggagaagctgaagaaaaaaacaaaaacaagtaaggctagcttt

SEQ ID NO: 141803 - DNA, 781 bp, Homo sapiens
tgagagctgattcttgaggatccacggacgcgttgctatggcccggctggtctcgaactcctgacctcaagcgatctgcgcacttcagcctctcaaagtgctgggacatttttgaggcaaatactgagcctatggaggaattccggtttagtatttttggcgctctcaatagagaacaccatatttttgtcccttaaatgtaacaatcacaaggacatcttctttgaggaattggaagagaggcctgaagggtagagatttcagataaaaagctgaagagaaagagttaaagaagcatcctcctgaagttactaaatgtatggctcataaatctatgggctctatagggaaagggttaactgccaacttagtaaagctggggaattttagcgtgagcatattagttgaacaatgtgaaaaatcagcaaaactgctgtgccatgagcagcgagtccctgaaataggctctcatttactttccatttcttctgctttccagtctcttctctttgaagcagctcttgattagtttctttttaattgccatttaattgggaaacaaaattagaacacttatttgatatcagtgatgaggtttctctttccattctgctttgatctagttttgaaaaaccaaaagttgaagggagaaattaaaaaggaactaaaaagatttcttatttccaagagctagctgcagctataagccatcaaataaatagggaaagaacgactcttggagaagctgaagaaaaaaacaaaaacaagtaaggctagcttt

SEQ ID NO: 141804 - DNA, 373 bp, Homo sapiens
ctggtctacaaactcctgacctcggcctcccaaagtgctgggattacaggtgtgagccagcacgcccagccgaaacgaaccacttttccactgaagtaaggaagcacaatccatcccacaagtgcagggtgttctgaatttatgaggtgttaccgctcacgttctgtccgatcagaattatctttagaaatgactaatcttggctgggtgcggtggctcagggatggccgggtgcagtggctcacgcctgtaatcccagcactttaggaacccctcacctgaggtcaggagttcgagaccagcctggccaacatggtgaaatcccatccccactgcctgcctggggagtggccatgcaggcatgggcctgagg

SEQ ID NO: 141805 - DNA, 473 bp, Homo sapiens
aaagaaagagggataggacagaaggagagggaggagataggagagagggaggagaagaaatagagagggagagggaggctcagaacacaaacacagctccagatagaatatttggtcctatggaacgctgtggctccatttgttcgggtgtctgacccggatccagcaccaaggtttgtccaggactgctccatgcactgtgctgacctgtgaccaacaccaggcagccgggctcggagactgagattctcctgcctttcttccccatctccctgcaggggcactcaagctgaccttggccttcacagtggcccggggctggtcatttgcaggggcagcatctctgcctttccctgttgtcaaggggcagctctcagggatgcaggcctcccctcagtaatgagaggctaacgagagtgaccagtgatgtttctcccatctcagccccgggtagaccttgaggttgacccctt

SEQ ID NO: 141806 - DNA, 316 bp, Homo sapiens
accactttctcactgataaatatttatgttatgatataaaaatccttatttgattgggctgccaatgattctcagtgagctaaatattttttataacagctgaatgtcttctctctcttgcaggtagctttggtgttcctgatgagtgtgctgttaaagaaagctgtcctcaccaatttggttgtgtttctccttaccctcttttggggatgtctgggattcactgtattttatgaacaacttccttcatctctggagtggattttgaatatttgtagcccttttgcctttactactggaatgattcaggtaagag

SEQ ID NO: 141807 - DNA, 159 bp, Homo sapiens
ccatataacaaccagcttgagacaccttttcactatgtacaaagtaagtccaaaatctttcattctggcctgctttatgctctacttcatgatttgttctcattcagcccaggtctatgatgactttaaaggctcatttcacaacttggggtctgtcgc

SEQ ID NO: 141808 - DNA, 133 bp, Homo sapiens
atgggaggccagagtggtttaggacagaagttattaatttggtaatggccaagctgagtttatggtgacagccctatgagggtgtcctaaaggtcactgaactagatcagggctagagttctaagtgcaaagt

SEQ ID NO: 141809 - DNA, 429 bp, Homo sapiens
agtaactcagcactttgggaggctgaggtgggaggatcgcttaagcccaggagtttaaaactagcctgggcaacatagggagacaccatctctacaaaaaatttaatttgccagccatggtggtatgtgctataatatcagctacttggggggctgaggtgggaggatcactggaccccgggaagtcaaggctgcattgagctgtgatcaagtatgtactccagcctgtgcaacagaatgagaccttgaaaataaaaagaagaaagaaagaaagaaagaaagaaagaaagaaagaaagaaagaaagaaagaaagaaagaaagaaaagaaagaaaaagaaagagagaaagaaagaaagaaaaagaaagaaagaaaagaaagaaagaaaaagaaagaaagagaaagaaagaaaaagaaagaaagaaaaaga

SEQ ID NO: 141810 - DNA, 421 bp, Homo sapiens
tgtgccctgggcacccagtttcagaaatgagtaaaacaccggccttgccttcaaggaactcaagagaccctgcggcagccacagtcttacagagcaattaccaccctgggttgcaagagcctaacgtagggtggggacaggggaggtacaaaatgctatcagagctggagacgaaagtctctaatactcggagtggggctgtgaaggtgactttaaagttgtgccttgaaggaggccaggagcgcaccaggacaaggccatgggaaccgccggtgcaaagcagggagacctggaacagcaggctggtggggaccagtgactgaacagcacagcgtgaacccaaagagtgtttggcttaagggtggggagagctgagccgactccctgaactgctaggacttaaacctgagaaggcccagca

SEQ ID NO: 141811 - DNA, 446 bp, Homo sapiens
attgaacttctttaaccctaactttcatcctctccacactctcttttgccttcaaataaaccatctgctctctctggaacaatgttccttgccttctttgctgaactagctccaattcatcaaacttcaggttagtagacattcactcagataagaagaccttttctttttttttcttttttctttttgagacagggtctcgctctgtcacccaggctggagtgcagtggcatgatctcagctcactgcaacctccacctcctgggctcaagccatcctccacctcagctcccaggtagctggcaccacaggcatgtgccaccatgcctagctatttttttgtatttttggtagagatgcggttttgctatgttgccctgggtggtcttgaactcctgagctcaagcaacccacccgccttggcctcccaaagtgtgggattacag

SEQ ID NO: 141812 - DNA, 269 bp, Homo sapiens
ctaatttgaaatattaagccagttcctgactgaccttatcctcgccaccctactggcctcaatttctcccatctggcctgatttctaagaaacccacatatgctttgcaaaaaatgctccacttcatatttcttaccaatgtgttgtaggaacctaccaagctggaaataatatgcagagataaacgtgtttaaagacagactattctccaaaatagtctcatttttttgcctaacttattatgtattttctgtcacttttaataaatt

SEQ ID NO: 141813 - DNA, 272 bp, Homo sapiens
acaaatagcaagtggtccctgacttatgagggttagacttaagattttttgactttacgatgtgggaaagcaatacagtttcagtgtgctcctcaatttattatgggggatatatctggataagcctataagttgaaaatattgttaagtaaaaaacatactattttcaatttacaacaatgggtttatctggatgtaaccccaatgtaagttgaggaacatctgtaatggatgaggtgataaaattattctctatcttgatgaaggtagag

SEQ ID NO: 141814 - DNA, 549 bp, Homo sapiens
gaacctgggaggtggaggttgtagtgagcctaagggaggagaccacccctcatattgtcttatgcccaatttctgcctccaaagaaagaaaaagtaaaaactaaaaggcagaaatgaaatccacaagcagacagcccggggccacaccctggacctggtagttaaagatggacccctgacctaattggttatgttatctatagattccagacattgtatagaaaagcactgtgaaaatccctatcctgttttgttacgacctaattaccggtgcatgcagcccccagtcacgtaccccctgcttgctcaatcgatcacgaccctctcacgcacacccccttagagttgtgagcccttaaaagggacagaaattgctcactcggggagctcggcttttgagacaggagtcttgccgatgcccccagccgaataaaccccttccttctttaactcggagtctgaggagttttgtctgtggctcgtcgtactacaagccaagatggtgccattgcactccagcctgggcaacaagagcaaaactctatctca

SEQ ID NO: 141815 - DNA, 296 bp, Homo sapiens
aataccccttctccttgcttcctcagtagcagaatcccaggcagttgcccagctcagaggctatgttgcctccctgcatttgcggggaggtgtgccgccacgactgaagctggcaggggagaccaatgtggaagtgcggtgtgggcttctgaaaagttgtctcgaaagtgaaaaggcagccgggcgcagcgactcatacctgtaatcccagcattttgggaggccaaggcgggcagatcactgaaggttgggagttcaagaccagcctggccaacatggtgaatccctgtttctac

SEQ ID NO: 141816 - DNA, 340 bp, Homo sapiens
gtggcttctgcccgagacggccgtttttcccgttataagagggggaagatgaaaatggccgctgcgtccccgcggtgttgggggaggggagcgatatcttatttcggcgttgctctcctgcgaaggtccgccgcagccatcttgggctggcgggctgggcgagctgccagaggcacaaaatggcggagaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacgga

SEQ ID NO: 141817 - DNA, 663 bp, Homo sapiens
gctggagtgcagtgacacgttcacagctcactgcagcctccacgtcctgtgcttaagcgatcctcccacctcagcctctcgagtagctgggaccacaggtgcgagcccctacacctggataatttttgtatttttagtagagacagggtttcacctggtcttaaactcttggattcaagcgatcctcccaccttggcctttcaagatgctgggattacagacatgagccaccgtgcctcgccacagccaggatttgaacaaacttggtattcaccaccacattctttgcctctattccaaaaagatgcttcatcagatccttcctgggagcctcacattcaagggtctgacttgtgagacccttgggaaaaaatgggcatgtttgaccatatttaacacagagtttcccaaagttttggattagaaagctcggccgggctcggtggctcactcctgtaatcccagcactttgggaggccgaggcaggcagatgacctgagtttgggagtttgagaccagcctgaccaacatggagaaagcccatctctactaaaaatacaaaattagctgagggtggtgacgcatgcctgtaatcccagctactcgggaggctgaggcagagaattgcttgaatccgggaggcggaggtggcggtgagccgag

SEQ ID NO: 141818 - DNA, 256 bp, Homo sapiens
aactcctggactcaagcagtcctcctcctttggcttcccaaagtgctgggattacaggcatgagctactgtgcctagcaagcctgcattcttaacaccacattaaaagagagaagagacttagcttagaggtctgggcaattctaatagttacagataggatagagaaggtagagctggcacaggaaatgggaaaggaatgattagagaggcaggaaggaaccatgccaggccagagtgttccaggtaggctgcca

SEQ ID NO: 141819 - DNA, 261 bp, Homo sapiens
ggatggtcgttctagaggatcccttacagaagaaagtttgctgactccaggtttagatgacaaagaactttcaagaatctgtactgaggaagcaaaaatgggcttaagtacaataggccctgccttaaagtagagagaccggtcaaacgtaagccccagcgccaaaaaagacaaggtctcactcatcaatccccatcttacaatcaagaggcagaacttaaatcacttaaagctgttttttcagatttgagcagtaaaata

SEQ ID NO: 141820 - DNA, 424 bp, Homo sapiens
tgtttccactgcaacatcttccctcaggaagtggctcagaactctttaagatgttcttggaagaacatggtttgtcattacagtaacatcagaggccacatgtgtcattatgcaaacttgtatctctattattaactgtgttgattggaaatgtttttcccaagtaccataacagcattttgactttttatagtaatcttgttgaaaagatgtggtcttcaaaatgacccacctagttagagcccacagatgggatttctgttaaaagattctgtttgggagggatagataaatgaggtctggcaaagagacagagatcccgtgttgaattaccagtgagttaggaacaaagacaatgttttctctctccctttcttagatgtgatgtttccaagaaaagaaatttcaggtggggaggacagag

SEQ ID NO: 141821 - DNA, 400 bp, Homo sapiens
ccagcagaaatgcttatctgatctctgcgagaacaggaagcagctcagtgggggccttccttgctaaattcttcatcaagctggtctgttatctgccctgagtcctgcaaaaacatctcaagaaaaatcccaaaaacatgcaagacaaatgagggtcctcccttagcatgtcttgaagcactgaggcacctgaaagttacatatagtttccggggaaacagttttttaggaaatgtagcacagacactaactattcttccagaagagccccttcctgacatgaaagatcttacttagcatgacagagaagcatctgattcatcatgaggacctatccagccagcagcaggggccccagtgccagtgtccacctcaacagaggagacacgggggacatgca

SEQ ID NO: 141822 - DNA, 336 bp, Homo sapiens
tgtgtgggctgagtccagagaaaatgttacacctggctaacctataacaagaaccacctttttaaaaaaaattggaattgcctctaagagaaaaagcgaaggcttagagagtatgactgagtttagcacttcaaaagtggaagagctaacaatatgcattgtaagtattatttgttgtttttgccctgactcctttaaaaagtagatatgaggacttagaaaagagatgccaagagtttgtgcctcacttcctatatccacaaaataagaatagtcacatatgccccctacaattattcagtgtgatgctgcagggccagctgcaccgccacctcc

SEQ ID NO: 141823 - DNA, 439 bp, Homo sapiens
ttgtgaagagagtattcatattccatctccaattaactcaaaatgttggctaaagcttcaacatagagtcattctaattaaaactgctattcctgatgtggtagctttaccattggcatgattcttggcactggggataatgcttcctctctggcataaattgttttctctataactgtaaacagagaatatcaggcacaatttttctttcatatgtcagttacaagagttaaagattctcattgtattctgggtttaagtaatttctcagcatctgtgctacaatttattttacaaggacgtagatcatctcactgtgccacaggacatattttgttaatgacatactctgaaaaatatgaaatgtgaaatatgtaaaaaaacacgactagcaggtattctagcttctggcctataccttaagtatgcatgaggactg

SEQ ID NO: 141824 - DNA, 259 bp, Homo sapiens
tccctcaaaccttctagaacagtagtgcctatatattgtaaagaccgtgtccttgactatgggtaacttcttgcccaccccttctcccagcctccgggcctgggaggagccctcatatacttttgtttttaaagactgatttggctgggcacggtggctcacgcctgtaaccccagcactttgggaggttgaagtgggcagatcacctgaggcaggagaatcgcttgaacctggcaggcagaggttgcggtgagccaag

SEQ ID NO: 141825 - DNA, 297 bp, Homo sapiens
gggtttggtccttcagactctgcatctgtccggtcactgatggtcacaaccagcagttccttaaaaacctgaaattgggccgggtgcagtggctcatgcctgtaatcgcagcactttggaggctaaggcagtaggattgcttgaggccaggattttgacaccagcctgggcaacatagtgaggccgtctttaccaaaaactttttttttaatttattgatggaaacagtctcactcttatcaccatggctggagtgcagtggcgcgatcttggctcactgtaacctccacctcccta

SEQ ID NO: 141826 - DNA, 317 bp, Homo sapiens
atgatatgtagtaaaagggttttacaaattgtgaagtgctatatgaatgataaatattgtgtgaaagtcattggaattcctagtagaagaaggtctttggagataattatgaatatcaatgaaattatctcatggaacaccaacatctcacaaaattctatacccaaaggttttgagggagttcacgtcaccacaagcaaaggaagaaaggcatatcttaaagtctatgtcttctgtttagacattatcccaaatgtcccactgaactaaatgtaaacttctcagaatgccttaactgattctctttaccgctacta

SEQ ID NO: 141827 - DNA, 437 bp, Homo sapiens
ggctctgcagcttatgctggttctcatttaatcttcaagtgtaacagatgaggaaacaggcttgtggatggaggaggagctcaaggtcattctgctggtggtgctggctcagaccaggcctgccgctgtcccccagcgcttccctgggtcctcagcctgtgcagatgtggtggccgtgctgtcacagcattagttcaagtcagtcttttgataggtaccactcggatggccagcctgccttggcagctttattccaggcgcgctcccaaatcctcaggttattttcactggtgaatcttgatactgcagacagcggggtcggagatttaagcacaggatttgactgatgaccctttcctcttctagctaaaatagatttccagggagccagaggctccttcctggaagtcagggggcttccagtagcaggttattga

SEQ ID NO: 141828 - DNA, 266 bp, Homo sapiens
ggctctgcagcttatgctggttctcatttaatcttcaagtgtaacagatgaggaaacaggcttgtggacaattaatatttttatactttgcattgaacatattcctaaaaggacagcagctcttgtctgcctgaaccaactatcagaaagaagagcaaggtggaggctgacctggagcatccacaacctcctgaagccacggtcaacccacaagccacaggtcaacccacaagccacggtcaacccacaagccacggtcaacccac

SEQ ID NO: 141829 - DNA, 286 bp, Homo sapiens
ggatctagagaaaactgaacagtcaaaggtttgaagttcaaaagagatcaaagaattacactgggagttgtgttttaaaaaaacacgaaggaggaggaggtgggggagagagagaaagagggagagacagaaagagagagaggaagagaaagaaggaaagaaagaaaaagaaagaaagaaagaaagaaagaaagaaagaaagaaagaaagaaagaaagaaaagaaagaaagaaagaaaaaaaagaaaagagaaaagaaaagagggaaggaaggagggaaggaggga

SEQ ID NO: 141830 - DNA, 145 bp, Homo sapiens
gaagaagcagagatttattgaggatcaaaaatattcctaatgcacccggacatttccttatcgctggcgttggtggttcttcaagtcagggaaggtatggactccccagaccacacataccaggagctctgcaatgagctaggat

SEQ ID NO: 141831 - DNA, 386 bp, Homo sapiens
taactttgaaaccttgggtaacatgaaattgaatcaaaatattttcaagttatggaacatagtgttattaatagaatggagtgttgaaaaagcactggattatgctttctgtaacttttagttctgggtcttatgataactgtgaccctgagcctcagtgttttccttttaatctgtagtgatattttttagttcagtctctcattttaaactgcttttagctctaaaattttatctcagtgacctgttgagttatataacaatcgtatcaggtaacctagataagaagaggaaggcagtaacatttcagaaatacagtttggggttgggaatccttaagtgatccagacttctcctttggtccgaagatagttgtaaatggcgga

SEQ ID NO: 141832 - DNA, 451 bp, Homo sapiens
agcgacaatggcgactcctcaaactggcatttgtcatttggtgagtggactatatttcacttagttcatagccctaatggttcactggtattttagacatatgtcgtaattggcaataactttgtaaggctgaataatactgtatcctatgtttacagcacattttgtttatccactcatctgctgatggacacttgagttgtttctaccttttggtgattgtgaataatgctgctatgaacatgggtgtacaaatatctcttcaagacccagctttcaattttttgtttatagtcccagaaattgagttgctggatcatatagtaattctaactttacgttttaggggggaacttcccatattgttttccacagcagctgcactagattacattcacaacagcagtgcataggtgttctagtttctccacattctcaccaacacttgtta

SEQ ID NO: 141833 - DNA, 462 bp, Homo sapiens
acctgggctgggctacatgacatgatgctactagatgaatggcagtctcatgagtgaatcaaggaactgtaaagatgaatttcaggcctttgtgaaaatggcttacaagtgatccccaatttcaaatgattgtcatttctgtttctgctcagacattctgcatccgaaacagatctgctcatgaatccttgcaagaaaatctaacagagtacagcagagtgttccctttcctggtgagctaatgcccaagaatatccattctagagtccatggtgtgcatggaatgatatttcttggaatttcccagggactgaaacttctccaatgactattcagctgggctctcagaattaggaataaacatgtcagagccagagggtggggtctgaaaatggaaatcctcaagatgagacaatattagttagttggaaagggtgataacttttctctgtccctagttca

SEQ ID NO: 141834 - DNA, 864 bp, Homo sapiens
attacatctatacctaaatattttactttttgaataatcataaatttttttttgaggcaaagtctcactctgtcacccagacgagtgcagtagcaagatctcagctcactgcaacctccacctcctgggttcaagggattctcatgcctcgggctcccaagtggctggaattacaggcatgtgccaccatgcttggctaaattttttgtatttttagtagagatgaggtttcatcatgttggtcaggctggtctcaaactcctggcctcaagtgatctgcccaccttggcctcccaaagtgctgggattacaggcatgagctaccaggtccacggcctgtaaattatttttttttaaataatggttaatatactttaaaagcacataaaccaatttcagttctgtacactttttagataagctgactttttttccctcatcgcaatatttccttaatgagagaagcagcttgctgatttacattctgatgccagcagcttatcctgaactggcattttgaatggctctacttcagaggtccacaaatcctcaaagacaaaacaaaacaaaaccacctcaggctgggtgcggtgactcatacctgtaacgccagcactttgggaggccaaggtgggtggatcacgaggtcaggagatcaagaccattctggctaacacagtgaaaccctgtctctactaaaaacacaaaaattagctgggcgtggcaacaggcgcctgtagtcccagctgctcggggggctgaggcaggagaatcgcttgaacccaggaggcagaggttgcagtgagccgagatcatgccactgcactccagcctgggcaacagagcgagactcagtctcaaaaa

SEQ ID NO: 141835 - DNA, 348 bp, Homo sapiens
ggggttggggagccctgggaccgagcagagctccctggcacctctttacggtccgcgtcctggaaccacgagcgctcctaggccactatctaaggtcaggatcaggttttagtcccttaatctttagccaaaccgtggtacgataccagacatcgccaggaccatccctgaggcctaatgtgcagtgcccggtgcccatgccaagctggtgcaatggcacttctgcgccaagctggtgcaatggcacttctgctcggctctggaggtccatctttcctcctaaccttcccctgacccttccggcggtggcaggaggagtgagtgctctcggaaatcaaattcactgtg

SEQ ID NO: 141836 - DNA, 439 bp, Homo sapiens
ggtcaagagttcgagaccagccaggccaacatggtgaaaccccatctctatcaaaaaaagtacaaaaaattcactgggcatggtggtgggcacctgtaatcccagctacttggaaggttgaggcaggagaatcacttgaacccaggaggcagaggttgcagtgagctgagatcacgccactgcattccagcccggtgacagtgtgagactccatctcaaaaaaataaaaaagaaaagaaaagaaaagttagccaggtatggtggcatgcatttgtgatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggat

SEQ ID NO: 141837 - DNA, 122 bp, Homo sapiens
ccacaatgaaataccacttcacacccactaggatggctataatttaaaacaatggaaaatggcaaaagttggcaaggctaggaagaaataagaacattcatatgttgcaggtaggaatgtaa

SEQ ID NO: 141838 - DNA, 466 bp, Homo sapiens
tgatagtcaccatctctgaggatttttaggaaagctccaaattgcccttggttctaatgagcaagaaaagggtcttctctgtataagctctggtatcctctattttaaaacaaccacgttgggtataccaggctacaaacacatgcttgtttaatgagatccatagtaagataacctttctgaaagaaagtcattgattctattgggtaaatatcctcaacttccacaggcagtaccctgaaatcttgggaatggagaaaccattctagatcagctcctagatactcctaagaggggtcaactggtgtttgatcctgcctgtggggaagcagcatggccaaactcatttaaacatctgcgtaactggagctaggatgatgcatagcacatatgtcactaggaatgagaaaggaaaaagctttgggaaagtagctaagcagaggatgcttcttaaaaaatgtcaaaa

SEQ ID NO: 141839 - DNA, 246 bp, Homo sapiens
cgctgtgcaagtatgcctggtgttgccaccacgactactggaattatgggtattctgctgacaccctgcctctccttagctgcctcggtttctcaggccctctcttttcccacattcttcttaactctagcaatttttattgtcacctccttgagccccaatccctgcctcggctctcaggcctggacctaacaggtacagatgtggtgagcccctatccaaggtccagacctgagcaagccaggt

SEQ ID NO: 141840 - DNA, 211 bp, Homo sapiens
agggactcttaaatggtaattttggtgagttggtaaatttggtgggactctgagtgtagactagcttgagaattaagaactcttttctgcagacaaaccagaccagaatttcattttaaggacagagccttgggagccgattattttgattaaaatccctgctcatctataaaatggttaataataatacctaatttataaagtttagagg

SEQ ID NO: 141841 - DNA, 653 bp, Homo sapiens
cactgccatatgagatgtgcctttcattttccaccatgatcgtgaggaactgtaagtccaataaacctctttcttttgtaaattgcctagtctcaggtatgtctttatcagcagtgtgaaaatggacgaatacaatgattattactaaaaacattttgttgtaaatggggtatgtgtgataaaaaggaacccactctgagcgtgaagtacattgggcacccactgcagatgctcagacatgcctcatggatatcagcagaggaaatgcttcctggctgcctgctaccttcaggggactgtgctgagtgacttgcagacattgtctcatctaatcctcagaaaaacatcattttagaaatgagaaaacagctaagagagccattcacttgcaagaggagaagctgagacttgaacccatgctaagaccgttcattcactgtcatctctcagaaaggccttggtttgttgaaagtgatgcgttttgatcctgcctgcccagagcaggcaagggcaagattcctggatgcaacttctctgctgaagagaacattatcggctcctgagctcggactgagacacgcatgctgactctccccactggctccccttggatgccttcctccggccccatctgtacccctgcaaaggcaaga

SEQ ID NO: 141842 - DNA, 412 bp, Homo sapiens
gcctccccggctcacgccattctcctgcctcagcctcccgagtagctgggactacaggcgcccgccaccacgcctggctaattttttgtatttttagtagagacggggtttcactgtgttagccaggatggtctcgatctcctgacctcatgagaatccctttattactatattataaccataaaatggtagcagtaggttcttacctgtcaataatcaccttgaatgtaaataggttaaattctccaatgaaataaaggggctgaatggattaaaaaataagatccaactatatgctgcctgtaggagactctcttcaccatctttaaggacacacataaactgagagtgaagagatggaagaagatattcaacacaaattgaaaccaaaagagagcaggggtagctatac

SEQ ID NO: 141843 - DNA, 578 bp, Homo sapiens
tcatacagtatctatatatggtggctaaaacataaacagtctgtgaaatgcaatggctcatagaagagcaagactcccagcattgcccagagcaggtctaaagatccagtgaacacctccaccacaccagaccacactcacatactcagctgtgccctcaagtgctctttcatcctgagaccaaccacctgagccccagatctgagattaagcacaggggtttgtcacgcgttctgatgcagatgaggcgtaccacaccctggaaagttgacacaaccaccacagagggttaagctgtgacccgaagctcaaaaatcaggtcctggtcgaagacctctaagaaactgatgcagcaatgataacttgcttcacacaaggaggagctggtatcacctgatcctaattttgggcatatcatgtggaccaagggacctggtcaatgtcacaggctcaggatgacagaggactgcatgccagctttccctgaaccctgctgtcagggtggcatgccctctctgagagctttcagggccatgaatctctccaaagccatttctagtttcagtcaatgaccagct

SEQ ID NO: 141844 - DNA, 1683 bp, Homo sapiens
tagcctgaaaagccacctcagattcagccaacaaagattgctgatttgctccttaagcaagagattcactgctgctcagcatggctcagaccaactcatgcttcatgctgatctcctgcctgatgttcctgtctctgagccaaggaggcccatgctgagttgcccaaggcccagatcagctgcccagaaggcaccagtgcctaaggctcccactgctactactttaatgaagagcatgagacctgggtttatgcagatctctactgccagaacatgaattcaggtaacctggtgtctgtgctcacccaggctgagggtgcctttgtggcttcgctgattaaagagagtggcaccaaggatagcaatgtctggattggcctccatgacccccaccggatcagtctgctgcatcttctacctcctgattatcaggttccagagggtctgatgtctggcacctcaagcatcagtttttactatattatgataaaagcaacctctctataaatcatataatgtaaaggatatcaaggttctccataggttcttcgagataagcttaaagctgaatttcctgtgtgtttcaggcattcacagataaactcattctctgtacttctagggtagcatctttatgtatctattatgtacctcttatctattgtgttatcatctctgttatagaagagccttctgtagaccatatagaaaaagattatagaggaggagaatctactgctggcaattgggaaccgcaaggtatactaaataatatatcaacaactaatggccatctaatgctatgctggatatgaacttttggggcctcaggaaagaaaaaccaggaactagtttcaataatgaggtgtcatggttccctgtggcaaatttagaacacttatcgtttggcaggacacagagaggtaggtgaacattccaggaaagaagcagcttagagaaaatgtggaggaaataatatgacacttagagaaaaaggaaggtttattcttgtcttatgtcttgacctgtttctgagtgcgaacacaaaccaggtgtttctgtctctttctgagtcacgtctgcccctgttctggcccttccccatctagaactgccattatcagtggagtagtgggtccctggtctcctacaaatcctgggacattggatccccaagctgtgccaatactgcctactgtgctagcctgacttcaagctcaggtgagaggcacagaatccacacacttattgccatcctctcctatttatctctgaggatcgaccggggactgggatagaggaagggtgagctcctcattcaggaaatagaggagtgtttcctctttatttttgctgagtcctgcagccaggagggtaatacactctgatcccctcagtctgaatcttctcattgtcttataggattcaagaaatggaaggatgattcttgtaaggagaagttctcctttgtttgcaagttcaaatactggaggcaattgtaaaatggacgtctagaattggtctaccagttactatggagtaaaagaattaaactggaccatctctctccatatcaatctggaccatctctcctctgctaaatttgcatgactgatctttagtatctttacctacctcaatttctggagccctaaacaataaaaataaacatgtttcccccat

SEQ ID NO: 141845 - DNA, 506 bp, Homo sapiens
tggttatatgagtttgtgaaattacaaacctaatttctgggtggtgtcaaagatgggattacctgaaacggattcccacgttgctttgtgatttggtgattatggttcttgacttctctaagagaggaataaaagtgccacactcactaatgaccaaattggtcagttccactcatatgccccctatagcctctttaccatctagcctttccagagttaacctattgtaaaattagattgtaaaaatggacagagtggccaccactctgggataagggtgaaggactcatggtgtcatccccactaaatactccagtggaaattatcacttaattatttgtgatatcacccagctccccaaagagctggccttccttttcagccccagttatcttttggaagtgtaactctttcagtttgattgtcctgggaacacatgcagttttctcttgatggggaaacccctctctgaaggtctgcgttttaagtggcagagatgcaaaaac

SEQ ID NO: 141846 - DNA, 584 bp, Homo sapiens
aagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttc

SEQ ID NO: 141847 - DNA, 131 bp, Homo sapiens
gaggaggggtggtggtggagcaacagggagataataaaagtcactgagccagcgagaatagcagaactgcatttcagagacattgctctgcagccctgtgaataggagttgtaacattattattattatta

SEQ ID NO: 141848 - DNA, 488 bp, Homo sapiens
gataggagtgctgcttcctcatgctgcattccagaatcctttctagatgccttcaagatttatacccttaaagttggaaacctggggggcaccttgtgcccaaacagcgctaaattccaggtaacacatctccattcacaacctattgtgcgtagaccctcctggacactgctattgaccgttgactgattatgtgatcaaagattgatgaatctggaagcactggagggatagcaaaggctttcatttttttgtttgtctttttaaatcctgttccatgttccactttgaactggattgaagtcagcagtgaaatcaggagtgtggaagctgtggtaccagaggagagaaccagtgagagagacttggcttatagcaatcagtccagctccagtcagataaaggagacaccagtgagggagtgaacagaatggtagagaacaacccagctgagattccagcatccttttcttctatcatcagataca

SEQ ID NO: 141849 - DNA, 256 bp, Homo sapiens
cctgcaaaatgggcaggaacatctgagcacatgtctttgtgtagacatgattttatcactaagtgggtgtcagatattgtcaaatacttttctctgtctatgaagatgatgatatagttccggtcctctattatattaacagggtggattaccttgactgaaatttgaatgttaagccaatcttgcattcctagaataaatgtcacttggtcatgttgcataacccactgtatgtgtcgctggagggggccgcgcg

SEQ ID NO: 141850 - DNA, 110 bp, Homo sapiens
taaggacctaaaggggttcaacatgtttgtctagacgactctgtggtccttggaccatgtagtccaacctgtgtctttgacctgtgtgggacaagaaaaaaaaaaggcag

SEQ ID NO: 141851 - DNA, 581 bp, Homo sapiens
atgtaccaccatgcctagctaatttttgtatttttagtagagacagtttcgccagatggccaggctggtctcgaactcctggcctcaagtgatctacccaacttggcctcccaaagtgctgggattacaggtatgagccaccacgcctggcctgcacaagattaaatgagataataaatgtaaatgactgaatgaatgactagataaatctttgaaagcctgtttcataaatttttcttggttctcatagtaccttatgcagttttctgaatcaaacctatcaacttgtcaaaattaaatgatcctaatttagggatagtagtgtgtaacattttattattcctctttcaaatcatttgatgttgtttacatgtattcaggtcctttgttctataaatcattcattaaaagcagatgctggaactcccataacattccctcccttagatcaaatgttttcagaggtttgactttggtcttatattcatatgtagttgtaaagaggcctgttgactattaggacccactacaagtgtggtagtccattttcaatatttcacatataatatggagttcttttt

SEQ ID NO: 141852 - DNA, 343 bp, Homo sapiens
agtttttattgttatctgcctctgtgtcacatttcactctcttgattgcttattcggtttgctgaaagtgaaagaaaagacattttcatggtggtgtatttttttagatgtgtttctccctctgatgccttcttatatgcagactcttctgtttgtagcaaactgttgattatagatcacccttgaagctgtatcctcaattcagtttaacatttaccaaacacttctccgtggcacacaaaggttgggacttttaagatgagtaagactcgttgctcatcagagaggcagacttctagtctaatactaatatattaatactaatatattagggtctgtgctg

SEQ ID NO: 141853 - DNA, 185 bp, Homo sapiens
ataattagagcccaataagccctctcttcaacttcaaacttcaggcatgcatgttcaagataaataaattaccattttaatgttgtatttcatcaaatttaagacaatttttttacacattttagcatcagtgaaatagggatgcatcttacaatagatgacaccttagatcagatgaatgtggt

SEQ ID NO: 141854 - DNA, 460 bp, Homo sapiens
agaagagttcttttaaagtctcaattgggccagaaatctgtgtttttgaaagtcatcaagtagttgtgctcattcacatgcagaaagtaatgatgtggcatgacctatagcacaaatgtaagtcagaattccaaagagtgagcgacctctaaaatgtatttagttattccgaacacaaaatagtttctccaaaataaaaccacaattctagttaaaatacaaagtaaaactgaattcataatgcagcaaaaaacattaagaaagagctaccaaattacaaggaaggactaaagccgggtcggtccttcaaggctggcattgttgacattttgggctagataattctttgttgatggagggtgctgtgtgcactgtaggatatttccatcatttgaacataaagtgtgtgaaagtattgctgtaacaaaacaattagtaattctgctgacctctacccatt

SEQ ID NO: 141855 - DNA, 344 bp, Homo sapiens
cattttggctagctcactgcaacctcaaactccatggctcaagcaatcctcccacctgaccttcccaaatagctgggactataggtgtgcaacacaatgcctggcttttttttctttctttctttgttttctttttctttgtagaaaagcggtctcactatatttcctaggctgatcttgaactcctggcctcaaatgatcttcttgcctcagcctcctaaggtgctgcgattacagacatgagccaccatgactggccagttattttcctttgataatgctgtgtttaagttctgtttgtttaaaaatggacccagtgccatccccaaacaagagaccgcctt

SEQ ID NO: 141856 - DNA, 313 bp, Homo sapiens
aaaaaatgtgtacattcaggctgggtgcaatggctcatgcctgtgaaatgggatagtccatgtttcacatgactattttgaaaatagtgggttgagaggccgggcgcagtgtctcacgcctgtaatcccagcactttgggaggccgagacgggcgggtcatgaggtcaggagatcgagaccatcctggctaacatggtgaaatcccatctctactaaaaatacaaaaaattagctgggcgaggtggcgggcgcctgtagtcccagctactcgggaggctgaggcaggagaatgtcgtgaacccagggggcgga

SEQ ID NO: 141857 - DNA, 216 bp, Homo sapiens
ggaaagacttgccccagtgattcaattccctcctaccaggttcctcccacaacatgtgaaaattcaagatgagatttgcgtggagacacagccaaaccctatcatatggtcttctgtatttctgaccttgaaatatcttgagagtttcctctgctaacagagtgaaagttgctcctggccagaactttatttctgcattttaatggacaaacataa

SEQ ID NO: 141858 - DNA, 646 bp, Homo sapiens
ttttcatagaaaatttagttttgccatgtagaattgaaaaagtgatagatggtgttacttccaatggaagtacttacacacgcaatagaaaaatatggttttcatcagctggctgtttaggcagggattgactgtgagtctattaatagatggcattttcatgaagaagtctatttatgtattgcactggcttaacatttgatgcgtgtgcaaaggagctattcctacaaaaggtgtagtaacacttcagaacccaggaaagtcctcagaggggaagcccacagcttctgctggaaagaagaaagcagctcaaaagagaaatacagaaagttaacaataagttaagaccacatgattatgaaatcaaatgtagtgaaactaatttttataaaagcagaccaaagataatatatttaaaggaagttaagcctgcttcaatcaaattagttatattcttgttctaattatgttgctattgcccatggcacattcttttgaacatatttagtggcagatgtttgtccagtgattttagtcaatactttacataatttggaatcatcttatgagtaaaactttatcatttacctggataaatgcatcatatttatgtaaaaatcatcatatatatataaatcatcataca

SEQ ID NO: 141859 - DNA, 302 bp, Homo sapiens
gtctctttgtttacttaggtcttctttgatttgttccatgaacatttgttaagtttatacctatgaatctcattttcttttgagcaattgcaaatgatgatgcattttaaatgtaaatttccaggtctttattgttagtatgtaaatttttgtgtgttgatttttgtatcctgcaaccttagtgaattcatttgttgtgggaggttttttttttttttttttgatatgaagtcttgctctgttgcccaggctggagtgcagtggtgcaatctgggctcaccacaacctccgcctcctgggtt

SEQ ID NO: 141860 - DNA, 399 bp, Homo sapiens
gaagaggcagaaacttagagggagagagagaagaacagagagccagcaagagaaagagcagagacagaggagggaaagagacggaagagggggaaatacaccagagatggggagaaggggaagaaggagggggaaatacaccagagatggggagaaggggaagaaggagggggaaatacaccagagatggggagaaggggaagaaggagggggaaatacaccagagatggggagaaggggaagaagaagggggaggggaaagaggttgtcagagagcaaggaggagacagactcagatgaaagggcagagacccagagaggaggcaggacaaagcgggttgcggggagggagtagaggacagggacacaagacccagggagtgcggtacagagccccag

SEQ ID NO: 141861 - DNA, 338 bp, Homo sapiens
ataacaggccactgtgcataactttatgtcaatacattaaaaaatccaaacaaaatacacaatttgctaatacaaataatcaaacctgacttaagatgaggaagaaaactggccaggcgtggtggctcatgcctgtaataccagcactttgggaggccgaggcaggtggatcacttgtggtcagagttcaagaccagcctggccaacatggtgaaaccccgtctctactaaaaatacaaaaaattggccaggcgtggtggcaggtgcctgtaatcccagctactcgggagactgaggcaggagaatcgcttgaacccaggaggcagaggttgaagtga

SEQ ID NO: 141862 - DNA, 1488 bp, Homo sapiens
  misc_feature (1006)..(1006): n is a, c, g, or t
  misc_feature (1009)..(1009): n is a, c, g, or t
  misc_feature (1012)..(1013): n is a, c, g, or t
  misc_feature (1015)..(1015): n is a, c, g, or t
  misc_feature (1488)..(1488): n is a, c, g, or t
tgtttccacagtactttcagtttctcttcgtttgtttttcttttatttttcttgctcctctttctacacactgaagttgctgttgttttacatttaccttttatttatttgtagtttttgaggcaggttggagtgtaagaatgcaatctcggcttacagccgcctcgactttccaggactccctcaggtgatcttcctatctcagccttccaagtggctgagactacaggaatcacttaattctgtgatgtcgaagctgaagtgagccgtgatgatgccttgccctccagtctgagtgtttcagaaggtggagtttcgctcttattgcccaggctggagttcagtggcgtgacctcagctcaccgcaacctctgccgcctgtgttcaagagattttccagtcttcaccctttcgagtagctgaaaccacaggcaaacacctccaggcctggctaattttttttttttcatagagactaggtagctccataatggtcaggctggtctagaacacccaacctgaggcgtaccacccaacttgaccacccaaagtgctgagattaaaggcgtgagctccgcgtctggccataacatcttatcctatagaagcccagagaggttaggcgtcatctcacgtgtcgaggtgatctcgaacttttaggctccagagatcctcccgcatcggcctcccggagtgctgtgatgacacgcgtgggcacgacggagtttcactcttgtcgcccagggtggagtacgatggcggctctcggctcaccgcaccctccgcctcccaggttcaagtgattctcctgcctcagccttcccgagtagctggaatgacagagatgagccatcgtgcccggctaatttttctatttttactacagatggggtttctccatcttggtcaggctggtcttcaacttccgaccgttggagaatcttaactttcttggtggtggttgttttccttttacttatagattcttttcttttctttccttctnccnccnnanagagacacaccctagaagagtcatcatcaaacaacatccatacagtcagacaagaaaaaaagaacagcaagagaccaacgaagaagaaaaaccgggaacaagaagaaccaaaacatggacaagaagacaaacacagaacatacgagacaggaaggacgcgaaggacgacaacaacgaaaaaggaaaaaggagagaaaacagaagaaggaagaaacaaacaagagcaaaaaacaacaacaagaaaacgagggcaaaaaagcacaacgcaagacaaagaaacacaagaaaaaaaagggaaaaagaggaaaaaaaagagagggacgagaaggagcagagaagagaaacagagaaaacgaggaaagaaagaagaagaaaagagagagaacaagaaggaaaagagagggagaagggaggaaaagagaaagagaagagcgagaagggaagaaggagaggacaaagccgccagcgcacan

SEQ ID NO: 141863 - DNA, 1312 bp, Homo sapiens
  misc_feature (830)..(830): n is a, c, g, or t
  misc_feature (833)..(833): n is a, c, g, or t
  misc_feature (836)..(837): n is a, c, g, or t
  misc_feature (839)..(839): n is a, c, g, or t
  misc_feature (1312)..(1312): n is a, c, g, or t
tgtttccacagtactttcagtttctcttcgtttgtttttcttttatttttcttgctcctctttctacacactgaagttgctgttgttttacatttaccttttatttatttgtagtttttgaggcaggttggagtgtaagaatgcaatctcggcttacagccgcctcgactttccaggactccctcaggtgatcttcctatctcagccttccaagtggctgagactacaggaatcacttaattctgtgatgtcgaagctgaagtgagccgtgatgatgccttgccctccagtctgagtgtttcagaaggtggagtttcgctcttattgcccaggctggagttcagtggcgtgacctcagctcaccgcaacctctgccgcctgtgttcaagagattttccagtcttcaccctttcgagtagctgaaaccacaggcaaacacctccaggccgtcatctcacgtgtcgaggtgatctcgaacttttaggctccagagatcctcccgcatcggcctcccggagtgctgtgatgacacgcgtgggcacgacggagtttcactcttgtcgcccagggtggagtacgatggcggctctcggctcaccgcaccctccgcctcccaggttcaagtgattctcctgcctcagccttcccgagtagctggaatgacagagatgagccatcgtgcccggctaatttttctatttttactacagatggggtttctccatcttggtcaggctggtcttcaacttccgaccgttggagaatcttaactttcttggtggtggttgttttccttttacttatagattcttttcttttctttccttctnccnccnnanagagacacaccctagaagagtcatcatcaaacaacatccatacagtcagacaagaaaaaaagaacagcaagagaccaacgaagaagaaaaaccgggaacaagaagaaccaaaacatggacaagaagacaaacacagaacatacgagacaggaaggacgcgaaggacgacaacaacgaaaaaggaaaaaggagagaaaacagaagaaggaagaaacaaacaagagcaaaaaacaacaacaagaaaacgagggcaaaaaagcacaacgcaagacaaagaaacacaagaaaaaaaagggaaaaagaggaaaaaaaagagagggacgagaaggagcagagaagagaaacagagaaaacgaggaaagaaagaagaagaaaagagagagaacaagaaggaaaagagagggagaagggaggaaaagagaaagagaagagcgagaagggaagaaggagaggacaaagccgccagcgcacan

SEQ ID NO: 141864 - DNA, 671 bp, Homo sapiens
gtccagtgcttctgtattgatgtagaatgttcactgagcagcttgtaggagaaaaagactgccttaatttttgggcaaaaagttagaagggaaattgctttgcatttttctctccataatgttaatgaggaaaagaggcaatgctggaggaaaggagataaatggatgtttcctcccttccctatttaagctgcctaagttgactaaagttcgacttgataaatgtcctagttaatttaattttgtgttagtgcctctcctcccctcgagtgtccagtccattttcagctgacttgcagaaaaaccaggttaatgcaaatccatcagattctgcatgcctgttaaaatgcttaagcattctacatggcgtgggagacatgatgcttgcctaaaagggtccctggagagataaagtatattcctgccagtgcatttagggagttatacatatataactgtctcatatgatttggcattgtcacatactgagcactgggagagccaaaggaggtctggggttggtaggctgtttggaggtaaaagtttactactggaatagtccttccagctcagccgcttccatttccacattgcctcagaagttgcctaaaggatgtgcatcttgttggcagccccatgactttctagaagccctgttgtgtctgtttagt

SEQ ID NO: 141865 - DNA, 599 bp, Homo sapiens
acaggcacacaagcagggcctagtcacatcattagtctaaccctgaacactctgcatttacccctgtcaagagacttggggttcccgaggagaagaagcaggaatctactgtgtgaccacctaggcagtgagaagtcatgggaaggaggattaagacaataatgaggtctggcaggtgtaatctatcttgacaaaaaggccaagtgacacccacaaaagtactaaggaaaggcactatttccatgaaacctcaacatattttatcttagggttgacatgttatttctcacagtaagaatctgcgctttagtggtttcataattaggtagaagcagatgcggttataaatgtaagacagttataattgttagtggtctatgccatcctccatgttcattacccagatttaaattagcttttcaagaaaaccctgatgataatgcaactatgtaaaaacccacccgagatctgagcctagaaacaggagttttcctatcttccttgggtagcttgtagacaaaggtattatgagtcctctggccaaaaagagaataaaaagccaggtaaattgtaacatcctgcactgcagaggcctagca

SEQ ID NO: 141866 - DNA, 330 bp, Homo sapiens
cccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcac

SEQ ID NO: 141867 - DNA, 153 bp, Homo sapiens
tgtttctaacctagagtattcccagattacccaagcttgtctacattgctaattatgaaccaacactgacttgtcctctccaaatggtatttaatgaatacagaaatcaagaatagaaggatgcctaaggaatgtagaatataaaatttgata

SEQ ID NO: 141868 - DNA, 545 bp, Homo sapiens
aaaccacttggttggaaacttacgatgaatccacgggtgcgtttcctcacttgtgagaaccgaagcctggctaggtccttgctgccggggtcaggttcctgtggctgttcaaacgcccctgccctcatcaccagggactgaccccctctagtgctcccagcactcaagtctgggggtgtttttgaccttctgaatgtgggctttcttttcgaactgcggggaaggggactccttatcttaactgatcagaaagtttgtgtttcttccctttggactccttgatcaaatattaattctagccacccttaattccagtttcccttcgctctgggtaattttgttcccttgcgtgaatgtgtgcgatttttagtttctttggtttctggatggaatttattgtgagcttgttcaggttcttttaaattttcttgtttgtgtgtgtttatctgtgtggtttctacccaagagatttcgcctatgttggagtgccatgatgatgcaaaatctctgtatgtcatttgttccgtatataagtggttccttgt

SEQ ID NO: 141869 - DNA, 283 bp, Homo sapiens
gtttcctggggaatgactgtgcagccccgtgagcaaatccagaggggccctatcctccttcctgtcccttgtacctatggaaaaccaacaggttccctaagcccaaaagcagaaagccgaagtcaactttcacctactctggaaacaccctcctctgtcgtctaggtggaaaacaaagctatttttaaaggttttttcaagaatttcctagaatgttttcttccaggataccctcataataccctagaccaccaagtcactggggacccagagaaatcatctg

SEQ ID NO: 141870 - DNA, 207 bp, Homo sapiens
tgctcaggtctccagcctgacgcagatgttgagtgagcacacacactataggctgtcctggatagtgggacagtccctgctatacaagcaccattcagtggacactggaagtgaacagatgagaccaaaccgccctgcaggtcctaagacaagggcagcacagagccctaggggacatgggtcccatccagacctgagcaagccagg

SEQ ID NO: 141871 - DNA, 463 bp, Homo sapiens
agtaggcacagaccacagtaggagtagcgtgatacagggtgatgagtgtggggaggaatggggtgggttagtatgtcaacactgtcattttatttatacgtgttaaatacggggccagtggagcttagagtggacactttacctgagacggattttggagtcttgaatgtccaacccaggaaagagaagcatgttgtctgggaattgggatatgactacctcatgatttcactgtgaatttaaacagattgaaggagaacaaggtcatttttcaaggaataatttacaagatttagcaactgaaggagaggataatgaataaagagagtcaaaatgacactaaggttttaagagtgtgtgactgggagaataatgacatcttatctcctttataaaaaataataaggcccaggctcagtggctcacgtctgtaatcccagcactttgggaaaccgagacgggt

SEQ ID NO: 141872 - DNA, 136 bp, Homo sapiens
ataataaaattgccagatctacctctgtgacctctgtcatccagcagactacatctcttgtttagaaagggccttttttacttcacagttatgcccattaatagtgtggcatttctgaacaacaattttatcaact

SEQ ID NO: 141873 - DNA, 526 bp, Homo sapiens
tatcacccccaccctgtagagttcagcaaataggacattttgtctgaagctgcagggctgctacatgcctcaaatgcccctgccaagtggccatggtggaggggacggcatctgcaccctggatattcctgacctgtcccagaagcaggcaggtgacaagtgaggcctgagggggaatgacttgtaaaaggctgctttgggccggggattccagcagaatggggcaggctcctgtttttgagagtcaccggcataaggaaatgattgcaggggtgcccaggaaaccgagggctccaggacactgggttgggttgtagctcagcctggtccctgggagcccagtggcagctcatggccaaaatcactcagcccctcttcacacccgaacccagcttccttctccggagccatcactttttgagcaccaatcatatccaaggcctggtgtaggcctgtccagctgagttccacacccccaggctggccggcactcccagccctggcagctttctagggcagaagctca

SEQ ID NO: 141874 - DNA, 308 bp, Homo sapiens
tcgttatcattctgtttgataaacacctctggtccacaggacttttggcctagcattacagtatgcaatgtttttttcccttctgtaaatagccttggtcaaaaagcaaggaaacttgtgaattctctggttctgtgagatgctgtggaatacatccttttgttcttccccactcaagaaaactcttggttatcgcgtcattgggaaggaacacgttgcatggcaactgaagacactcacatccagacttgactgttgagagaaaggagctggcccctgggaaatacagaggctgctgagtccttaga

SEQ ID NO: 141875 - DNA, 428 bp, Homo sapiens
aaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggc

SEQ ID NO: 141876 - DNA, 359 bp, Homo sapiens
ttcgacggtgttctaaattctccatgttaggccgggtgcagtggcttgtgcctgttatcctagtgcgttatgaggccgaggccggcctaattgtttcttgacagttggttattagtaggtagaaatacacttgagttttgtaaaccaacctcatatcccacagcgttctaaattctccatgttaggccgggtgcagtggcttgtgcctgttatcctagtgcgttatgaggccgaggccggaggatcaccaggagttagaaaccagcctggatggcgtaatgagacctgcctctgccaaaaacagattctcttgaattttctcttgcacacactgctgtgtcatctgcagataaacacag

SEQ ID NO: 141877 - DNA, 526 bp, Homo sapiens
gagctttggcatctatctatccatgccagaccttacgctgaccagggaaatcactaccttttgggggagggttcctggattatcagccttaaaaactcactcagtccctcactgtgagggtcgtttctaacatgacaccggggttcttcactggtgaagcagattctctgcttctacttgtaggtggtccttagcatttaccacaaatacctattcagaaaatctcaagtaacatttgtcctttgattttcaaatgagagtacttttttttttaagaatgcaataatttccctttttttcatttttttctgccttttagatgtttgaatttatttattatttattttaccccaaatagtcataccttcatatttcacatgtcgcttcttcttatgtatttcacagacttctagaaagtttttgttttgttttttactttgctctgtgcttggcttaaagtatgcattcagctgagattgttgctgcactgggaaactcttattttgactcaaaagtgattcgttga

SEQ ID NO: 141878 - DNA, 296 bp, Homo sapiens
aagagggggagtctcaatgtgttgtccaggttgcacttgaacttttagtgtcaagtgatcctcctgcctcagcctcccaactacctggggctacaagcacacactactgcacttggccatgaatttggttttattactcttatcattaaggtactgttaagagctgtctattattgatgagatcagttgattcagtgcagacagttcagtgctaagttcctgaaaatattttgcaagtttaactcaacttaaaattctaaaaattgttaagtagaaataagctatactcttagaaa

SEQ ID NO: 141879 - DNA, 292 bp, Homo sapiens
tcaagaggataaaaaggtgaaaaggcaagttacagaattggagaaaatattttcaagatagatatctgacaaaacactagtatctagactacatactttctatatatgcacacatacatataaattttatgatacatagtaattatatatacatacatataacgtgactctcaaaactcaacaggaaaacaacaaagagtacaattagaaaaagagaagaaaaaaagaaaaagggtaagcgatatgaacagatattctataagccaccaagaggcttacacagatgacaaat

SEQ ID NO: 141880 - DNA, 117 bp, Homo sapiens
ttgataaacattagcatatgagtggaccctcaaaatcaaacctgtgttgttcaagttttaagccctgagagctctaagagtttaaagctaaaaacaattagaaaaaaaagggcggtt

SEQ ID NO: 141881 - DNA, 453 bp, Homo sapiens
cagtgtgccaggctgtgcatgaggcactggggtatgctgctcctcccatcatgagaagtgaccaccaagaaaatgggcaagcgtgatgggcgctagaagaaaatgaaactgggtagcagaacagagagggaccgaagcagttactttaggtggaggggtcagagacaacctctctcacagggtgccgttttacaaggagcggaaggacaaaaagaaccagacaggcaaagatctggaggaagatcatgccaagcagcaagaacagcttattcaaaggctgtaggagtggacccagctcagtgggtagaagaaacagaaaggtcgggagactggagtacagtgagccagagaaggggtggtgaggctggcaagggttggggccaaatcccaggaagcctctggagagcatggaaaagcatctagaatgagcgtcttaataaatgctttttccgg

SEQ ID NO: 141882 - DNA, 326 bp, Homo sapiens
gcctctttatgttgcttgcgtagcagtcatccactgaacatcggcatatgtgtggcccagtgggaatgttgcaccctaagttcctagcaggacgccaggcagcaactgtgcaatccaactccttggctcatcatctccatcgcacataagtgagcacacacactcactcattccacaaatatgtatgagtgcctattttctgccaggagctgagcaatacggtatatgcccaacccatacagggcttagcaaagtgcctaggtgccaaacagccaggaaacacacatgcaaaatatatacggccatacaacacagggactcctttc

SEQ ID NO: 141883 - DNA, 400 bp, Homo sapiens
taaagctgaacaatgtactctatgcctccgcagttttgttcctaaagtatacattgaacagaaatgcatagagatgttaccaaaagacacacacacaaatctagaatttggtcaggtgcggtggctcacacctataatcccaacactttgggaggctgaagtgggaggatcactggaggccaggaatttgagaccaaccttgacatcatggcaaaaccctgtctctacaaaaaaatacaaaaaattagcccggtgtggtggcacatgcctgtagttctagctaccctagaggctggggtgggaggatcacctgaagctgagggagttcgaggctgctgcagtgaactgcaatcgtgctacttactgcacaccagtctgggtgacagagcaagaccctgtc

SEQ ID NO: 141884 - DNA, 491 bp, Homo sapiens
aggaggtcagggtagccagaatagaggtgagatcagagaggtaacaggagactgaaatgacccctccaggccatttgtaaagacttggtttttactctgagtgagatgggaagctattagaacctggcacaataaaaggtggcagtattattgaaatgtctcaactctaaacttgtttgaaaactccacaattatctttttaaaaattcaggcaacttaaaacacttctgcttttggatgaaatcgtatccacttatggcagtgatgatataattggaatttctgggctagcacactgttaccaatgataccagagctgtggctcaggagtttattcatccatttattcagacttgaggataaaagacaagagtgacacatataagaagctcaaggatagtggaggaagacaaatatacataagcacaaaaagtcactaaagcaccatgacagacaactgtatcatgtgcaaaatgacctcacaaaacaag

SEQ ID NO: 141885 - DNA, 543 bp, Homo sapiens
cctaatttagaaccttgtctatgaaaggtacctaatatatttctatacaataaataactagataaatctctctgtcttgggacagaaaacactgaagagaaggtatattagagtcagaccaatgatcagaacagaattggaagaaaaagaaaaaaaaaaggtaagaaaatccttaatatggcttataaagcttgaaacgatttagcccttgcccatcagaccaagcttctttgatgctttaaacctgccatgcttcttttcccttcaaggtctctaagccatacatagttctaacaacccattatttttccctaagttaattctactcatcctcagagctctgctcaaatattacttcctcaaagtagctgtccttgaccatcccccactctaactaagccagctaccactataagaagttcataacactctgtacatctccttatcacaattttaaataaaggcacctttcctccctacaagaatataagctgcatgaaggcagaatcctcatatgtttgccttactgcagtgattaaaata

SEQ ID NO: 141886 - DNA, 678 bp, Homo sapiens
ggtctcaaactcctgacctcaggtgatccgcctgcctcacctcccaaagtgctgggattacaggcataagccaccacgcccggcccccaaaatcaactttttaactacaattgtagtaacttcttattatatttaatatgactcatcacaaacaacagaatgaaagagtatatcataacatttaaacctaactaatatgaagacctacttctctattttaaggcacaggaaccttaaaaacatggctatttcttgaaacaacaaattacaaaaaataaaaataaaaaaataaaggagaaagctatagattgattttaaaagacttaagggttatatcaaccagatgcaataaatcaacgttgtttaaatgctaatttgaacaaagtataaaaagaactgtaagataattgagaaaaatttgaatttgaccagcaggtgtgagccactgcacccggctgatactatgatttttttaaatggtcatttagagatatatattgaatagttttggatgaaatgtctgcagagattcaaaatgaaccagtagattatgtgttgataattattgaaactgggtgataagtattaatacatagtgattcattatattctctccacttttgtagagatgcagtttaaaagaatcagctggaagacaaaaaaaagcaaaaagatttg

SEQ ID NO: 141887 - DNA, 126 bp, Homo sapiens
tacccacaagaaaaggaaagcagccggcccggtctaaatacaaaagatttactgtcaacaccttgaaacttggaaagggtccattacatgccagcatcagacttttggtggagaagcgcggtggtg

SEQ ID NO: 141888 - DNA, 436 bp, Homo sapiens
tgcttccatttctctaaggtaaatatttaagagtagagttgttgggtcatacagtagatttatgtttaagtttcaaactaccaaattattttccagattataccattttacattcccacaagcaatacataagagttccaatttctccctttcctcaccaacacttgttatgatcagtctttttaacattagacattctaataggtgtgtaatgccacttcatggtggttttaatttgtattttcctaaagactaatgatggtgaacacctttccatgtgcttacttgacattcatatattttatttggggaagcacctgttcaatctttcacctgtttctttttcttttttttttttttttttttttggacccagggggacccccgggtcccgcccccaattccgaacccgggcccttccctgtcccggggggga

SEQ ID NO: 141889 - DNA, 167 bp, Homo sapiens
ctacttgcccttgagtccttgactccgcttttggaagaacccaaaccaagatcatttgtatgtggatgcacgtgtgtgcacgtggagagggtcagcgtcaggacgggtagaggcggggagttgctgacttcctggctggggaatggcactggtagacgaagattctg

SEQ ID NO: 141890 - DNA, 291 bp, Homo sapiens
gctcttcctgatcagtggcagtgggggttggggagtagagtgatggctgcatttctcttcccgtgtaagtgtctgagtttgtgcaggtgccaggcagagtgtgatggggtggcatacatatgtttgtgtagactttgtgactaaggaattgtgaatgtgcatgggtccacaagtaggagctatggggtcccagagactttttccttctctctgaggctccaggatggtgggcccctgggctcagtaccttgtggttcccaaatttgtgtgtctgggcaggatgggcacagg

SEQ ID NO: 141891 - DNA, 416 bp, Homo sapiens
caccctcccaagtaactgggactgcaggccccttccaccaatcccggctaattttttgtatttttagtagagacagggtttcactgtgttagccaggatggtcttgatctcctgaccttgtgatccacccgcctcggcctcccaaagtgctgggattacaggcgtgagccaccgtgcctggcctacaatggtattcttactaatttaactctctattcccatcattgcagcccaagactgtgctgatacacttctttctcctctctctcaagtgtctattctgttccaaatactacattagtagctgaagacaaatgtgtgaattaagacaaaagctttgtcctaagtacccctcaggtagaataaaatacatgcaagaaagttatggataagggtacaaagaggacaggaaggag

SEQ ID NO: 141892 - DNA, 509 bp, Homo sapiens
gattctcctgcctcagcttccggagtagctgggattacaggcatgtgggaccacgcctggctaattttttgtattttcttagtagagagatggtttcactatgtttgcaatctgcccgcctcagcctcccagagtgctggaattatgtgtgtgagcccggccaggggagaacttttgaacacttacctgtgttctatgacacagatcctttgggggataacaaagatcctttgggggacccagggtggactgcagggtggagtctgaggaaggagagcacccagtccaagggagagatggtgaagccagaatgaggcaggtgagtgggcgtggggatgctaaacccccagagccagtaggagccctccctagcaggatcaatcagacgccatcaggccttcccttcacggagggtcgactccactgcagactgtttcccaaaaggccaaatggacggacacatggcctttttgctatctcagccctcatgccttgagaacatattttac

SEQ ID NO: 141893 - DNA, 470 bp, Homo sapiens
aactcctgacctcaaatgatccacccacgtcggctttccaaagtgctgggattacaggtgtgagccaccgcgcctggccagaattatgtttttgattgtcttttagatgaatcttttataaatatatggtaaatagtctggtttaaaatagctcttatatcttgtgtttcttttcagcctgttgatttagttaaaagtctcagatgagaaggagatttgcaggataagtgccaatattatgacttaaaattactgctctgaatgaacattcaccccaaaataggaccagtctgcttttcagcataatcatactgtatgcattttgagtggcagggcagtagtcattgaaataatacattccttgtataaagttttcatcccgtacaaggtgcataagtgggtcaggggcaatattgagccatagcgttgagcagcgttgagtggatgcttggctgtgcccagtgacccac

SEQ ID NO: 141894 - DNA, 143 bp, Homo sapiens
ttcatgtttgtttccttccctttgagtctctacccacacgtgtcacaaagcagtgaccgtgagaccaccttacgtcttaatgtctaatattcctctgagtgaattaagcatttaaatagccattcccgctctttatttaatat

SEQ ID NO: 141895 - DNA, 332 bp, Homo sapiens
gaacagcgctccatgggctgttggatcaaattgattcctagatcccagtgctgtggaatctcagaatggttcatatgaatcagtgtgatgatggctaagggatagtttggtctttttgtacctgatgcagcctcttggctgggaacaaagatggaggtgccttggcccacttcgagttctgctttccccggccttccctggtctccaggctttgaagtcccccatgttgtttgaatgtctcagaagaccatcacagtctaatggttaagaattgggttctggggccaggcacggtggcctgtaagccccgcactttgagaggccgatgcagg

SEQ ID NO: 141896 - DNA, 388 bp, Homo sapiens
tgccctccccttttctacctaaaagcagagcataaatttcccataagtaccctccccgtaccaggaagaagagtagaacattcttatcattggagatggagagttgatactgagatgaatctataaaaacaaatcttactaaaataacttatatcttccattagtttctttatatattttatagtcacttttccacaattcactacccctagcccaagcctttttttcctttgtcttgccacatctttacaatttattgccctttgttaaaatggtatatgagcccctaggtctaacggtcctttggattttcatttttttctatgaagcctctcatgttatataaaaatactaattaatatcaaataaaatgtgtatagttttcctc

SEQ ID NO: 141897 - DNA, 427 bp, Homo sapiens
agccagagttcacgagggcaggcgtgtgctttgggtgttcagtgggtgtccacaggaaccacacagtggccagtgtggctcaggtttacagaacaaatgggagtgtgtcagaggccaagttgtctagggctttgggagttgagcctaaggagcctggccttcatctggagggcgctggaaccacaggagggtcccaagcaggaggggaatgctcacttgttaaaagtgtagaaattggattgaagtggagagaaaggaggtggggaggcagtggcagaaaaatgtaaggttacagactcagaagagatctgactgagtgtggtggctcacgcctataatcccagcattttgggaggccaaggcgggaggattgcattacccaggagtttggcagcttagtaagaccctgtctccctgtctctactta

SEQ ID NO: 141898 - DNA, 478 bp, Homo sapiens
tctatattgctcgacactggtttttctttcttttaaattcaacacaatgctattgagatctatccttaaaccttctggacagtgtcgtcctactcacatcatcttcagacaatgtcacatcaaaagatacttatgtaaggtgccatatgcatagacaaccagagcaagctctaagattaactactaagcaggcaaaatttagtcttcagtgttgctagaataaatagttttcctttatcttgcttcctctgcaacacataccaagatgaaggaactccaggcctcctcttcctctccttccacattcttcccaagtaaagaacaagaaaatccacttataaaacttaacgctgcacattttagggagacagcatcaatttaaaaaagagggtttccgggttggtcagagctgggctataacacatccagttgttgcatttactaattgtgtcatcctggccaagctactcaccctctc

SEQ ID NO: 141899 - DNA, 673 bp, Homo sapiens
gggactgttacccaggcatagttctttttctccagtgtaactaggtaaaaaatcagtgggaagctggttagtgagtgaacaagactgaggtaagaataatctatactattaaggaaacctgtgaacttcttgtatttctaattcagattttgctatcaaacatataactgatatgagaagccactttttttaaataatcaaagctgattagaaaaacaagagtttagaacacaactaaacaaatttactgataacatgctgttacaaataaagtactgtaaatggctttgagtttttgcaaaatccagatttaagctgctttataaaaacgagatttctaaaaagtcatgtgacaaaactgcatgacatgtaaataacatatcacattgttgagagtctaggggagctgttttgacactgtgtatatcattggattcactcagtcttccagaagactaccgttggtccagaaaactgtcatatcaatggatgttggttttccaggaccttttttttcacatataataaaacttattgaaacgtaacagagaagtgcacaattttaagtgttcagcttagtgaattttcacaaaataaagacacacattggccaggtgcggttgctcatgcctgtaatcccagcactttgggaggctgaggggggagcggatca

SEQ ID NO: 141900 - DNA, 525 bp, Homo sapiens
atgccaagaatgtataaccagacgtctaatgtctgttgagagtgctgcgtggggatggggcagtgctttggggaactggaggacagttctgtgcacagaagcctctgagtgaggaaaagagaagttgggaactcatattagaaagttcccaggagccaggtggattgcccaagggtttgtggggcaccgcatgggcttggtttttctcagaagagcagaggttgcataagataatcaacgggtataaatgttcctggcaagtgttatctgtttgctgctgatatctttaaggtgacccagctggttgcaggacttctgcctgtaagagaaagttgtaccttggcagaagggcaaaacctccaaggaatgaggctgggggagagaatagagagggaggaagagacagtgttgtcagtggcagtgctggtatccagttcatgtggccacagctgctactgatggtggaggtgatggtgatgatggtggtcacagccagcctagaaaaaggaatttggacttcttctc

SEQ ID NO: 141901 - DNA, 348 bp, Homo sapiens
attccccaccacccagctaccttttcagctccagggaagaacagcacaggaagcacagcaggagccctcaagaagcccccaggttcacttccccaggctggaggaatgcgacacagaccagcaggcactccagcctggggcacgcatatgcagggcttggaggtgccacagacacgggtggcctgggcgatcttgctgtagccaaagcaaccgagggacaccccaatccccagaggctacaaagcagagcaaagctgcttctggtggactagtctgagttacatttatttcctgaaggctgtgatatgctacagaaatgagaattcatttcttcttctttttcttttc

SEQ ID NO: 141902 - DNA, 682 bp, Homo sapiens
agagtttcctgggcagcctaccaggaggtgggaggaaggtcctcgttagcacttttgtgaggctgctgggaagccttggatattgcgtgaaacagccaaggtgcagaagtgtccgaagtgaggcgcctagctgtagaactgcccgagagatttgagaagagcagagagaaaatgaaaaatatatatacagcctcggtagtagaatgaaatacataaaaatatacatttatttataaaatattaggttggtgcaaaagtaattgcggtttttgtctttatttatctattttgagatcaagtcttgccctgtcacctaggctggagtgcagtggtgcgctccagattttctgcaacctccgcctcccaagttcaagcaattctcgtgcctcagcctcccaaatagctgggattacaggcatgcaccaccatacctggctaatttttgtgtttttagtagagacggggttttgccatgttgcccaggctagtcttgaactcctgggctcaagcaatccacccgcctgggcctcccaaagtgctgggattgcaggcgtgagccaacacacccagtcggtttttgccattttaattgcaaaaattacagttacttttgcactaacctaatatttatagactatggatattagttacattaatataccataagtatactgtacgtgtt

SEQ ID NO: 141903 - DNA, 224 bp, Homo sapiens
gcgtagtgaactgcttcggatggtttctgcttctggggaggctcaggaaacttaaaatcacgggagaaggcaaaggggaagcaggtgcatcttatatggccgaagcaggaagaagagaaggggggaagagaggggggcagagaaggtgccacacacttttaaacaaccagaacttgtgagaactctatcacgaaaacagcacaaaaggcggaaatccgccccca

SEQ ID NO: 141904 - DNA, 533 bp, Homo sapiens
tattgcaagacagtacataaaaacagacatacagcaagtttaacaaaacaatatttaccttatagcttgtgatttactctggtacttgtattttattttttttcaaaaaaaaaaattacgtctcatgaaattggtcacattacccactaatggataatgattctcaaagtgagtcactagtgcggagaaaagtgaatgggacttggccagcttggacaacacagcgaggccccatttctttaaaaaaaaaatttatagccaggtgtggtggcacacacctgtaatcccagctactcgggaggctgaggccagagaattgcttgaacccaggaagcggaggtttcagtgagccaagatcacgccactgcactccagcctgagcaacagagcaagactccatctcaaaaaaagaaaaaaaaaaaggccttggaatggccaataggggaaagcccagctccacctttctaatcccattgaggaagtttattagggacacccctaatgagccccgagcctgtaggtaaggctggggg

SEQ ID NO: 141905 - DNA, 107 bp, Homo sapiens
agaagccgtcctctgagggcacaggaaggggatggggtcaagtgcagaggctgaggccagaacaagttcaaagcagcaggaaggagaggatgttggattctcttaat

SEQ ID NO: 141906 - DNA, 834 bp, Homo sapiens
gtggtgacatgcgcctgtaatcccagctactcaggaggctgaggcaggaaaatcgcttgaatccgggaggcggaggttgcagtgagctgagattgtgccacagcactccagcctgggcgacaacgcgagaactgtctcaaaaaaaaaagaaaaattaaatttcaaaaaatattaaaaatcaggaaaaagggatagtgagtgattgagatgttactgttgtagacagggctgtcagagagggcctttctgatggggcgataggtaagtagagctttaactggaagcatctggaggaagaacttcatcgttgggcgctttctctttggggctaggctatgccttctatgagagcagtgggctgggcttgatgtctcattcattgctgcgctcctggaccctttgtcagttcctggcagagagtgctcactcattcctctgagtgactggttacaagccactaacctaaaaccaggaagaccgtcttcctcggtcccttcttgtatcatgtgtagacagctcatccaacatacatttcctgaagattggctgtgtactaggcactggccttcacagcttctacaggcagaaagggcaaagatgaaagccccaaggaagggttttatccaatgagattataaacccagtgacagatgggcatggtggctcacgcctgtaatcccagcacctggggaggctgaggcgggcagatcacttgaggtcaggagtttgagaccagcctggccaacatggcaaaaaccctgtctctactaaaaatacaaaaattaggccgggagcagtggctcacgcctgtaatcccagcactttgggaggccg

SEQ ID NO: 141907 - DNA, 421 bp, Homo sapiens
cgcatcacttaacgacagggatatgttctgagaaatgccttggaaggcaattccatctttgtgtgaacatcatagtgtacttacacaaacctggatggcacagcctcctacacacccaggctagatggtgtcacctttgctactgggccccaaacctgtaaagcacgttgttgtgctgaatactgtgggtagctgtaacgcaatggtgaggatttgtgtatcaaaacatagaaaagtaaaaatacagtagtattaatctcatgggacactgtcatatacgtggttcctcgccgactgaatgtcatcatgcagcgtgtgactgtgtgtaagcatgaaggcctactcagaggtaccctggacctccaccctctccctgcatcaaggtgacagattctggcatccctgcttctggccctgcatt

SEQ ID NO: 141908 - DNA, 127 bp, Homo sapiens
tgctaggattacaggtgtgagtcactgcatctgaacagtcatcaatatttaaatcacccaagaggctataattttctaatgagtaatgattggaattgtccactttgaggtgaagtaaagggggaaa

SEQ ID NO: 141909 - DNA, 1189 bp, Homo sapiens
ccactgctaggtgaaataatcaaattttctggagcgtttaatatatttgagaagcttggtaaattatctgtagtggataagaacagatttttgtactctagaaacagatgttttcaacataatatgcagcaaaattattctatgcctattccctcctaatttaagggcgtgcagatgaaggctgacatcggcatagaaatgtgctaaatttcaaatatggttgttcaataatatatttttaattgtattttaaaacatccctttgtagggaatatcagtagaactattgaattgatgttgtatttttgcattagctgtcctttaattttgctttccatgtcttgatcttgttaccgaaatgcattctgtgtaatttcaacgtagactacgttcctgagtctgatgatgtcattgtaaataatcattcctcatgttgctctcacgggtttgacattggaggatagatgtgccatcaactttaaatagagtttccatcttttgtcagctctgcatgtcatacagcaagatggaacacaggttgcaagaaagaaccaacgttattcctgacattctattgatgtgttttgagcagcaatgtgtaaccaggtgtttctgcttctaatcttgattctgctgatgaccatttttatactttatggcaaagcctcattgcctcagtttcctgtctggaaaatgagttcatcatctacctcttgggcaattgagagttttcattttgtgtcttttaaacatctggaaaatggaaaacactgagggctaaggataatgatattgtttaatgtaatttgtcatcagaccggcctcctgctcactatttctttttttttagatgctgtttttttagaatattaaattaaaggagtgctgttaatatgtaatcttcaactagttccatggaggaaagtgatgttttatgaattagagcttaaattcctatctaatttctgaagactgcattcttttcaaagacttgaaattaaactcaggaggatacattttgtttgttctagggggaaacgtaatagaatggtatgagatgaattctatccttttacaataattattactataatattgaagtattctatgcctttctgaaacactttattcagaaaagatcattttttggcttccttttaaaaataagcttgaagtagggaagcatttg

SEQ ID NO: 141910 - DNA, 115 bp, Homo sapiens
ccctttgctggaccatacttcagcttgctcaggcttcctaaagcacagcactgtcaggcaggcaccacctgtgtccctctctgcctgcctagtcatggctgccaacaattcggct

SEQ ID NO: 141911 - DNA, 761 bp, Homo sapiens
cgttcacgtcgactggtgcgccactgcgccgcgcgacctccaccagctgcagcgccatctcgccgtcgccgctcttggcggcccaatgcagggccgtgaagccagacatgaagtcgcgcttggccgccaagccgcggtcgcgcagcagcagcccgtgcagctggtgggtccagcggcccccggcagtccgcacgagccactcgtgctcggacggctccaggggcaccgcggacggcggcggcgcggcgggcaactcctcggcgtcagggctcagcagacgcgggccggcgcgcgacaggcgcctcaggtgcggggagcggcccgggcccaggccgaggcccagaccggactcttccaccgagagccgcctcagcagcagaggggagctccgcgggctcggctcctccgacagctgccggcgcaggccgggctcctccgcccggaggcggagcgtggcgggggccgggacgcagcgcaccggcagcatacagggcttctgctgcggcggccctttcgctgccccgggcccgggctccgcgtctggcggatcagagcagggcgatgccgcctcagaaggggccctaggcggtggggccgcgtctgcggagggtctctcggtggcctgggctagctcaagggctggaagcggtgggtcggcggaccgctccccgggcggctgagcgggctcggaggccggcccccccggggtgtcctgtggctctgttggcagacccaggtcccctggcggctccactggccgc

SEQ ID NO: 141912 - DNA, 326 bp, Homo sapiens
aagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggatgtataaaaatggatcacaaatctaaatttaaaactataaaactt

SEQ ID NO: 141913 - DNA, 559 bp, Homo sapiens
tcatgactggtctctctactctcaccaatgtcattctacagtctattctcaacacagcagccataaaaatccttaagaaaacttaggtcaggtcagccttctgcttaaacctccaaatggcttctcatttcaccaaaagtaagagccaaagtccttcctatcacttaaaggcctacacactttcatctcctgctgactttctgccctcatctccaaccatgtcctccctggatcattctgctagaaccactcagatcttgctgttcattgaacaagccaggcatgttgtggtttatggcctgcttgacctaaccctacagcattttcccaggaaactactataggaaaacatgctttttatgtattacttaataatgttctgcacaccacacccctcatctttagttttaatacaatcagactctcacatagcatatccagttaaaacaaaacaatgctatgtgagagtctccgtcgaactagttcgacggagactctccattggttttcccaaaaacatatggagagtccatgttgtacttagatgggcagcggcatt

SEQ ID NO: 141914 - DNA, 793 bp, Homo sapiens
tcatgactggtctctctactctcaccaatgtcattctacagtctattctcaacacagcagccataaaaatccttaagaaaacttaggtcaggtcagccttctgcttaaacctccaaatggcttctcatttcaccaaaagtaagagccaaagtccttcctatcacttaaaggcctacacactttcatctcctgctgactttctgccctcatctccaaccatgtcctccctggatcattctgctagaaccactcagatcttgctgttcattgaacaagccaggcatgttgtggtttatggcctgcttgacctaaccctacagcattttcccaggaaactactataggaaaacatgctttttatgtattacttaataatgttctgcacaccacacccctcatctttagttttaatacaatcagactctcacatagcatatccagttaaaacaaaacaatgctccagaaaactcttgttattcctcagcatcataggcagaaacatcaagaggccccaagcagtgttgctgttgggtcactggaaaataccttcaagccccaggcaggcaataaaataatgaataacagggcaagaaataataaggcctttctacatgaatcaaactcagtgtggcccttcttatactgtaacccggaattttttattaataccactggtgtgctggttaaattttgatttagatcaaaatcaaatggtgaactaaactagtttagttgttatctgatagagccagtgctttgtagctgtgccaatgatttgaaaacgtgacagatg

SEQ ID NO: 141915 - DNA, 139 bp, Homo sapiens
catgccagcattgcttcaacccttggagatatacagccctaggacattgtcctcaaagaacagcaagagtgtagtgtgagattttttaaaaaggaaaagatgaaggcaatatggcagtggttgagggagggctttccag

SEQ ID NO: 141916 - DNA, 433 bp, Homo sapiens
gcttatctgcagaagtgtcattttttgctgagagctctgattcacaaatgggcaccttcccagacaagaccagctgggcaatccagaatctgtcatggattatttgatgccgtggcttgggaattgatgccggaatagatcttaggaaggtggaaggaggaggagtccttccaaagcataaggttgttcagctgttatttgacatgaatgtcacatggagtaagttaattgtatctagatcccacattgctgaaatactttggaacagaggtagaggagagaaggaacatttatttttgtgtctgaattatacagagttcaatcactgagggaactggcttacttttttagtgaaagctttgagatttgcatctgaaaaagtgaatttgtgcttaaatgcatgtggcctgcctaggactttagcatccagaag

SEQ ID NO: 141917 - DNA, 543 bp, Homo sapiens
gccatgtggattgaaataattatatcttctggccaggcgcagtggctcacgcctgtaatcccagcatttggggaggctaaggtagatggatcacttgaggtcaggagttcgagaccagcctggccaacatggtgaaaccctgcctctactaaaaatacaaaaatgagccaggcatgttggcacacgcccgtaatcctagctactcaagtggctgaggcaggaaaatcacttgaatccaggaggcggaagttgcagtcacctgagatcacaccactgctctcctacctgggcaacaaagcaagacactgtctcaaaaaagaaagaattctctcttcttccaattgtgctaaaggcttaaagatgtagtagaaagcagcaacatgcagagtgcatgcattccttcatctttatttcccatctctctttcccaggaactgatgaattagacttagcaaagaaacatgaaaagcactcctcccaggcctccttaccgcaagactcactaaaacatctttttcctagctcttgaggtttttggctata

SEQ ID NO: 141918 - DNA, 177 bp, Homo sapiens
gtgggcccaggctgctggcactgaccaggctcaccttatcttggctcctgggctgaatggctgagctttccaggcttgggctggggaggtccctcttatttagcttccttgtcagcagtttccagaaggtgaaagttacctgcccaaggtagtaaccttaaactgcaatagaaataa

SEQ ID NO: 141919 - DNA, 797 bp, Homo sapiens
gaaatctctttctcttaatctaactgtaacttacaacaatttagtagattatacttttataaatagaaatgaggcatttatctttttttccctgcctgatttttccagaattttgaaatccttactgaatactcatattttcacgatgatatagttgttagcaaaagtccaataagaatctgttcaccttataacggacataattggaaattttggttatattatcaaggtttttactggaatatcatatttaggaagtgtacctaagatcatttatgaccagcaattttaaggaagtaaggttgacttttatggaaacaatgcttacaaagcactgtgagaaatgggaaagttcttcttcaaagattataaagtcacaatttcttactataagattgctatccactatttatgtgtgtgtgtgtgtgtgtgtgtgtgtattccaaatcacttgtcctagcttgctccagcatgcctggacagaactagacaagccccagcccatagtgcatgccattccttatttggagatccttccttaactatccctgggcaacttccttttctttctttcttctattccccttacctaattaagaaagttttaaactaacagccaatcgggtaaagtgtaaaatgtgaggtcctattccagccaatggaaactggacacagcactagggtagacacatcagattataagtaactctgtctcctttgtttggtgtgctcttgtggctggacagctattgagtagcaccctttctgcagaaagtaaagcttgccttgctaagaga

SEQ ID NO: 141920 - DNA, 728 bp, Homo sapiens
ctgagtgtggtggcatgtgcctgtattcctagcaacttgggaggctgaggtgggaagactgctagagcctaggaatttgcagctgcagagagctatgatggcatcactgcactccagcctgggtgacagactgagaccctgtctcaatcaatcaatcaatcaatcaatcaatgtcaatcaatagacctattgtcctaaaagcaaagctagcctgtttggcttctatagttattattttaaaaatggctttatttatttaatttagctttcttccatggacaggattttcttctagattcaaaaggaaaatttttattccacaatatagaaacaattagttcaaatgtaatagaattttgattaaaatccaaaccttctgttgaatattgaatctgatatttaagtataacaattacatcaggtttttaaaataataacattgtctaaacaactttttactttttatcaaaagtggtttatttttaaactatagaaagatataaaatatatgctatcttgaaatagttgaggatatcagaaaagttattggtcaagcacttggtaataatttctaaaaagaagagcatcaattgtagaataagtgaagacttgtttctttaatttactttaatgttacttttctataagggtgggctcttaaagcttgatgtaggctgagtgtggtggctcatgcctgtaatcccagcactttgggaggccgaggcggg

SEQ ID NO: 141921 - DNA, 164 bp, Homo sapiens
catgttagagccaatgatacctcacaaacagccctggaaaacctgttcacagtacttcagtccatggtttaacttctgaaaagctcgtgagcccaggtctctccttctgaactcaggaacatctggatggcaatggcttggccttttacattattatccctcaa

SEQ ID NO: 141922 - DNA, 802 bp, Homo sapiens
gagactgggaaggagaagcctgagaagagggaaagctggaaagaagcatcttggatgccaagatcggagagaattgcaaggaggaggcagtggccatgccagatgtagtggagaggagagggaagttaaagacggaaaaaacgtccattggtgttagcaatggagagttcattgagggcctctcccacagcagatgtggggaagcaacagggtatggagttgagtggatggagtaaggaatggatgtgagaaggttgcagcctggaggacaagttattcggcagtgaagaggaggaaacggacaacaggctcggggagtgatttttggaagatgggtggatgtagcaagttcatttctagtccaagggctgagagcccacagagaaggtgaagggaggggccagcttccagagcaataaagagatttaggaacaatgaaccaacgcttgtggtccctacctcatggcctctgctgccttttggagaggaaggtagtaggttatagagtttcaagagaatggtgtaattttggaatatctcttgtgggaaatgggagaaagagttgagaaagagcccatgtaaggattttcaagaaaccctggaagattttgtgctcaggagcaaaaaagaaaagaaaaaggtagattgttgtaccagggttaaggttttgtcatgtgcgtgaggtggaaggaatcaaaggccgaggaatctgggagaaagcagttccgatggtgtccgtggggctaacgcatgagggaaagacccaggtaggaggagtgggtaacaggtaggaggagtgggt

SEQ ID NO: 141923 - DNA, 291 bp, Homo sapiens
attttgactacgccacttccttgatgtgtaacattaaataactgattaaaatgctcctgtgcctttccacagcataacacaaacagcacattaggatagcgaaaagaaccagagtccttcctctgtttttgtgatgaaacagattcaattctagttaacactcagtgtcattctgtgtggtgagaggctgggaaagtctgggagaatttcctcggcgactctaagattagggatggcctgcggctgcatccgacttcctggagctactgaagtctgaactctggtctcatg

SEQ ID NO: 141924 - DNA, 224 bp, Homo sapiens
ggctgctccggggaggggtcagaaccttggctaaggcagtttgtctttggctgaggatggttcctggggaggcgccccacaggtgacactcctagcagtctcagccctgaaggggactccatcacttcctacacccccactgcaaaccttcttctccacatcaccaggtcccttaactgaattgtcaatcgtctcctctatgtgatgtgacgttgggcctgctg

SEQ ID NO: 141925 - DNA, 895 bp, Homo sapiens
attgtgggtttctctggaaaatgtaaattcaaacctgctcttattgacctcaatatgtcattttaaatgtgaaattaaaattgtgtctcatcaaaaactaaacttatcacagattatccaaacacaaatgcacacagtttacatttaccaacatcagtttcaaacatcccaatagtatgctttagaaagtgttttagcatcttaagcacttatgttccatattttaaggactacttcagaatctaacagattttttaaatcctctaaatcaccccaaatactataaatggtaattttaaataaaaaagattaaacatcccgttgtatgcagctctcaaaccaataagccagataacgctagaaatcggcataaaagctctccatccaccacctgccacgacaacgtgcacactggatctgccaagagggccccgagcatttcaggggtgggtgggatgcctgactgctccgcttgctctatagcccccaaataagtctaaagccagctggcgttcttttcaaacacatacccaccatcgccagcttcccagcccccaaccactgtgcattttgggagaaaaacaaggatttaacttaaattttagaaaaactaaagtttagttttatgaagaaagttatttcagtgcatgccatatactttttggcatataaaggaaaccacgtgcacataatgtaagaagcagaaaggagtaagttgaggggaagatggcctgtggatgaagtggcagcaggtagtgactgcaccgtccccctggggcatgtgtggtgtattaaaaggccgaagaggtctcctctgggggagatcatgagacggatataggatccagactggttttttttttaatggttctagggtacaaaaaaaaatggtaga

SEQ ID NO: 141926 - DNA, 182 bp, Homo sapiens
gcggccgcctactactactactgctcgaattcaagcttctaacgaaatatcggggacatgttaataatgacaatcccattatttccttgcagtaggcaggaaatgctgtctacacccattagatttgtttgagtggcccctggctggaaatgaagaaaatttaattttctaatttgcaggga

SEQ ID NO: 141927 - DNA, 131 bp, Homo sapiens
gcaatgctggatccctgctgtgacacttcagaccaccccagcctccctatgaaaactgtaacaaccaaaaatgaaacccagacacctgctgggctagaggagggaaactacagaatttatgcttggagaat

SEQ ID NO: 141928 - DNA, 270 bp, Homo sapiens
actgatggggaagcagaggcctcatttaagtaactttcctgaggtcacacagctactaagtggaggaggcatgtgggagggattaaaatccagttattgttcctggtcctgaggagaaaataaaaatccagttaggtctgttatgtcctgcctcagcctcccaagtagctgggactacgggtacatgccaccatgcctggctaattttttttgtattattagtagagacagggtttcaccatgttggccaggctcgttgtgaactcctga

SEQ ID NO: 141929 - DNA, 328 bp, Homo sapiens
gaggaccttcagctttaagcacctaggaaggccctaactacggcgggaaggggcgtggattagaggactggaacacagagcactccagtgaaatgcagtgagggatgggagagcgattggataagaggccagagaggtgcttaggggctagatgtggggcctttacagagaacatgggaagggttttaaatatcatcccgtgaataataggccagtgcgtagttttaattagagtagcgacatgtttgtatgttgcattttttaaacagggcaaaaattattgtctagtctctacacaacagttttgggcatattttaaaaatgagaa

SEQ ID NO: 141930 - DNA, 118 bp, Homo sapiens
cccgcctcagcctcccaaagtgctgggattatagacgtgagccaccgtgcctggcctatcatcttgtttttactttttatctgcattacatgtgtagcaaggctttgctctgggtttg

SEQ ID NO: 141931 - DNA, 607 bp, Homo sapiens
accaccaccacccagataccacctaatagcttactgaattccagaatcacactatgtactttatgtaataagcccctttaatcctcctaaaagccccatgaggtgggtggaattggccccatttaactggataggaaacctcggcttgtcactttgtaactatctaaggtcacccagctaataaattgtggtgtcacattttgaacacaggtgtgaccccctaagtatgaggcactgaccatttggcaatcagggtgggaaagggaaagatatttggagtcttctggccccagccaaattagaggaagattggaaatagttaacttctgacccaagggctttgaattcctattctctccacaggcccctgctaatcgccaggagggttggggttggcaggcacttctgcccaggacctctggcctcccttttaagatatgggggaacagggagggttcagataccaggtctgagagcactcaaactgacagccctctgcagagaactgtcaccccacccccacctgcctccagcagcaaagacctcccacctcttgctctgggtagaagagcttgacagacccttcctcactcgctcctcctccccc

SEQ ID NO: 141932 - DNA, 121 bp, Homo sapiens
tctgtaaatacaatagtgttgtttagcaggaaagaccaaacatatctattggaatagaagatatttctaaatttaaagatagttcactgctttaagtggagctttgtgtttgtttttggtt

SEQ ID NO: 141933 - DNA, 412 bp, Homo sapiens
ggctcgccgagagataccagcccagacgtagtgccctcttgctctcttccctcccaaatcagctctcagcagcacctctggagaccatgtgttgaactgtttgttaagatgtggctgggcatgccatttccactcctgttttgctgtgtttacaaataggttcttaagtcagatcaagtacataccccagcccagcccctgtaactggttccatgggtgtgaggtaggccctgagaatctgtcttttgaaccagcaccccaggagatcctaatacgggaggtttcgacaactctttgggaccctagcctttgcctctatacacagacatatacattctctgctcaatcacaaatgttggccaggcatggtggctcacacctgtaatcctagcacttcgggaggccgagacag

SEQ ID NO: 141934 - DNA, 210 bp, Homo sapiens
tggattgtaaaggggcataagtacttttggggttgatggaaatgtttgacattttgcttatgatagtggtttcatgggagcatacacctatcacaaattcattgaattgtactttttttttttgagacagagtctcactctgtcgctcaggctggagtgtagtggtgcaatcttggctcaccgcaacctctgcctcctgggttcaatcaa

SEQ ID NO: 141935 - DNA, 288 bp, Homo sapiens
ttctattaacaattgtaaaagccccacaaagcgtttacattttggccaagcggccttaatattttcagaatatgtaatctcaaactatttcttcattaatttttctggaagcatgtactgaccacttactgtgttctctatgaggcactgggagaaattaaagtcatagtctctctctttgaagagtttccagcatcatgtcagggaaggacaattttaagaaagtctaactcaggcaagtgttttgccaaaggtaagctcaggattttggaatcaccactttgagag

SEQ ID NO: 141936 - DNA, 452 bp, Homo sapiens
cgtgcctgtgagggagtctatagaggatccgcgtctcgccgagcagacactcaacgcccttgttctgactcaagagggcagcagcgtgtgcccccaggccaagaccttagcaccactgacacctgtggctgcatgattcttggccatggagggccgagagccactgccccccaaggagccggggttctgcagagaaacagctgactccacggtgagcctggagcacctgccgtgcagaacgtgatgacgtgcccaggaatgagaggacacatcaaagggacgcaggccagcctcaagcggcttccaccagccaaggctgggaccacctgagaaccagaataacagagcagattacagcctatcaagtggagtaagactcctgggtccacgccgttaaagcaaatcaacaacgacgcagggcaaaggcgacagggaaagccaccactcacagc

SEQ ID NO: 141937 - DNA, 198 bp, Homo sapiens
ttttatgtaacagaagaggaaactaaggtatcaagagattgaaaaattggcccacatgattttaagtggcagtgtcagagttccaaatctagtctgtctctacacatagtacatttaacccttggtctatactgcctctgtttgcctggtgactataatgggctgaattctcttcccccaaaaatcatatgttgatgt

SEQ ID NO: 141938 - DNA, 495 bp, Homo sapiens
taagctacttgtctctcttatttaaaaaaaaaaaaactagaaggttattccctgttctaaacttctcagagaaatgtagtcatgaattaatatgcttatttagaagtaaacagaacaataaataaaacaaatataaagtaaaagcttagaagatagaagttgagggtcatagtttttatgctgcattagcataaatgatgaaccatgtctattctcaaccacgataatcaagctttgtgaaaatcgtctgaagtttgtaaacaaattcaccatagaagcaatgttgctcttagtcaaggaagcccttaaactgtggaaacaaattaacccccaacactcagtgacttaaacaacagacaatttctcctggtggaaaacgcttcctctatcttatttaatcaggaacacttggcttccaaggttgctaaggcagaccagagagggctagaagtttccttggacatttactctgctaacttttacccagtagattga

SEQ ID NO: 141939 - DNA, 332 bp, Homo sapiens
gcttaagcactactgtttttatgtacataatttaatgctggaacttgatcacctccggccctcctgctgacagcatttcttttgctagaaatacccacctttctcagagcctgtgtctcctttggttttggtttttactccatgatatgttaaggactcaccagatttaaatgtgaaatttatcttcaccactaaaaagcccacttgtcttggataaatcacttggtttctttaactcctcaaaaagtacaaagtcagggggttttgatttttctctcttgaaaatttggcttttaacaaaatttgtatagcaaaaacaggttacccgctcc

SEQ ID NO: 141940 - DNA, 738 bp, Homo sapiens
gtttggaatccccgccccagacatcttcacggtcaccgttgctattggactagaccaacctaagattttatattaacaaagacaatgggagcaacaacttctcttgtcatgttgagctgtctttcgtttttccaaagccttcataaaccagcgtagaccggtgcctgcagtttatcccacagctcagccctcccttgtggctgccaggaagaggtctgggtttctgactaagcctgggctagagcagctgggggctgtgcccagactcattttattgttgactcagggaattctcactgcagtgcatgttttgcatctagtctgtaaagctagctaatgctgcgactatttgattcactttaaattcctccccagggtttgccagggcaggcttcttgaaatctgcatctttggcccagtcaggagggcttcctacttagtgtaaaattttctgcactttgaatgatttttttttccttttcaaattctcccgaagccaatgacgccttggtggcactgttgagctgtgagtggataatggcgtgggaagggccagggctgcctgtgatgcccagagcagtgcactcccgcggcagatcatactcgctcctgggatgtttattaaacacctgccacgtgccaggtgccgttctaggtgctggggacccagcactgaacaggagtagagtctccctggtgggccccagcggggggtgtggaatggcaccaggaggtggt

SEQ ID NO: 141941 - DNA, 265 bp, Homo sapiens
gaggagcctttcctccccttttgcctgcgctccggcgcgcggagagcctttggaaggaattgggccatgagaagagccctcatgaatgggattagttcccttataagaagagacaccaaggaagtgatctttctctgccctctgctatgtgaagacaaggtcatctgcagttttttgttgttgttgatgatcttcctgtcatagacaatgctgtaacaaacagactaattgttcactgttgacatatagaagtactactgattgg

SEQ ID NO: 141942 - DNA, 293 bp, Homo sapiens
ccagaggcacaaggagggaggaccgacagtttgaagtgacccagctaggatggggtggcatgagaatcgaaccctggcaggttgcttcaggtgagtcctctcagaagctcacgcaggccccgggggaagcctcatctgagggcccgaggagggtgggctgctggcgcccaatgtcctttacatcttgggtggcattcatcggcagagccaggctgggcaccagggcaagaggcaccactgggaagaagggagtctgtgaggcctggtcagccccagcctcctggagttgcatt

SEQ ID NO: 141943 - DNA, 391 bp, Homo sapiens
agtgcaagactctccgtcttctattgatgagtatagattctgcctcaaagtcacagggaaaaaatcccttcctgtaaccatagctggattacatgatgattatgagtatgagttttacactcattctgttctgggttcaagtcccacctccaccacttatatagtttggatttttgtccctgcccaaatctcatgttgaattgtaatccccaatgctggaggtagggcctggtgggaggtgtggatccctcatggcttggggctgtctttgtgatagtcagttcttagaagatctggttgtttaaaagtatgtgatacctccctgctgacgcgctctgtctctgtctctctcttattcccaaaggggaagtaggccatgtgaagtgcctac

SEQ ID NO: 141944 - DNA, 355 bp, Homo sapiens
tttttttttttttgagacggagtctcactctgtcacccaggctggagtgcagtggcatgatcttggctcactacaacctccgcctctctggttcaagtgattctcctgcctcagcctcccgagtagctgagattacaggcacccaccaccatgcccagctactttttgtacttttagtagagatgagttttcaccatgttggccaggctgatctcaaactcctgacctcaggtgatccacccagctgggcctcccaaagtgctgggatcacaggcatgagccaccatgcccagccacatatttactatttttagcactctttattcctttgtgtagctctaaatctatctctggt

SEQ ID NO: 141945 - DNA, 173 bp, Homo sapiens
tccagcctgggcaacagagaaagactccgtgactttctaactgtttcaattatggttatctgaaatccagctcatactgaaaagtcaggaaaatgcttaattatttctctttaattctccatttttacaattatattgtattaaatgtggtatttctgaatgtatattgtcat

SEQ ID NO: 141946 - DNA, 189 bp, Homo sapiens
ctttgcttttacaaatgccaccaagaccctggctgggttgccagaggcagacaccccccccggccttaagtgcttaaggatgtttcccgaagggagtctgttttcccttggacaaaggcagcccatctgattgcccaggcacggggagtacatgctacaaggtgcctttggagacccacagatggtgcg

SEQ ID NO: 141947 - DNA, 200 bp, Homo sapiens
cgcgatgttccccattgtcgtgatatattgtcaatctgaatatctgtattccttacatatttaataagtaaaaggagaagaaagaaaagaaaatatggccaggcctggtggttcacacctgtaatcccactgtgggaggctgaggtgggcagaatgcttgagtccaagagttcgagagcagcctgggcaacatggcgaaa

SEQ ID NO: 141948 - DNA, 142 bp, Homo sapiens
ttttcaaagttgagacggaatttgggtaggggcagctgtttttcccttgattgttagctaggatatttgtcaagtaaactttggtgacaatcactctcttcccttttattcctcctttccttttcctttcttcccttttttc

SEQ ID NO: 141949 - DNA, 302 bp, Homo sapiens
atcccaactacttgggagactgaggcaggagaatcatttgaaccggggaggcagaggttgcagtgagctgagatcacgccactgtactcctgcctcggtgacagagtgagactccatctcaaaaaacaaaacaaaacaaaacaatccatgcttattttagacactgtttgatgtaatgaaatttctctgtaattctaaacaacaaacatcaatctgctatgagagtttttcataaattaatactcattttcattacacgacgtgctaacttaaattttaccacttggctgggtagggatcac

SEQ ID NO: 141950 - DNA, 173 bp, Homo sapiens
ggcagaggtgcaggtcctggtgcttgatggtcgaggccatctcctgggccgcctggcgaccatcgtggctaaacaggtactgctgggccggaaggtggtggtcgtacgctgcaaaggcatcaacatttctggcaatttctacagaaacaagttgaagtacttggctttcctcc

SEQ ID NO: 141951 - DNA, 234 bp, Homo sapiens
accaccgtccctctcgcccgtagatactggatcatgttcttcccactgcctggagagcgctttcttcccatctcagcttcgcgttgcctgctcttaggcgtccttcaggagtcctcttcggaattacttcttctgccttctcgatttttccaagatcccacagcaccccatcacagcgcttgtctgcctgtttacaggtctgccccctctcctaggacgggcattcttctcggg

SEQ ID NO: 141952 - DNA, 411 bp, Homo sapiens
gaatggttttccttatggcactggctagtagcccaactgaatcctgaatcaggttgtggtggcctgtcacctgcacccacacacactcagccgcagtgaggactgaatcaggttgtggtgacctgtcatctgcccccccacacacagccacagtggggaatgaatcaagttgtggtggcctgtcatctgaccccccacacacagccacagtggggactgaatcaggttgttgtgagctatcatctgagcccacaaactcagccacagtgaggggactgctgtgaaaacagtcgacatttccctttagaagctttggtgggaggcaagagggaagtgctgccctgcaggcctcgtctaagagttggtcattcccatggggggcctgttacagttctgtgattagtgcccagt

SEQ ID NO: 141953 - DNA, 246 bp, Homo sapiens
tcctccgtttgtcttaagagtcatagtagtaatagagggtgttgactgcacatggtcagtctcgttgctatggtggaaggctgtcttaacgtctgagtggttaaggattgaggaagtgatatttacttacatgcagccggtttctcctctcggcccgctgttccatagacacccataatgtcctgaaacgctggcccgaggagggtcccggctgtctccatctttatccacacggtcggcccccca

SEQ ID NO: 141954 - DNA, 1445 bp, Homo sapiens
gccccagctgtgccaccagccgccctgatttgcttcagcctcagttcctgctgcggccctggtaggatccaggagcactgaggcctgcaggggctgccgtgggggctggctcagggccttcaccacctgggggtctgtttcccttccagtctcccctgccatcctcagtgaccagggacacagatggccctggcaaggcccccggcctgctcctcgcctgtgggctgcaccccccctaccccacccgttgccctcaccctacccagctgctccacacccaggcagcccactgccttgctctgggggcggagagcagagggtccttctgcagggaggagacgcggagtgggcccagccctgaagctcttgctgacccggaagtgagagaggtcctcctttgttgctggaagccctgggatttgggggttggttttggactgtgaatcagtgactgatcagtccttgttttcaggttgtggaaagcaagggggtggtgcgtccccaggcccctgaggcccagcttggctccccctgcccgagctccccccgtcccagggccctgcagggcctcgctggcccatgtcctgcagcggggctgggcaggctggatgtggtggtgtaccccactcagagtgtctgggaagtgcagagcaggaccactctcagctcccaggcgggggcccagcaccctgagccttcccaggctgcctggggtgggggtggtcccaggactctggggcctcctggctccaggcatgtgggtggcccctatgcacagcccctcttgtgtgagcccccatggtccgacctcctctggccttgctgcctgctcagggttcatagccccagcagccccgccaaggatgcctggcgagtgggtggccgaggcaagttggagcctgtgtccctgctgttcagtgtcctggcccttccctgacacgagcagacacggcatccacagagacagcccggacaccctccaaggccccggccgatgggacagacgggcgtacaggagccataggcagcagatcccacgctccctcggcggggccagcttggctgcccagccccagctccttagagaacgggcttctcgcttcagaggagctggtcacaaaccagtggtcgcgacaaaaccattcctgtggtggagcgcgtgtggggcgcgtgtggggcgcgtgtggaacgtgtgtggggcgcgtgtggggcgggtgtggggcgcgtgtggggcgggtgtggagcgcgtgaggggcgcgtgtggggcgggtgtggggcgggtgtggggcgcgtgtggggcggatgtggggcgcgtgttgggaacagcgtccgggatgcacagagcacagcgcggtggggaggcggcaggggcggcttccacttcctccagcatcccaatcccaccgtctgggtttcttgtgaaaaacctggccgggcgcagtggc

SEQ ID NO: 141955 - DNA, 559 bp, Homo sapiens
ctttggacagtgctaccttatagatcccataacttctccatggttttgacaatcacggttttaatttagcgtcagtggaactccttaagtgctgggattgcattcatgggctgtgttacccccaaatacaaatctgtaaactctaaactcacatttgaagcagcaaattgttcatacgacaaggggcacgttggaatcaggaatggttcaaggaaaagaagaaaagatctatgctccttgtggtcatgctccctcagggacatgcacttaatatgaatgttagacaggattaaaagcgctatttaaattagaatttccacttcccactcttgcccctcagattacgcttctgattaagttcacttgcttaaatatgtatataatgctactgtagtatcatacaggataaaaaagaagcaatttcaggttcaattattctcatattgataacatatagggtgactattctattagagtcagatcctcagaaagaaatggcccagatatgtcaactctctgtaaaagtttcctctctattaattataccaacatcatttat

SEQ ID NO: 141956 - DNA, 485 bp, Homo sapiens
aataaatgagttttccccgacgttatgttgtccaggtaaagagtaactgaagtaactcaaagtgaacattcagagagggcaggcaggatgccctgtccccgcaaccttctgagctctgatccctgtggctagacaaacatgtatctagcaccttccttgtccaggagggacctggttcaaagaaggacaaactctgcacagagaaataaatgcccacttagagcccagcatggcaagaggcctcaggggcaggagggaacttccttggggaagcggggtgaagggataacatccaaattaaagcttgaagaagaaggatgaattcagagcaaaggaggaagatggggagggccctgcccgggcaggtcaaaggcccgaaggtgagagaaagtgtgtcctctttgcagcaccaaaaactactcactggagtcaagggggcaggcgagagaagcaggaactagaggccagggagccagccccctgca

SEQ ID NO: 141957 - DNA, 276 bp, Homo sapiens
acacatgatggtaagaggaggaggaggagaaggaggaagaagaggaactgggaggaagggttcaaaaaatgaggaaaggaagaaaaacgttgaaaaagtagggaacattagaatttgttagctctcctaaagtatccaggggttacacttgtgtgggcacacctagatctgctgcactcttggggttttgattgttctctttgttggcaacattctcagattctttccaagagacatcaaaataacttctgagagcctcacctcatttctaagaga

SEQ ID NO: 141958 - DNA, 523 bp, Homo sapiens
catcactttacctgacatattctattatatagattgaaatttatttcatgatgctggtgttttgttcagtttttaaaaatgaaataagaggatatttgaatagtcatgagaatcagctagagtcagtattctctccttgttatctctttcatgtttagttccttttaagtcatctccccactgaggtaggtaatggtgaaataatgtttccctgcctgtaaagcagcttaaattaaaagtagcaagtgtgtgccaggtacactacatgacttctcttcttgaatctgtggtccacttgaaatagcatttttttccccaaaagttgcttcccatcagtcttgtagttcttaatttcatttgtcaggtagtcacttagcaacttgggaagaatcatactattttgacagatactaacaggttttttggcatcttgttgcctacagttattgctttatgacttaaaaagtaagttcatactttttttgctatctcccgaaataatataattttccctcctgtctgt

SEQ ID NO: 141959 - DNA, 446 bp, Homo sapiens
tcaggacacactccctagggtcaagtacagatggtagagatgtgcttagatattcctaggcttgcctatataactagtctatgcatctatttgattgtgctgagcgctatttctggtcttaatctcaacagacacagacacacacaccttcggggccagagcaggacaagtgaaatgacaagcagagggcctgacctgtgagcgaaaattacgcagctgtcacaggccctgaatggagggagaggtggtcccgccagaaacagtgtgcccccgcaaggtgggtacgcccacggttctgggaaatgcatacctcaggtaatacaggggtgcgatccccccctactgtggtatggttgggtgctgaattttgttgtattaactttaaatatatttggcattgttctcctaggatgcagttaagttccttggaaagtaaaccttttgag

SEQ ID NO: 141960 - DNA, 738 bp, Homo sapiens
gtatcactccacaccccaggttcagtctctttgcgctttgcgttgcgtcagttctgggaaattaaaattgaacttggctttgttaagtgggtagtccccaactagaagcgtggaagcagagtggcagacgctagccttcaaatgatgcaagcctggaggaccctgtaaaagttttcacccaaatgaggaaaattagttccgggacacgtgtgtgtgtgtgtgtgtaagttagttacgggacacgtgtgtgtgtgtgtaagttccgggacacgtgtgtgtgtgtgtgtgttttctgaggtggggacggcgactttctcaaaggatgtccggagctgtgtttcgttaccagcaagtcagagttcttttaaagactgtccaggctgggcgctgtaactcacgcctgtaatcccagcactttaggaggccgagatgggaggattacttggagccaggagttccagaccagcctgggcaacaaagcaagacccccgactctaccaaaaaaaaaaaaaaaaaaaaaaaaaaagctcgaaaaatggacccgggtgtgtgtgggggccccccaccgtgtttttcccagctacccggggggcgtggggccaaaggaactcggtggaaatagaggccgcagggttgaccctgataatgggggccatcgtgcctataacagccggggggtgaacagaagacccccattctctccaaaacaataaacacaacaacacaaacaacaggggg

SEQ ID NO: 141961 - DNA, 369 bp, Homo sapiens
tcacaagcccatcatatccctgcacatgatgtgggaagcgaagtgcccatttgttgacaaaaatcacaaatcagggcacaatcaagatactacaagcttttcaggtgctcaatgggtataaatgataccaagttataaattcttctttgcaaggaaaatatcaaccacaagaataaattaagataaaaatgtgccctgttactcctgctcccactttccctcccaaaaaaatgcacacagcacacatctcaatgtttagaggcattttggcatatccagttgcctttcttgtgggggctggccaaagactgactcagctggtatgaaacaaatcagcaagtgacctcagtagtgacccctattttccaa

SEQ ID NO: 141962 - DNA, 386 bp, Homo sapiens
aattattaagagcacagccatagagccagaaagcctgtgctcaatcctgactttaccattttccagcactgtgaccttgaacaagtaacttaatctgtgcttcagatttaccacctgtaagacaggcctgaaaaactgtacttacctcatcaaactaacatcttatctatggctgtttttgtgctatgacagctgacttgagtatggctcacaaagctgaaaataccaacactctgaccctgtacagaaaaatgtattgacctctgatatagaccaatgaggttcattaaattttaagacatcatttctaagatacaccatttttatatgtgccacattgcatatacaataaaaagcactgctgattaacaactgtaaaatgccat

SEQ ID NO: 141963 - DNA, 229 bp, Homo sapiens
ttgtctacatgtatgctgggcatatctttaagaatttaagaaattcaacccaaatgacaggatctgtcacagggatcatcaatgcctgtggcttcaactgcccctcttgcagtcacgccaagtgaatcaaatctctggacacctccagaccagatctctatgctgatcccgttcctaaatatccaacatgatacctgacagctttacccagctacaaccaactcttcag

SEQ ID NO: 141964 - DNA, 723 bp, Homo sapiens
ggtatggatagcactttatgacaaaataggactgatttttaaatttagcagaattatctatggattgtctagatctcagctgatattaaaatataactatattcaagtatttcattagattaaagagcagaggataaggctgaatttaaaaattttatatctcggcccggtgcagtggctcactcctgtaatcccagcactttgggaggccgaggcaggcggatcacttgaggtcaggagttcgagaccagcctggccaacgtggtgaaacaccatctgtactaaaaaaacttcactgggcgtcttggcgcacgcctgtaatcccagctactggggaggctgaggcatgagaatcacttgaacctgagaggcggaggttgcagtgagctgagattgtaccactgcactccagcctgggcaacagagcgggactccgtctcaaaaaaaagaaaagaaatttatgtcatcttcagtttaaagtgaatgaagccaagtgcggtggctcacatttgtaattccagcccttttgagaggccagggtgggtggatcacttgagtacaggagtttgagaccagcctgggcaacatgatgaaacctccatctccacaaaaaaaaaatttaaaaattagctgggcatgaccgagtgcggtggctcacacctgtaatcccagcactttgggaggccaaggcgagtggatcacttgaagtcaggagttcaaaac

SEQ ID NO: 141965 - DNA, 529 bp, Homo sapiens
agtgagatatatatatgtgtatatatgtatatttgatgatatatatgtatatttgatgatatatatatatgtatatttgatgatatatatatatatatatgaaagtttacttttagcttaggatacttgtgcagcaaataggtcaatggtagggagatggactgtgctcatcactgtcattcagactgacaaagaggctacccaacattgctggtgtttgtgcagaagggaaaagaatggtctgggtcaggtgcagtgactcatgcttgtaatcctagcactttgggagactgaggcgggtggatcacctgaggtcaggagttcaaaactagcctggccaacatggcgaaaccccgtctctactaaaaatacaaaaacttagtcaggcgtggtggcacatgcctgtaatcccagctactcgggaggctgaggcaggagagtcacttgaaccctggggatggagattccagtgagccgagattgcgccacttcactccagcttgggcaaaaagagcaaaactccatctca

SEQ ID NO: 141966 - DNA, 251 bp, Homo sapiens
gtaaaaggttgataatttgaacctgtaaaaatttaaaacctaaattgagaaaattgtcaaaaaacaaagtcaaaagtccacacactgtggaaaactatttgtaacataatatcagataaaagctactcaggaggctgaggcaggggaattgcttgaacccaggaggcagaggttgcagtgagctgagatcatgctactgcactccagcctgccaacagagcaagaccctagctcaaaaaaaaaaaaaaaaa

SEQ ID NO: 141967 - DNA, 275 bp, Homo sapiens
aaatctcatcccaacaactcaatgtgccctgacacaccctcttcccaggctgacttactgccccagtgtgctgggaacggaggaatttcctgggacgtggaactttaaaactgggagtgtcctgggcaaaccaccctacttctacttcacctctgttagcctcctcaatcataccctcagagtcctgcgacacagtgtccttcagctgtcctccctttatctcttctactgaactgaaacttgtgtgtctccagaggaccctagtgaccttctca

SEQ ID NO: 141968 - DNA, 749 bp, Homo sapiens
gcgcgttgccccgggagcgcccgtcgtccgggcagagcgcagccgcaaccgcgaccacagccgcagtcgctttccagcctgccttcggtgcgcagcgggggaacagggctagtgcagccgccggaggggggcacgggctcctctcccatcccagagctactgggctgcccttgctgtcctcgccgccccagcagaccccggccggacctgccacctgcgccctggttgcgccatggatccttcggaaaagaagatatcggtgtggatctgccaggaagagaagctggtgtccggcctctcccgccgcaccacttgctccgacgttgtgcgagtgcttttggaggacggctgccggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggccatgacccaggagaaac

SEQ ID NO: 141969 - DNA, 369 bp, Homo sapiens
tgatgttttttgattcccgcattgtgatatgaagatgagcagacatcttcttccccatcacctcttcttcttctcttttacataccaaattctgttggctatcgttctatattgtcatagttcataatatgtacattccatactgtaaccataattattacatttgagttctgtttataggttgatttagaaagttaaaagggaataaacagcatttacattattatttctgcataagtagcatcaatggcaaagtagtaggttatcattatgattccttttctacagtgccattgttgataacccctgacccgctcaaaagaatatatttaaataatctttctaatcaccagttcatcaaaattatga

SEQ ID NO: 141970 - DNA, 347 bp, Homo sapiens
atgagtcgggcggtgcaagagcaagagaggtgggaccacggggagaggaggaaaatttgagtatatacttgtgactggtatataaaaaaataagccgatgattaaagaaaaaaaaagaggcaagttttaactgcagaaaaatggtaaagacaaaaggtatagttgtgcaacaaggaaaaacagttgtaaaaaaaaagaaatgcccgtggtcccacctcttcagctgggcgcggtggctcatgcctgtaatcctagcacttggggaggctgaggcgggcagatcacttgaggttaggggttcaaaaccggcctgaccaacatagtaaaaccccggggtcccacctcgg

SEQ ID NO: 141971 - DNA, 416 bp, Homo sapiens
gtattaggatatgggcacagcacataatgagcaccatgtgtttgccattttatggaaactgaagctcaagaaagttatatgacttggcctacgtcacatgagtaccacatggaagagccaggacttgaactcaagtctgtccaactccaaagcagccctctcctcacatactcagggcattgagctccttgatggatgagtagaatttttagattgaaggaaggtggacaattcaggttgttcacagagatgggaatgggctgcatagcaactagtagtagttccagggtgagtgccacatccccacagctctaacatccagtctgatggatattcaagtcactggacacaggattccgagcgcctactctgtgccaggtcaggtactaggtattgagaaaggagaaagaaagcac

SEQ ID NO: 141972 - DNA, 460 bp, Homo sapiens
  misc_feature (190)..(190): n is a, c, g, or t
  misc_feature (394)..(394): n is a, c, g, or t
  misc_feature (416)..(416): n is a, c, g, or t
aatatccaaatgcctgatggatagtgctttcttttttactaccaagccctcaaaggcactatgttcaaaaggaatttgtcatcagtctcacggcacataagcttcctcttgtgttcaatctggagacttgagagtcttcctgttcccttcttctccttattttctccataatcaatcacaaagtcatgtnggattttgctcctaaatatgttaacttctttcctctctcactttatatcccttacatctaggtatttcagaccctcagtctctctcacatagactttggcaataaccttctaatatcagtcaacctgaccaataggccaccagtgcttcatgtagaatctggacaatgtagagcactgagaatgctcacactggtcatatatgntatgagttggtatgacatctangggaagttgaagacttacatagcctttggcccagcaatatacac

SEQ ID NO: 141973 - DNA, 672 bp, Homo sapiens
tcaattaattaagaaattattacactttaactttttataataaaccccagaaggtattaatgtttgtatgttttcactctttttctcccagtgtcatcctgctcactacttttttatctaatttgattccttcactcatttccatttgtttattcactgttgtaatatacatttattctctaattgtgcaattcgatctctctgttatctgatattggtgtgtagtgggaattgtaggtttgtaataagacagacatggatttcagtcctggtttcatttctagatttgtatttgtacctcattttgcaagtaatgtacataaagcacaatgtattggcactcaatacatgataccattattatttgagagagtttttttgcttggtttggatggaggtgattatcgccttctttgttgctcgctacacatgctgttaaagttggctttccgcttttcctaatagaataactactgccatgcctcctcacctctagaggcctagatgccatacagcgagcagtccctctgtatctgtggggaattggttccaggacccccataggtaacaaaaccagggatgttcaaattccttatgtaaaatgacataatatttgcatgtaactgcatacattcttctatatactttaaattgtttctaggctgggtgtgg

SEQ ID NO: 141974 - DNA, 313 bp, Homo sapiens
cctgcaaagtgaagaagctcagactagtctactggaggatgagaggccacctgaagcagagacaagctgtcccagctgaagatcacccatctctcaggcaaaccagccttctagtagctatgtgagtgagaccatgctggattaaccagtcccagccaagctggcccagactaaaatagtccaggtgacccacaatcataagattgtggtcttggcccttaactgttgggatggcttgttacacagtatatgctaactgatacatccactttgttttctggttaacatctactcctcattcaagtctgaggat

SEQ ID NO: 141975 - DNA, 380 bp, Homo sapiens
tggcaccagcgttgcttctggtgagagcttcagaaagcttccactcatggcagaaggtgaagtaggggagcaggcatatcacatggtaagaaagcagcagtgggtgggtgtcaaactcttttaaacagccagttctcatgtgaactcagcacaagaactcactcattactgctgtaaggagggcaccaagtcatccatgagggatctgcacctatgatccaaacacttcccatcaggcctcacctccaacactgggagattacatttcaaactgatatttgaaggggataaaacatccaaaccatgtcactgattttgtacttttgtgtgttttcataatggtgaatatcacctgagtttagaattttttttagcttttc

SEQ ID NO: 141976 - DNA, 299 bp, Homo sapiens
tggagtcaggatctccttaatgtaccagactctttcttaccccccactgtctacccactcacccaacaacatgcttctctctcgccatgcagagctactaatgttcaacctcccacttcactggattccctatgactccagctcagcagagattctgattttggcaacacttttttaagccaaactttgaaagcagctccacttccagagggtagcctgtttcatgcttttctgtgttaaattgactttgtttaaaatggctctttgtttgcagcacatgttcagagttgtagctgtgt

SEQ ID NO: 141977 - DNA, 480 bp, Homo sapiens
ctcattcacacctattgattccttatgcttcgaacctctgcttcccagatctaccccatatagataccttctagagaacatgtcacaatcatgaactattctccattcacttgactgtcatctgtcactcctaagagatggaaccccacagggctagggcaagtaggggttgctatccttagcatgcctggatgtcatgcccccgtccaccctccaccggaggctataacccaatgaatgaacccaggttctaccactttctagcaatgtgacccaaggcaaactctatcactcctgagtctatttcctcatctataaaaagatgagggatacgagtgtgatgcgaggtcaggagtgggggtggctatggtgaagcgtgagccactgagcccgctgagagctgtccttttaaaacaccagatcctcatctctagctagcttattctgctagttagtgaagaacagggaagggagcatgtg

SEQ ID NO: 141978 - DNA, 536 bp, Homo sapiens
aagggctggcagatcaggcagggggaaggcctgtggggtggggcatttgccctgcagacctggggagagaagctggctgcagtagggtgcacttgggggacagagggcatttttttgtcacagtggaggtgagaacttcccggtggagattcagcagagtttttctcctgggcagtgggcaatgttgggagtctgggcccccagcacccggctggactggccaccatggagtcctgccctcggccagtgcatccctgccagagctgggggtgtccagccagacagtcagcattgccaggggaaagagacgaagccacaggtttccaggggctggggacagcattggagggccccaggaggcatggccaggtgagcatgggtcaacatcaagaagcagactgggcaaaggcggcatcccaagctcctaggaaaggaggtgtcagctgccccaggatggggccacagaggcagaaccatagcccccttcccagactaagcagcccagccaccagctgccagcagccagggccctgaat

SEQ ID NO: 141979 - DNA, 440 bp, Homo sapiens
gtcaatacaagagagcacgggagcagaggagagaaccctctgagaaggggaagaaagaatgagtaagaataactgaagaccttttgagaatccacaaatcttgtagctgcagctggattcttcatgcatggtgattagccataaactagaaacagaaagaggccccatgcttttcttctgggacagtgaaagagatggaaacctcagctatcccatctcactctccagccagcctcaagtcctggggtggaggcagcattcaaggggagcacaaaatagatggagtcctgggaagtgggagaatataggcaggaggctgtcacgggaatcagaaatgaccctgggtggcttctcggacaggcctgcatcattctggaaacttcttcactttagcctccaagaaacaagcatcccgtggtcccacctctcaagagcaattc

SEQ ID NO: 141980 - DNA, 265 bp, Homo sapiens
tacaaaataataaagttgggcccctacctacttcataaaaattaactcaaaggccaaaatataagagctaaaactttaaaactctcagaagaagtgaaaatctttgcgaccttgcagtaggcaacagcttcttagatgtgataccaaaaccacaagcaacaaaagaagaaacagttaaattaaacctcatcaaatgaaacacttttatgcttcaaaggacaccatcaagatagtgaaaagaaggccaggcacagtggctcacatc

SEQ ID NO: 141981 - DNA, 171 bp, Homo sapiens
actttcaaggccatgtggtaagaaaagacaataaggattttggtatacaatttaccagaagagtttaatgaggcaagatcaatgggttaacatttcaacgcagggtaaaatgtgaagcacatgacaccagaatatgctttaatatagccatgcttgcagtggatttatact

SEQ ID NO: 141982 - DNA, 409 bp, Homo sapiens
tgtgtgtgtgtgtgtttctgggtaattcagtaaggcccacgtgcaccctgatatcataaggtgggccagaacaatggttaagagtgttgggtatgcaggcagatcactaggcttcaattccctgcttggccgtggataagctctgtgaccttgggcaagttatccagctctcatctttctaatataaaataaaggcaaatagtatataaatcacaggattaagtgagatagtccatgccaagtgcttagcacaatacctggcacatattaagtactaacttgactttgaaagagagtggcatgatttgcaacatagatcctttgaataatgtctgactacctggaatatcagaagtttatggtctgtaagagtgatgtcctgtgggtcacctgtgcttcttcaacaagg

SEQ ID NO: 141983 - DNA, 185 bp, Homo sapiens
aaatttgctttcagtacctatcaccggggaaggatcttatcacctaattcataagaaagcatcagtagtagataaggtcaaatgaggcactctcccatggtgatttatattttaaaaggaaataatttctaatagcatatggaaggactctttaatgacaagtcattagtgaggtgaaaaaaaat

SEQ ID NO: 141984 - DNA, 534 bp, Homo sapiens
aaatctggtttcataatagctgtaacgaaataagccttaatgatattttattagcatcatcttctgtctgcattagcccttccttgctcttcaggagaacaacatttgttttcctccctaggctctatcccaaacggcacattcttccacaacccctgttgaacagattttttaaactgttgcctaatctaaaaacaataaaaacaacaaacaaccacagtaacaacaacgacaaaaaaaactgccacagattctaaataatcagatctttttaaatggtatcaatgtttcccacaaaatattgttgacattgaaaatatagaattttagcattaattttgttaaacctacatcccctcggcagaggggcctccctgcatcccagtggaaagtaggttcctcacagtcctctccgtcacattcttcccatttcttttcttcacagaacacatcactgtctaaaattatcttgtttgcttagttgcttactcatcttcttcttctctcctctgaagtctaagctccaggaaaaag

SEQ ID NO: 141985 - DNA, 241 bp, Homo sapiens
actgagcctgacccctgctctcgtgtcaacagtcctgctcctcccggctcattctgctgagccccatggccacctccaggaccttctcctgggtggaatcctgccgtgggtctgcgagattgtgaactacatctaagcaactccatggctgagcccatgccagctttttaaagccaagttttcattttcacagagaggcctttgccttccaggtggctcagaagcctgaatgataacaggg

SEQ ID NO: 141986 - DNA, 773 bp, Homo sapiens
gccagctttgtaggtgactgacctagtaggcatgtggacggtgtctttgtcacagtcctagccagtcccattttaagattgcctctaggcagcttggctggtgacttagtctcgccttttcaggtcccgcagggctgcgttcccgcagaattggatgtctttagcctcctcctgagcccaattcaaaactaacccaaagccgccaagcccaacagggaataagaggacagaataaggtgttaaacaacacaatgggatgctgtcagcagaatctagactatgagaagccacaggacagacaaccttgtttcttcaaataaattgcaaggaagagaggagtgtggtggggaacctatagattaaaaaagacttaagagatgtaacacatggccccttgtgcattttattaggatcctaattcagcaaacacattgaaaaaaatagtatgatacttattataagaactggaaatttggacactgggtagttgataaaattaaggaattgtgaaattacaaaattttaattgtggtaaaatacacaaaatttaccatcttaatatgatttaccatcttaaccgtttctaagtgtacaattcagtactgttaagtacatttacattgttgagcaatcaatcttcagaactcttcatcttgcaattaaaagaatgaaaaatagtccgagtgcggtggctcacgcctgtaatcccagcactttggaaggccgaggcgggaggatcacaaggtcaggagttcgagaccatcctggctaac

SEQ ID NO: 141987 - DNA, 255 bp, Homo sapiens
cctgtgtctcctccagcccgaataccttcctgatctccatgccaggtgccctggcccagacagcaggagaaagaaaggactcctctctgtctcaggctcctcatttgtaaaaagggagaaataatacctaccccacagtgttgttttgaaggttaaataacagttcacctgtggccgggtgcggtggctcacacttgtaatcccagcactttgagaggctgaggagggaggatcactggagcctaggcgttcaag

SEQ ID NO: 141988 - DNA, 470 bp, Homo sapiens
gacctgaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagc

SEQ ID NO: 141989 - DNA, 647 bp, Homo sapiens
ggacgcgtgggtcgcggacgcgtggggtgttcttattagggtatggtgcatagcagttcatgtgtccacagaagaaaattcattgtctaaaaatataatctactggaaacagtaattattttacttcttttaccttatactagtccatggaaacttggcatacactcgaggaataaggagattaaaaacataaacctggtgtcaagtcatatgagcaaaaacaaattcattagaaagaaatttctatcagtctggtcgcagtggctcgtgcctgtaatcccagcactttgggaggctgaggcgggtggatcacctgaggtcaggagttcgacaccagcctggccaacatcgtgaaaccccatctctactaaaaatacaaaaatcagctgggcgtggtggtgcatgcctttaatttcagctactcggaggcagagacaggagaattgcttgaaccggggaggcagaggttgcagtgagccgagattgccccacttcactccagcttggggtgacagagtaagactccgtctcaaaaaaaaaaaaaaggaacttctatcaaaaaaatccctctgagttgtgtaaagatggcttttaaaaaattttttttttttacaaagatactgatcaaatttatttataatggaaac

SEQ ID NO: 141990 - DNA, 400 bp, Homo sapiens
aactactttggagcatacaacaatctagaaagtgaattaacgtattttgcaggataatataaggttaattccaaaacgaaaagagagcacactaatgatcatgtatgcaaatattttaatatattagcaaatcaaatcaagtagcatagtaaaggaataacccatcatgaccaagtagcatttaatcccaggtaagcaagacttgcttgacagtaagactcactacgttagcttagtagagtaggaaaaactagatgacccgaacctctcaatagatagaggcagagtaggagaagagaacattttagctgttgtttccttcacttgattagggcattttctgcagacccacagcaaagatcccatctactgatgaagccaagacccacagcaaagatcc

SEQ ID NO: 141991 - DNA, 264 bp, Homo sapiens
cttagctctttcggggtcttagctctttggggtcttagctctttggggtcttagctctttggggtcttgcttgacagtaagactcactacgttagcttagtagagtaggaaaaactagatgacccgaacctctcaatagatagaggcagagtaggagaagagaacattttagctgttgtttccttcacttgattagggcattttctgcagacccacagcaaagatcccatctactgatgaagccaagacccacagcaaagatcc

SEQ ID NO: 141992 - DNA, 403 bp, Homo sapiens
tataaccaccaacaaatcatatttctcacagttctggaggctggaagtctgagatgagggtgccagtatggtcaggttctggtgagggttgctttcacgttgcagactgacaacttcttgtgtccttacgtcatggaagggaccagagctctctcagacctcctgaataagggcactaaccctgttcatgagggcttcaccctcaagacctgatcacctcccaaaggcttcatccctaacactatcactttggggattaggattccaacacatgaatctgggagagacacaaaacattcaggccatagaagctcgtttcccatttatcagtttggattctttcaggctgactaccaaaaatcctaattctgaataccagaaaacctaactcaggggctcccac

SEQ ID NO: 141993 - DNA, 785 bp, Homo sapiens
acattttcactattttactttgaccaaatactttctccttcatttgaaattaacttgaaatcacaggatttcagagttgggagcaattatgtggcttcctcacctcagagtaggcagctttggtattactacattattggtgtttccagtgagaaagctaccacgaggaagcaatctgctcacagctacaggctgtgttctaatttgttaacagatactactatgtaagtatgatcaggaaaagttttattagcacaacatgaaatagccttgactttgatcctttcataaaggttggtaaagctaatatttcctttgacatgttgaaaataccttgttatacaagtaataaaatagtacatttcatttaaaatttgaaacaataaaggttagaaacgtgtcatccacagaagcatgcagaaatcaacatagttaaagccagactttttactatgccatgacaagataatataaaattgtgtactatcaataaataaaacatgcagtataaaatatctcattgtactctgttttgggacatttgaaaccccagttagaaattaaaaagtcatctgggctctacagctcacacctgaaatcccagcaattttcccggctgaggcaagcagattgcttgagctcaggagttcgagaccagccagggcaacatggagaaaccctgtctttacaaaaaatacaaaaaattagccgggcatggtggcagatgcctgtagtcccagctaatccagctaattatttatttatttatttttgagacagagtct

SEQ ID NO: 141994 - DNA, 345 bp, Homo sapiens
gagagggagatgaaaggtgtctatgatatctttatgtaatcggttaagtgatgaagaaagacgagaggtcaacagagatttctggcttcatctggtaactaaaggtatttaggcacttggtagtaaacaaaggccagggggagaaaagagaaagaaagggagggcatagggagaaaacagaaaagaagaatctcagtgggcaccaagaaccatgagaatctcactactcggaaagacaaaagaacttaatcagagggatgcttaggctgagacaaagataaaaagtgaagaatccagacaaatcaaaaagactattccaaccctaaccccactttggatgccagg

SEQ ID NO: 141995 - DNA, 363 bp, Homo sapiens
agctggagcgaacaggaaaaacgggctggtaggtgacactcaccaggcagcaagagaactcgtcacgggaggccaaaagcacgaagtggcttagtgattagggatttgatgtgagtttttgttgttggtttatttcaggggatggggagcagaaacaaaaaacactgggcaaagcttccaaacacccccacccaaaatttcaggttctaagaggccacttcctttttatctcccgctcagtgggcccagagcaaagcatggtgggcctgttcggtttatactccggagtataaaccgaacagggaatcagcaataaaatgactgacagggtaagtaggagacggtcctgtcgcttgtcctgct

SEQ ID NO: 141996 - DNA, 128 bp, Homo sapiens
actggttatttataaggaggaagcacattgacctttggctttcactactgaacacacagtcatggagaccaaaattgtgtgtgaaaatcattcagtgaccacaggagattctatctgaacccgagtcg

SEQ ID NO: 141997 - DNA, 205 bp, Homo sapiens
tggtcacagctacctgtatgtagaccagactcatgcttctgcgggttggagcttaagatccaaactgagaaagcaggccgggcacgatggctctggggtgggggaaataagaaggggtggtcagagaggaaaacagcagggaaaagggactggggaaatggaaactgcccttcaagcatagcaacctgtggtgtcaggaaagagc

SEQ ID NO: 141998 - DNA, 1139 bp, Homo sapiens
gctgtaaggccgaggttgcggcggaagcggagaccatgttccgagcggggctccggggcagctccggcgggcggctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagtggtgcttcccgtgctgctgttgatgctggctttgtccccatgacatgccagttggacggacggggaaacatagtaagcacagaacgttatattgctgtggatatccggagccatccacattagctgggatgaaagaccgccagacattgtggcattataagaccgagctcccatttcagtggcatagggatcttgcgattattagggctccgcagctgcgcttgggaaagcccggcctcgtagaaaacttgacttccgaccgcttgggttcaacaggcacgggcgcctccctgggagcccaccagggcgcggcgcctgcgccaggtattccacacccaagcgcgcgccttgttgtggtaaagttaacgctcc

SEQ ID NO: 141999 - DNA, 218 bp, Homo sapiens
ggctattacattgttttcttttgacgctgtttgagataaaggctctgcctgccctttcctctagtctaggtcatttatagcacagcctgagggcagaattcagggtgtcatcctgcctagctgtctatacaggctacccttaggcaatgaactcatttgaaacatgaggttgcctgtgtgtctcagcttctgttagccccagtgctgacacaggtcag

SEQ ID NO: 142000 - DNA, 759 bp, Homo sapiens
accccaccggcgggtcttgggctccgaacccagggcgccccgcgcaccgagccgttgcgtttgaaacccacagaaagaattcccccgctcgacgacggcgagggtgtgggagctactggcaggcaaattggtgggagccgcccggcccagcctgccttgccgagtcagcgcgctcttgagccgctgggcccttcccggtgcccgcctggcagcgcggcgcggctggggcaggggtctgctgggggccggggactaagggctgtgggcccatccacacacgcctcatcccttctttccgggggcagcagagcagcagcgggagaccgggagcaggaggggtagggcgagagaaaagcaggacctgggccgggggtgggagtcgggccgttgacgctcgctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgcccgcccaggcgcctggttcctgagctccgcagcattccactgttctaagctactggtttttgttgacttttaaatattttcttctaagggagagggggagggaggcaaaagtcaggaaagagcaaataa

SEQ ID NO: 142001 - DNA, 764 bp, Homo sapiens
ggtttcttaaagagagattcgatgaagtggaggggtctggagatattcggctgtcatcatggaaaataatatatcccctctctctttttctttcttcttcctttctctctttctttccttccttcttcctctctttcttttttctttccttctttctctttctttccttccttccttctttctctccctctccttccttccttctttctccttccttccttccttcctctttcttttttccttccttccttctttctctttctttccttccttcttctttctctccctctccttccttcattctcattccttccttccttccttcctcttttctttctctttctttccctttcttcctctttctctccctctctttcctctctctcctcctctctccctctccctctccctcgctctctctctctctctctgtccccctctctttctttctggatccagcttttactctgttctaggccctggaaatacaaagaagatggacacagacactggtggacaagggggcacttcctggccttctgaagctttgggtctgagggaggacacaggcagatgctgctcacatcttcattttctgcatcggtctcaccaggatcctgagaggaggagagggcgggtattagatgtccccaagaagtgaaaaaagaagtgtcaccggcattaaagactgagcaaggaggcgtcaaatctccttgaccccatgctcacagcacagctggaggagacagaggtctcgccttcac

SEQ ID NO: 142002 - DNA, 541 bp, Homo sapiens
cgtgtccctgagcctagatggacggtctttgtggatctccaaaagaactggagagtggcaattctccctatcttatccagacaataatgaagttaaggcgagcctcagcctccctcccctggagtgtttgtgctacagctgacatctttcctagggacaataattgagtgctttaagaggcgggctccttgatccccggatgtaatccagcatagctaaaagataagagataagatcaagcttaaaaaaagagttacttaagcagaagggaataaaggtcacaaggagctgatactatgagaagccgggttaagatgaaaaccaaaaattaaacattctaaagaaaattctgcctggactggcccagtccattctgcacctcttgccctaaataaaaaagctgacacgtgctttggttctggccagagcaggcaatgtttctggaacaacttcaccttggttacatatttctactttaaacattccaaagttgctgaaggcctcccaggagcatctgctcctgtttctcgggagggagtta

SEQ ID NO: 142003 - DNA, 461 bp, Homo sapiens
ggagacagagcgagaccctgttcaaaagtataaatgtatggctgggcatgatggttcacacctgtaatcccagcactttggcaggctgaagagggcagatcacttgaggtcaagatttcaagaccagcctggcctcaggtgatccgtccaccttggcctcccaaagtgctgggattacaggcatgagccactgcacccagccacttttttcatactgacaaaaattactggtacttaacactggagatttgtatctaaccatccacttcatgccccagattgctagacagaaagtggaatcatctcctttaatcaagcaaattcccgtctcataatggggctgtgggaatttctctagaggacatcatttagggaaaaacaaagaaggcagccacttccttggcctttgggtatgtgctcttgcttcttgtgccctgagagtgagacccctttataatctg

SEQ ID NO: 142004 - DNA, 305 bp, Homo sapiens
tatatgggcaggggtgcaaatgaataggcattcttacaccctgctggtggggtacggaaagcccagatggtataggttatagagaaggggatgtgtaacatgccattttggcaaggagtcctggcagatttttaagagaactgtctttgtgtacttttcaaaacatgttttcctttgttattttggggttcagagcatttctttgaaacttcttgaatctccccttgactggcagcctgttagttgatcctccatttgtgtattgtgtgaaaactccctgtggcagaaatatacacacacatgtc

SEQ ID NO: 142005 - DNA, 191 bp, Homo sapiens
gccgtgctattgactgtttcccttctgcccctggggctcagagagggacaggagcatcaggtggaccgtcccccttcaagctgtagaagccatctttttcacacaacatttcctcaggccaggagcatggggaaatgttgtgtgaaaaagatggcttcaacagctaaaggggacacgggagatcctataga

SEQ ID NO: 142006 - DNA, 447 bp, Homo sapiens
ataaaagtgcccaggctggacagatgtgagcgagaatctccgtcatggccactggtgtaaacgcagcaaagcagaaccgccagggatccggatgggatgaaatggtttcccacgccggaggctggctctcaggagaggactggctttgtgggctcagcacagcctggtcccaagcttgctgaccacaggcagggcctggctggcaggaggggccagctccagagagggagggaggcctgactgcttgggataagaaatcagagagaaatgggcagcccgaggtgggaggcaggaggagggaaacagggggctgggaatgctgtaggcatctgggagaagcggccagccagaaattccggaggtggggatggctgaggaattttaaagagatctttaaaaaaggcatctctagtcagcgttaaggaattagctataacctctccctgg

SEQ ID NO: 142007 - DNA, 185 bp, Homo sapiens
tgttgtgtgacctcgagcaaattgttcaagcttaaacttcaatttcttctttaaaatgggactgggctgggcgcagtggctaatgcctgtaatcccaccactttgggaggccaagccgggtggatcacctgaggtcaggagttcgagaccagcctgatcaacatggcgaaagctcgtctctacta

SEQ ID NO: 142008 - DNA, 234 bp, Homo sapiens
ttatttttgcatatgggatttgaaggaaagagagggatcaaggataactcagtcaccactttgacctagaaaatggggtgactggtggtgatcgttattgacctgaggaggatgggaatcagagagtttaggggtgtagttggtaatccagaggttttagaaatgttacatttaagctgcttattaaatattcaggtgaagagtttgagtaggttattagacacatgatgaatc

SEQ ID NO: 142009 - DNA, 281 bp, Homo sapiens
ctctacatcagacagcaaatcgcctctcctcagctggctgctcctctgagtcggcacagccccagcctctgcatccccagcactccctcttccttggcccttgcaccttggcatccacactgatccttccatgggtccccagccacctcacaaatgaagacactgaatgtgctgaccgggctggctctgagcctgattgccagcctctagtgtttttctacaatatttctactcttttattttattttactttgagacagggtctcactctgttgcccagt

SEQ ID NO: 142010 - DNA, 201 bp, Homo sapiens
acttggtacacccacacaacccaataaagcctgtagccctggtaagaggctttcctgtggaggcagtgaacacctttacagggagctggggaggattggttgattgtctagagaagtcggttaatatctcatatttggggccacacaagaatcaagacaatcatttgctgacaggcattctccctagattctggtcatttt

SEQ ID NO: 142011 - DNA, 177 bp, Homo sapiens
actggtacctctgggaaaaaaggatcaaaggaatggtggaggtgaaagcttaattggaagggggtaaatcaagaactggaggcaagactgaagacagaaatataaacaagattttagtgtactgtgttctcaaatggagcgttgaagaggggtactcactacagggagagatgtaat

SEQ ID NO: 142012 - DNA, 651 bp, Homo sapiens
tgtgatcacctctcccgatcaccgctgagccctgcaggtcaccttctcctgacctattacaccactgattgcttatgctgggcacaattttatacccttgctgttgttcagtctaatcatccctataaccctatcggatcattcccatatgacagaggagaaaacctggggacacaggggctgtgtcctggccaaggccttgcttgcagcaaaaggcagagctggggtctagccaggagccccagcacagtcctgttcttcccccactaaactgagctgtgaaatagatcatggcggtctggaaaacgagctaattccgtgccgatggaggtgttgatggatgtccaccactctccacttgggaggaggccttaacatccccctcaggtctagcttctctctgtgactgagtaccttgggaaagtgggctcagaggaggaaagggacttacttgcccaagggccacagctgccaagtggcaggtaagggaccgttattctcctgtccctttcacagaggacaggaggaaagtgaggacaggtggggtacatgagtttagcctcttttctgcagcaggcccagatcagctttgcacacggttggtgctgacctcaaatgcagccctagaggggcctgtctctgccctgagta

SEQ ID NO: 142013 - DNA, 249 bp, Homo sapiens
caggagccaagtggccagggtgtgacgtccctagtcgtctaccaactatgtgagactcagctcacccactgcacagggtaacgtgcgttagcgcgtgacaggccctgggaaccatgcctggcgcaccgtcagcacatggaaggattagctattctcgttatttctgactgcttggcccatcacaatgcctgtttgggtcttcctaaagcccagccctggaagctcccttcccttggcactctggacaca

SEQ ID NO: 142014 - DNA, 301 bp, Homo sapiens
ggaaaagaccagtcaagcctccaccagtttagttaccataatggcccatgccttgaaaaacatttcaagttagtctacgcgggcatccttttctaggagagtcattgttaatctcataatggcaagtatatggaaaaattccattgaatttatgtgaattcaccttctatccaactcttctatattgactgtctctcaactcttaaatatagacccaagcggtggtaagttgcagggtggaatttctaaaatggtaactcctttaaaatcctttggatttgaaatacgttcagatacacct

SEQ ID NO: 142015 - DNA, 332 bp, Homo sapiens
catagtctcaatgcagatgtcacatgtaactttgttattaatattttagttacttgtggatatctcatatcttctttggtttctttgttatagaacattgtcttcccataaacttgaatattgtccctttcccttagaaaagggaaatgtgggagaggtggggagatggttacatcaacccaatttttgcttcttaaaatgggcttttgttgatgtgagtctatggtcccatttattgttgtgacaatatcttggtagtgggaattactgggtatgttggagaacctcagaagggagaatggtcatgttctccagtgccgtatctgaatatc

SEQ ID NO: 142016 - DNA, 504 bp, Homo sapiens
aaacatcaaggtaacaacggagagggttccaaaatccctaagtaaaaattactggatgccagaaattttatatttattatgacttaattaaaagagtcactggttcaatatggcagactttgtacatctttatttctctccccacccccaaatcccattaaaatgagaagaaacagaaggtaaaaacctgtaacaacaaagtgaataaaaagaagaccaaaagcaaatgaaagatttaaatacaattctaggagatgaagagaaaactgaacagaaaagattactaaaacagagcatgaaaaagtcatagcctagagtccaaaggagctgaagcttaagaagttgtgaacaaccttgtctaacttttagaatctctaaaaatgaaatgatagatggtataagtagtgagctgggctagacataaggattaactgaaagccttaatactttaatactgagaggtcaacctcatctcttcccctacttgaatacccagcaaggcct

SEQ ID NO: 142017 - DNA, 376 bp, Homo sapiens
cttttatatcttcataatgacacattttaccattttcagaatcttctttgatattaaaagtagagaagctattattaccccatcctatagctgaagaaactgaggttgagaaagattaaatgatatagccaaggtcacttgactagtgagtggcaaatatgtctccaatctttttattctatgtgcttttcacagtgtcttatgttcaagtcttctattagaaaattcttgatttgggacaggaggttgcagtgagctgagatggcgctactgcactctagcctgggtgacagagtgagaccctgtctcaaagaaaagacaaaatgctaataaaagtattgcttgtgtagatttctacaacactagacttgaaaat

SEQ ID NO: 142018 - DNA, 411 bp, Homo sapiens
gtttagctctcctatgccacaccagccccagacactcaaggcccatgagtggggttaggggaacctgcaggtcagctcccggatcaggagcttttggggttccccagaactcagggcatcataaaagctcacagtgactgagcctttgcaggtgcaatgtcaatctagatgctgtctgtggatctgcccctcccgagtagctgggactacaggcgcccaccaccaggtacagctccttttcgtatattacgtagagacggggtttcaccctgtaggtccggcttgtctcgacgtcttgaccttgtgatctgtccgcctgggcttcccaaaactgctgggattccgggtgtgagccacctcgcctggcctactgtaactataatactcattggggtcgctgggtcggatgtt

SEQ ID NO: 142019 - DNA, 378 bp, Homo sapiens
gtttacgtgaattatctcacacgttctcctctgacagatgaaaactgatccagtgcctgacattgttgaaacttgccattctgaacttcacttctccattccctaagcgaggtcttccagcaagagtttctgctttgttatctagtgtgataaaaatcagcctgtcttcacagactatggctttttattgagtgagatttcatttttgcagcaggaaagatctggtgcctccatgacccgcctctgtgaggtctgctgctgtcatgagaccgagtgaggcagtgcttcacggccctttcacttacgcagaatattaaaggtcgttttagtgcgattcagatatgatttaaacttgtttgaaattctgaatttataggg

SEQ ID NO: 142020 - DNA, 733 bp, Homo sapiens
ggcggtggcagtctgttgggctttccttccagtttgtggaagtttgttgttttgctgtttgcgataaatcctgctgatgctctttctgtgggtctatactacctttatgagctgttatactaactgcgaaggtctgtggcttcacttctgaagccagcaagaccacgaatccaacgggaggaatgaacaactccagataagaactgtagtaacactcgccgtgagggtccgcagcttcattgttgaagtcagctacaccaagaacccactggaaggaaccaattctggacacagggggacttcgtgcacgcagcactccatgagaccatgagctttctcaccgggcaggaggagcccatccccagctacacgtctgggcccagcgctctcggagctgctttggagaaacatgcttggcgttgtctatgccaatggccaggctcctgggactctacaggtttctccaggtacgaagagatgtcttctgtgcccagaggagcagtactcaagccgcaccagagatggctgcctgcccaggacagagaccttcctggcctttgacgaccccctgggactcatgctcgccttggtggcgctcatgctggccagcctggcagtgctggtcctcagactgttctgaagcaccgagacacacctgtggtcggggccaacaacagagctctcagctgcacgccgctcacctccctgaccctctgtgccctctgtcccttgc

SEQ ID NO: 142021 - DNA, 472 bp, Homo sapiens
ggttactttaaatagatataaatttgaagcataacattgctacttggttggattaaatgtgatatttcttatactctaagccagattttttgttttgaaaaattaagtagtacataaaggaagtataaggcatacaaatggctaagtataaaattgcttttgaagttttctgtattatcgtgtcctgtaatctagagaagagagtcaatgtggaatcagagaaagagcattgctctgtgagtcagcacatctacagtatcccagctgggccatgcaccagctatgtgaccctgagccattccagtcaccttcataggcctcagtgtcctcactaataaaatgagcataggctggctggatgtggtggcttatgcctgtaatcccagcactttgggaggctgaggcgggcggatcacttgcggtcaggagttcgagaccagcctgacctacaggttgaaaccctgtctctact

SEQ ID NO: 142022 - DNA, 383 bp, Homo sapiens
acatatttcccctaggctgatattccccctagctgctcctccctccagttgactttcttttcaataaatagccttcctttccactccactacccaagtcagaaatctccatagcaaccttcactgtattccctcctgacatcctgacaattacaattctcagcaattctacctcggaaatatccttcatctgtctacttctctctattaccgatgccaacaccttagtccaccatctactgtctaggtaattacaacattcccctgcctcaaagcctcacttctttccagttctccacgctggacctgaagtgagctaaaaatctaattaagtctttccatccatttccccttctaagatccttaaaacattccaaaggtctt

SEQ ID NO: 142023 - DNA, 141 bp, Homo sapiens
gtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttct

SEQ ID NO: 142024 - DNA, 216 bp, Homo sapiens
ggtctggtctgggccctggggtacagctgggttgtggggccaagcccaggaagcagccccttcacgccagtcagtctgtgggtactgacaagtttgcagctcccacccactggggacaacactgcccggccacaccctgcatgggccagagcctgtgagctagtgtgtgtgcacccttctgtgcatgtgcgtgtgagagcccaccagggtccacca

SEQ ID NO: 142025 - DNA, 475 bp, Homo sapiens
ttataaatcagacagaaatgtataattgcttaaaaagatactatcaatgtaaaaactaaataaccagcaattcatgagaaagctttaaaggaaattttaccaaaaatttataaatggctttttcaaaagatattaaagagacttaaaaagtgtaccacatgtttctttcaacccttacattgcccctacaacaccaatgctagtttccatctcatggcaaataacttcctaaagggactaaatctaaccatgctaaactctaaataatccaagcttaatgaagtgtaacactctaacatggccggtacatataaaatgccaccactaaaacaagagtcagctcaaacatctggcaatacccttattaaataaaatttttaaaggaaggttgttttcttattcgtaacagcagtaagaggaaaagaattctgtttgatgtaaagattgggtaatatctatcatgcagtcatttttg

SEQ ID NO: 142026 - DNA, 304 bp, Homo sapiens
tatcagagaaaatagcaggtgtataaaaaggtaaacaaggctttttcagattaaagtgggaatcatgtcatggtagtgacattttggagagttcaagtttataactcagactttctttcatgtttttgttaagcttaatgtcctcctagtttcaaatacctgctttagcatgtagattgttcttgaagctatccttgaaacccatcgttgtccttcagttctgcactgcaccatcaagctgtttaattataaaaccaacttgttctggcttccaggaaggatagttttttggaatataaagctt

SEQ ID NO: 142027 - DNA, 427 bp, Homo sapiens
tacaagtttgttctatggaattatgtttaaaatattcatctgagtagttcacaacatgattaataatggggaagacacattgagaagatgctcaaatcttagcagtcttcagaaaaatgcaaattacagacataaagaattcaaattacaaagccagccgggtgcggtggctcgcgcctgtaatcccagcactttgggaggctgagcgggtggatcacttgaggtcaggagttcaagaccagccttggcaacatgttgaaaccctgtctctattaaaaatacaaaattagccaggagtggtggctcatgcctatggtcccaggtacttgggaggctgaggcaggagaatcgcttgagcctgggaggcggaggttgcagcgagctgagattacgccactgcactccagcttgggcaacagagtaagac

SEQ ID NO: 142028 - DNA, 277 bp, Homo sapiens
gtccctgagccctagatggcctggcccacctcctgtctcagcccctgtgcctggctgtgtttcagctacattggcctgctggaggtttctggaacaggtccagtgctctcctgcctctgggcctttgcacttgctcttctctttgcttggagtgtgaaccctcaagatttctacatggtgctccctgtgcaaatgtcccccatcagagaggtcttggaaaatagctcctcctcctcctggtcacctgcatccctccacctgtgttaactttcttcat

SEQ ID NO: 142029 - DNA, 263 bp, Homo sapiens
gtataggctgtcagtgaccaagaagaaaggtgatgaatggcaccagcaatggcggtaaaaagggggtgtaacttcagaaggtagttggagatctagttggcaagacttgatcactgattgaatgtgggggaagctgagaagagaggtgaacctaactctgagcatacctgagtgacaacctggaggttcctgaatatatgagggggcagacaataccctctgcctatttctgcgtccttggctagttccacatcttccctgcc

SEQ ID NO: 142030 - DNA, 409 bp, Homo sapiens
aagctcatcttacccctcaaatacatttcttgtcctgtgaactttctcttagaaaatggcatcaccattcaggccagaaagctgagagtccttctctctccccagccacattctacctacactgcagtttgagcccctcagacatgctaagcccacctccacctcgggcctcagtgttggcagccccttccctccagtgcgttccttacccccgagtttcacagagcagccccttatctgccctaaaatctggaggattcaggctgaccagaggctccctggccacccttgcaaacgtcatgctatttcatttgcttagcagtgaatgctgctatctgaaaatgttttcttcacttatttataattttactgtctgcattctctcactagtaaacaaggattttaggtg

SEQ ID NO: 142031 - DNA, 436 bp, Homo sapiens
caagggcattaagtaccattcatattctgaatcacaagggtactttggcatcttatttaatcaagctctttttatcatcatctacactttaattacttaacaaacatttctctgtgtgggaaagtttgaccaggttatcttctacccttgtcttttgtctgatggtgcaaaaaattttcataagcatgtatttctgaatgcctgatggattgacatatataataagctgctagtattaaaatatgtgacataaaacgcatccaatcttctcactgtttacataaattctaggtttctcctatttacctcaagcacgtatggagcgaattcttaccttttaatattgccatggcattcacattgaacataagttgaactctctcatatggtagctgggttcggattcccttgacaatttccagttctaaccctcaca

SEQ ID NO: 142032 - DNA, 356 bp, Homo sapiens
agaaacaaggctttaacatccacaaagtatttttatatcttttctcagtgttatctctgtttgtatgtaaggaaagtaagttcaaaaggataagcagtttgttaaggatcacagggctggtactggaacctgggtttctaactttgcaaaccaagttaggtgttgattaccctgcacagtaacagtaggctgataacctgtatatgaaggaaagcttgaaaaggatcattctgggtaatgagttaagttgaacttttttatttcagaaacaattttcatccttattttctcttagtacctttcccaagcttaaatgaaatcaccttttagtctcaagtctgtagttagcagctaga

SEQ ID NO: 142033 - DNA, 386 bp, Homo sapiens
  misc_feature (17)..(17): n is a, c, g, or t
gtaaaggcaggatttcnccatgttggtcaggctggtcttgaactcccaacctcaggtgatctgcccacctcagcctcccaagatgctgtgattacaggcatgagccaccacacccagctacttgggaggctgaggcaggagaatcgcttgaacccaggaggcggaggctgcagtgagccgagatcacgccactgcactccaggctgggcaacagagtaagactccatctcaaaaaaaaaaaaaaaaaagcaatgttacacaaaatccagcagcttccccattcataaaatccaccattcactctgcatttactacaaagatacagaagtggctatcaactgcttatgcagagatgattgaaaggtacatcaccaacaatttaatca

SEQ ID NO: 142034 - DNA, 497 bp, Homo sapiens
cctagtacctcaaataatattggaagaggcatgttgagttaactcaccttatagtaaaggctttttgaactaaccaaactaagtagcctagaactgattaccacttactaagctgtacctgcccttctaggctaacacacatgcccccaaaactttcgtggttgataaagaaagggaagaaattttcttggcttcttgcagactacatgtgtctattgcataataaaaaatgtaaatcagtggccaggcatggtggctcatgcctgtaataccagcactttggaaggccgaggcgggcagatcccttgaggtcaggaattcgagaccagcctggccaacatggcgaaaccccatctctgctaaaacaaaaagtagccgggtgtggtggtgggtgcctgtggtcccagctacttagtagggggccaaagcacgagaattgctcgaatccaggaggctgaggttgccatgaactgaggtcgcgccactgcattccagcc

SEQ ID NO: 142035 - DNA, 393 bp, Homo sapiens
gaactatctgaccatcattccaaacacttattattactctttcctgctttattttttgccatagaaattattgctattaaacatactgtatattttgcttatttaatttagcttattatctgtcacctgccactaaaatgtaaactccgcaatgacagaattctttatctgttgtgctcactgctgagtccctagcatctatggcagggcctggcacataaaaggcaatcaaaaaatgtttgttgaataaatgaatgaatgagtgaatgagccaacaaaacactactagacatagtatctggtaatacataagttttgccatttactgttagaaataaatgttacacaattcttcttcctgtgaaaatcagcaaatgagaaaggttaaaaata

SEQ ID NO: 142036 - DNA, 524 bp, Homo sapiens
aggtgattagcatgggccctaatccaatatgacggtgtccttgtacaaaggggaaactgggatacgaagacagagggagaatgccgtgtgatgatgaagggttggagtgatgcacctagaagtgaaggaatgccaatggttgccagcaaagcaccagaaactagggagaaacaaggaaggattcttccacagtttcagagggagaatggccctgccaacactgtgattttggacttctggcctccaaaactatgagacaataaattcctgttgtcttagaccacccagtttgtggaattttgttacagcagaactaggaaacaaatacagtttttttttgcagtaaagaagttttaaatctggattatgtccaatgtatcaatctttttttgtcacttgtgcttccgatgtcatatctagaggaggaccaaatcacaaaaatgtattcctattttttcttagttttatagttttagttcctatatttaggtttatgacctattttaagctaattttggggtgtg

SEQ ID NO: 142037 - DNA, 347 bp, Homo sapiens
aagtcaattaatctgatccttctaaggctttgctgtcagtagaggaaccccttgcctcttatggctgctgcacacttgaatagggctagtgcaaattgagatgtgctgtgaatgtacaagaggcaatggattcaaccatttagtgtgaaaaatgaatgtaaaatttcacatcaataatattttactttgatgacttgtggaaatgataacactttggatgtatcgggttccataaaataatattacagtaaatttcacctatttcttttttttttttttttttttttttttttttttttttttttttttttttttttttttttttttttttttttttttttattata

SEQ ID NO: 142038 - DNA, 199 bp, Homo sapiens
ttgctcggtatcccccttgcattactgcagaaattccaaaattgtaacttttcctggatacattatggaaaaaaaaaaaaagaataaaagccaggtatgactcaaaaaagttaatcaagtatatctgggtccaggtggtaaagccttgggtgataatggccaaagtcagcattacaatgggttggctggtgggaagggt

SEQ ID NO: 142039 - DNA, 436 bp, Homo sapiens
tgagtcaaagatctaaacttaaaagccaaaaccatagaagacttagaagaagatataggagaaattttcatgacattggatttaacaatcatttcttggatatgaaatctaaagcacaggcaaacaaaagataaactgaactacatgaaaatttaaaacttttgtgcaccaaaagacaacatacagaatgagaacatatttgcaaatcacgtatcttggaagagattaatacccaaaatacataggaactcctacaactcaacaaaacaaaccaatgagcccattcaaaaatgagtgagggacttgaaaacatttgtacaaagatatataaatggccaacaaccacatggaataatgctcattaccactggtgattagggaaatgtaaatcaaaacaccagtgacagttcacaactgttggaatggctgccattta

SEQ ID NO: 142040 - DNA, 154 bp, Homo sapiens
agatctaaaaggagatgtctgaccactgttcatcccgatctaacaagcagtaagatactggaattgatcaaatgtctgagacaccgtggttgagacccactgttgtaaagcatggagatagctaacaggatgaatcagtggtgggggcctctag

SEQ ID NO: 142041 - DNA, 345 bp, Homo sapiens
atacagtggaaacccctgagaaatgctacttcaaccaggtaattaaggctaatatcagtgacaaaacacgttgatagcatgtagctatgatatgatatgatgtgatgcggatggcactatacctctgtggacttccttcctaaaacctgtaaccccattctaaccatgagaacatcagacaaatccaaattgaggggaattctacaaatgccctggtcagtactctttaaagctgtcaaaggtcatcaaaaccacgaaaagtcttaaaaaccattaaaatccagagaagcctaaggagacatcaagactaaatataatgtggtgtcttggatgggatcttgggac

SEQ ID NO: 142042 - DNA, 716 bp, Homo sapiens
agccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaaca

SEQ ID NO: 142043 - DNA, 306 bp, Homo sapiens
tttataaagactgcacaatatggaaaatgttatgtcacatggaaaatcaggatacagaattatatttacaaaataaattcgatgtaaggaattaacccgcctgggcacagtggctcaaacctgtaatcccagaactttgggaggccaggtgggaggatcacgagttcaagaccagcctggtcaacatcgcgaaacccccaactctaccaaaaatacgaaaattagccggacacagtggcacatgccagtagtcccagctactccagagactgaggcaagagaatcacttgaacccgggaggcagag

SEQ ID NO: 142044 - DNA, 518 bp, Homo sapiens
cagcctctggttatacccttctgtctggtcttcctttttcctcacgagggtcttaacttcgagtctctccacacagaggctgatgagctttctcaactctaatacgaaataggaatggccaagcagcattcaaaaaggtgttccttgctaggagtcacatgcaaagaggggatgccacttgtcactaacctgattgacaaagatggaaaataaggatgataacagtgtcaccgaggtgtagagaaagggctctctcatacactcttaatggaagcataaacgtggacaacctttctggagggcagtttggcatgatgcatcaaaaacctttaaaaggccaggtgcggtggctcacgcctgtaatcacagcactttgggaggccaaggcgggatcatcaccttaggtcaggagttccagaccagcctggccaacatggtgaaaccctgtctctactaaaaatacaaaaattagccaggtgcagtagccacgcctgtagtcccagctacttgggaggctg

SEQ ID NO: 142045 - DNA, 575 bp, Homo sapiens
  misc_feature (487)..(487): n is a, c, g, or t
ggttgcaacatctgagccacaatatcttgatttcacaaccgccgcggcttcttacccaaggcggggagtatttatttatttttaattaaagcaagttaaatgaattgagtctggagggttttgcaatggcgctacaggtaagtgactatactgtaattgcatctctacctcagacaaccagcctggcaggtgagccttcagagcccaccaaagacctcctgaaggataagcaaacaggaactgggtcgccctccacccaggatgacacgggtgagtgtggacagtcaaccaccatgtcagtttctgcaccaccttggttactgccacgtagaaagcgaccacacagccccattatctgttcccctccatgaattcccatccttcccttgcggcactcccacccaaacaaacccctggtcactgggatgcaacttccgggggttgcaacatctgagccacaatatcttgatttcacaaccgccgcggnttcttacccaaggcggggagtattcatccatttttaattaaagcaagttaaatgaatggagtctggagggttccgcaatggcagtacc

SEQ ID NO: 142046 - DNA, 133 bp, Homo sapiens
caggtgtggctataaagcctgggctttggcccgtgggccatatctttacagactcacaaccatcccttcctgctgctcgaattttcattcttgaggcatgagcagcgcctgcagcccctgctgggatgttttg

SEQ ID NO: 142047 - DNA, 330 bp, Homo sapiens
ggaagccacagctctaaccaccctgcgttccagagtgacagaccagtccccaagacaagccagcctggagccagagagagaactgcaagagaaagtttctaatttaggttcctgttagattcagacaagtgcaggtcatcctctctccacagctaccgtcacccgtctccagcctaacaaagcctgcagtccacactccaaccctggtgtctcccacctcctagcctctcccaacatcgcctgccgtctctgaccatcttctgccatcctctgccatctcccaccatctcccactgtctcccacagcctcccaccgcctcttgccaactc

SEQ ID NO: 142048 - DNA, 263 bp, Homo sapiens
gcgatacagctttaatctctctctcatcccacccttctggaccaggcatgcttgatccctgcaaatgtgtttctctctccagctttcattttactcattctttgactgccttcgtaaattatttatatgatggattaagttgtaggctgggcacggtggctcatgcctgtaatcccagcactttgggaggacaaggcaggcggatcaccttaggtcgggagttcgagaccagccataaccaacatggagaaaccccatcttta

SEQ ID NO: 142049 - DNA, 717 bp, Homo sapiens
gaagtaattaacaaaaattgccagcattaggaataattttagaaggatacctacaactagaagagatatttttaattatgagcacttttataatttactataaataattgtgtagtgttaaaccaataaatttgaaagactagatgaaatgtgactgtttaaaaatatggattgtaaaaattgataaaaaatagaaaatgtaaataaacgaaacatcttaggagaaattgaaaaaataggacaagaacttatttttaaaaagaggccaggtgcggtggcccatgcctgtaataccagtactttgggaggccgaggtgggcggatcacctgagatgaggagttcaagaccagcctggccaacatggtgaaaccccgtctctactaaaaatacaaaaattagccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatacagttagaaaaactttaaaggggccaggtgtggtggctcatgtctgtaatcccagcactttgggacaccaaagtgggaacattgctgagaccagcagtttgagaccagcctgggcaagacctcatctctacaaaaattaaaaaacaaaa

SEQ ID NO: 142050 - DNA, 266 bp, Homo sapiens
ttaatctagtttgcttagagatgttttatcagatgctatcaattcaaccatgaattgtttctacactctgacgcatttcatccactcccaactccatgttgacaatagagtcctgggcactttcacttgcatcagtgagcattcaacaagttcacggcaaaatccatcacatcagtacgtccacctgctcttccttctggcctctctctaagttactttcactccctcatttgtgatcacttgccctgcctttgtacattccacat

SEQ ID NO: 142051 - DNA, 329 bp, Homo sapiens
agagctcctggagggcgtggggcctacaaggaatgagagcgggcagaggctgccacagtaagcatacgcagatgttcactcatgtcttgcatcagacctgcagcctgggtcgggacctcacgtgccaagaactccttagcgtcttctttccggaaggaagctacaggtgtgctgggaaacctagctgttggagagtgaggtcatgctatgcaggactggctggcaaggcaggccctggcaaagccaggaagcgccctgaggaagccacgggccaaggtcctctgtgactgttcctgcaccccagatctccccggggtctgggtcggcct

SEQ ID NO: 142052 - DNA, 542 bp, Homo sapiens
gtttctcagatcctgacaacctcaggagatggtgctagaattctcccctattttatgaatgaggaaactacagttaaaagagaggaagatacttgctcaaagtcacatggtaagtagaaccaaatcccatctgtttgattctaaatctgctgtttcttcgctgcaggcatagatttcagcaggaggaggtgtgtgggatatggcagtgaacgagctcaatggccaggcctgcgaggcagcagcagcctccctgtgtgtgtgggaccgtccagcccaggccccccagtgctcccagtctctcccagtctctcccacaacagggaattggctggccctgcccatcttcacagtctgtcttgtctctgtttttactctaagaccacatttgtacaccttacactcaatctgcttgagaaactgagtctcttggagaaagagccccattcctccccaaaactgagaagccccgctggttggggcaaatgtaccagccacaaatagatcctgcacttgagtgaaataaacaagtttcaaggtgttcc

SEQ ID NO: 142053 - DNA, 528 bp, Homo sapiens
ctactaatgaagatttgtaaaccctgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgct

SEQ ID NO: 142054 - DNA, 111 bp, Homo sapiens
tgcttctggttttgtgtctgaaaccctttgccacacttgaggcccatgcctctgttttcgctgtccgctggcggcatgcaccaagcccactgttgagagaggcgggggaga

SEQ ID NO: 142055 - DNA, 765 bp, Homo sapiens
gcacattcccagcagtcacactgctcactgcttacactgtcagcagggcaaatgatttgttaagtcagggcctcaaagggttatcgtcttcactgagagtttcctgtggcaagcacaagtttctcaacccactcatttctcatatccttccttatggaatatggctgcagtgatgcttttaatgcagggagtcagttcagccatctggtctccacaataatttgtagaaagatacactttggggaatcacaatctaaaaagtagctgaaactcttagtaattatacctggatatacttcaagcagagggagacagaagacttacctttgaagggtgccttccttacagcccccatctgacatccacacgtatctggtgcctgaagaaatgtgttaggccactggatactttgggcccagagtccagcttgacaggacttttggtgggttctataggtcacccaaggcttgcctaagcctttatttccccctcagtgtatacttgctgagaatagagattcttgggttagttgaactcagtatttagttatttcagatttgggttctctgaagcttctgcatataaaaaatggattgttacacatgagagaactttgacaactgtaaagccttgtgctgagtaagatggtgtcagtgattatcatggcaccaagaattacaatccttctcagattcttggcttcctttttttttttgctgggtggtgggagcaaaaaccttgtctccccctccacaaaatggggaa

SEQ ID NO: 142056 - DNA, 227 bp, Homo sapiens
ccctgcactcctgccccggggcacgggagtgctccgccctctcccggggtgctcctcgggcgccctgtttcgcctcccccaactgggtccaggcactaggagcaggccaacgagcaggcctgagcctggggagcgtggcccccaggctgcaaaccgctgccagggcccttggtcgctgaattagagtggaagttgcgcggcaggcaaatttgggctccccaagaact

SEQ ID NO: 142057 - DNA, 208 bp, Homo sapiens
ggaaatgatgtatattatagaaagggttgatgcctgtgatactctaggaaaggcagctgactggagctccctaagacagatgagcaaagggagattgtgagtgctgcctaagacatcctggggcaggaaaacaagattggaagagctatttaaagccacgttgggaaagaacaatgttgtttcccattttgcaaaatgaaaaaaggaa

SEQ ID NO: 142058 - DNA, 797 bp, Homo sapiens
ataatcaaacaccaattctttattagatagatagccacaccaagagaaacaaataaagactataacctcacacagctcaggcctggtttcgcagccaagtgagtcctgaaaaaaccgttttctgagctttttggatttcagatttgtacataagggtttgatagcttgtaccaattttcactcctgtcagcagtgtgtgaaaatttcatttccccacttttacttcatgacttagcattgccagatgtttaaaaatctttgtttgtttgtttgtttgtttttttgagtcggggtctcactctgtcacccaggctggagtacagtggtgtgatctcagctcactgcaatctcaatctccttggctcaagagatcctcctgcctcagcttcatgagtagctgggactacaggtatatgccaccatgctcagctaatttttgtatttttttggagagatgaggttttgccatgttgcctcggctggtctcaaactcctacactcaagcaatctgcccacttcagcctcccaaagtgctggtattacaggcatgagccactgtgcccacaccttaaaaaggttttttaaagccttaaaaaacctttacattatggaaatttttacatgtgaatcaaagtagagataataatataagaaaccccatgactctaggtatctatcttccagcttcaacaactatcagtatatggtcaatcttgtctcataccccttacacttcctcattccctagatggttttatagcacatttcagatatatcattccatctgtaattactaa

SEQ ID NO: 142059 - DNA, 329 bp, Homo sapiens
tattaaaaacacatctcatcttccactggaacgtttagataaaggagtgtggggtgtaataaagaactaagctagagcgagagaaacactgaaaaactaattacgaaatgtcacacaagtaccacaaagagagtgattacttgattaattaatgataggaaccctacatttaagtctttcagttatacttgcatcagtcctctttgcctatcagaatgcggtttgtttctgccaacgaataactatcaaaccactgaggcctaactgatgtgtgattaatgtgggctccattaattgtgtggctgagttttatgcatgaagctgtatcc

SEQ ID NO: 142060 - DNA, 315 bp, Homo sapiens
cttggcaggatggaaccggtcagagggtagaatgccaggctaggaaaccaaacaactctagtcccaaccctggcttttgtttgtatgctaggctgggcacctgccctctgacctcaggtgcctcctgtcaagtgccgatgttacagcagtctgcaatttcttgagcttctttctttcttattgcagccaaagctgtcttatttttttttcttttgagagtgtctcactctgtcgcccagactggaatgcagtcgtgcaatatctgctcactacaacctccgcctcccaggttaaagtgattctattctcctgcct

SEQ ID NO: 142061 - DNA, 398 bp, Homo sapiens
cggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaa

SEQ ID NO: 142062 - DNA, 931 bp, Homo sapiens
atgtatctctcaggcttagagctttatactcactcctttgacagccacgcttctatttctttttaaatctcaaaggtgtgggattacaagtcctgtcttagtaataaacttttgcagataaaccctgagatggtataactgcatcctttcttggcaccttaaatcaaattaactaaatacttagtgaggagagaaaaggaaaacacagtttttttgcaacgtatctgactgggtgagaagccactgctgcagcataaagaaccgacgggaatctgggctttcccactctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaataccacacgccgaggagatccggagccttagaggggaggagcccgtacacaagagggaggggaggcccgggacaccgaacctctgagcacccggtgtaacagagcggggaaaagtacaagaccaaggaggtgtaacctagggccacaactacggcgggaacacgggcggagaactatgaatagccgcggggcgagattctcacagga

SEQ ID NO: 142063 - DNA, 601 bp, Homo sapiens
aggatccttaattaaattaatcctcttcccccgagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaataccacacgccgaggagatccggagccttagaggggaggagcccgtacacaagagggaggggaggcccgggacaccgaacctctgagcacccggtgtaacagagcggggaaaagtacaagaccaaggaggtgtaacctagggccacaactacggcgggaacacgggcggagaactatgaatagccgcggggcgagattctcacagga

SEQ ID NO: 142064 - DNA, 472 bp, Homo sapiens
taaggacaaaaagaaatgcaaagaaattttgagtctcactgagcagtttcatttatttttgaaactattttataaatacttagaaaaaacatacatcaatgttaataaaaactatgattttcaacgtaaaggagattaaaacaaaaataatttaacaaactaaaaggaggaggaggaagaagagtagggagaagagaaggaagaaacccataatgttaaacttgagtaagaattatcaagatgatatcatgctttttactccctcctgtcaagagcctcaatgacagcccaataacaaggagcatacttagcacctaaatagtggtttctaaatacaatctcggcagagtgtagtgactcatgcctgtaatcctagcactttgggaggctgaggcaggcagatcacctgaggtcaggagtcccagaccagcctggtcaacatggtgaaaccctgtctctactaaaaatacaa

SEQ ID NO: 142065 - DNA, 449 bp, Homo sapiens
agctcctggtgtccccaagacagatgctcttcccattcttctctgttttctcccaaatgggatggatattcccatttggtcccagagggcagtcaacctgaacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacagtgaggaaactgagcctaatagaggttagaaaccttactcaaggtcacatacatagagtgtggctgagacaggatttgccccagccctgtctgattccagaactcttgtcttcttctccacattcccttctgtgccctgcta

SEQ ID NO: 142066 - DNA, 713 bp, Homo sapiens
gttgacatggttaatggtacctccattgcagacctcagttaactttaccacacatgtcatattatgttttatgtgggaagacataaagctcattagtttttggttttaaacagcaactcactgaaatgagtctttgtgctaacacagggaacaaggaatcttctcttccactagtggttgcaccatttacaaagataatgccactataggactttttgacaactacggtttccctgctaccttgctgtatggccggggttgctctctctgatagagtactttgcttctccagtctcttgtcaaaatcctgccctgattgaatacaagcaacctcaggaagccttcactaactcccacctctcatctgaaacataagatcttttcctttcttgaactcttagactgctcttgtctataactcatggtcctcaggccttcttccctgctatggaattgtgcctgtatcatctgactctgctgccactgccctcgcccttctcctgacttcttagatatgtataaacagcccttactcgtgagggaaggatttaaaaaaaaaaacaaaaaacccaaagtgctcctccatttatcctctggttttatgaaagtagtgactgacctttatattgaatggcttttattagaaaaagaaaatctgttaaaagtaaaatatctgcataaaattatataaatgtccatcttagataaaattg

SEQ ID NO: 142067 - DNA, 480 bp, Homo sapiens
tgagtggctccttctgtgggaactgcttcggatgggtctgatgagacattcagtggtcactgtggcgcctgtccctgtactcagtggtcccatgggctggtggctcctgtacacgacagtgtggatgaggcgttgccactgtcgcagggagttctatcagatggagatggcccaggcagggaacagcagaaaacatgccaaatccactgaaaaccagagtgaagccaggcggggaaggccagggaagcccccagggaaggcaggagcccttgtgcagcctctctggtgtggtgcgtggccgggtgtgaccacagtcaaaggcatagccaccttcgcccacacctggcaaaacaacaagaccaggcagctctcccaggccgagcctcagacggcccgtttgctaactgccccggctttgtgtgcacaggtaaggctgcgtgtccaggccctgagcccacctcaggactcggctgtggcctg

SEQ ID NO: 142068 - DNA, 182 bp, Homo sapiens
tcttcagttaggaggttaaagcagaatctactgaagcaagctgcagactgctagtgctggacgttgcaccatttcagcttggtttcattttcctccccagctggttcctgaaatactcctatagatctcaaaccaatgtttgcaagtatctttcctagcgtcactcagagctttatggccac

SEQ ID NO: 142069 - DNA, 163 bp, Homo sapiens
aggttttggaacatttcagattttgaattttcagatttgggctactcaacctttatcttcattttggctgaaactattatttcctcttctttgatgagaaatcttaggctgagggaaattttaatttgccaaaggaacctagaaagtaattgacaatgacagg

SEQ ID NO: 142070 - DNA, 834 bp, Homo sapiens
ctattctaaatataagagaaatgatattggtgagaagccacaaaaatatgaaaaatgtggcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaaacaatacaaatataaagagggttgtagtacctgtacttctctcatggattttgttgtacacattttataataggggaaaacactgaaggagactttcttcaacatcagaaaatttatattggagagaaatcctacaaatgtaataaatgtggaaaaacatttgttcaaaaactgcagcttaaacagtttacactagaaaatattttgtagatgcagtaaatgtgaagaaatatttagtctaaaaagaagagtatgtaaacatcagaggatttacagtagaaagaactaaggaactaacactttagacactgcagtaaatcagagtattaagtattaaaaaaatccaaagttgaacctattagagaatttgctttgtatataagttgaaaagaagatttttgaagagatactacatttaaagtatattttttcacttgaaaaaagtatagattttttgaaaagcatataatagttaatt

SEQ ID NO: 142071 - DNA, 348 bp, Homo sapiens
ggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcg

SEQ ID NO: 142072 - DNA, 423 bp, Homo sapiens
cgaggcattcctggagtctctctgaatctgctatgattctggaggctgccaatttgcgaatcatttttttttcttgttcaattaaactctgttaaatttaatttgtctgaagttttcttttaacagagttgttccacaaatgtcaagtgaatgaatagatagattaaaacaataaataaaagcctgtattgccatgaccaacatgttaaggacaactctggtgagggctcagaagaagagaggtgtttcccttcgtctggcttttgtaaattcatccaggtcacgactaagtatgttggttaataggaatcctttttttttttttaaaagactaattgtgaaaaaatactcactacttaacctaatcaatatgggccataaacttcaaaggatgcaaattcctcatgtctaaaatttatccaa

SEQ ID NO: 142073 - DNA, 208 bp, Homo sapiens
aatgagcctggcccgaatttgctatgatgggtgagttgtcctcctcacctcaagccaactctgaatcaacatgatttcttctgccagtgtgatcagctgttaccacagaaatcacctgaaagcacagtcacaaaccaatttggctgacttgatgatttgatgtcttgtggagatgttagttttgctcagggacatcttgactctaatg

SEQ ID NO: 142074 - DNA, 412 bp, Homo sapiens
cattcccacagccaccatcatagcccaagctctcattacctcatgcttagattactgcagcagcctcctaactggtctctctgcattcagcctccccatcagcgccaagtgatccttcaacgctgctgccagaggaatctccttaaaacatctttcatcgtgtcagtccctgctcaagaacctataatagtgcccttttgcttactatatcaaatagaagctcctcctcctggtatatgaggcctgccttccacaacagctggaattcattatacatatacatatacatatacatatacatatacatatacatatacatatacatatacgtgtgtgtgtgtctgtgtgtctgtctgtgtgtatccctctgccccacttcccaatgcccagactcccctagcctccttactct

SEQ ID NO: 142075 - DNA, 162 bp, Homo sapiens
aaggagaacctggacagatggaccaccagttgcccatggtaatgcccaatttaatactatccttgtgttggcttttcttccttgtctgtgttactccccttagtctgtagaaatcacttcctgaataaatcatttgtgcattaaccttgtctcagggaacct

SEQ ID NO: 142076 - DNA, 297 bp, Homo sapiens
ttttctaacctaatgttctaatcttttctaacctttatggtgctccctcagccctgattttctctgctacaaaatgttccacagaaccactttaagtagcaattctagcggaaacctcatctgggtggacaaaggagaagcaggattgggcagaaagaaaactgcctttcccacatacaggggaactgtgagaccctggaggaacctggggaatggggcagaagaaacaagatcaggaaaagatggatgactgcaagaatttcaagcgtgcctcatccaggtacaagagctaaaatt

SEQ ID NO: 142077 - DNA, 349 bp, Homo sapiens
gttacctaggctggagtgcggtggcacgatcttggctcgctgcggcttggcctcccgggttcaagcgattctcctgcctcggccttccgagtagctgggattacaggtgcgccaccgtgcctggctgatttttgtattttttggagcaacaggtttcatcatgttggccaggctggtcttgaactcctggcctcaagtgatccgcccacctcacctcccaaagtgctaggattacaagtatgagacaccacacccagcccagggtgaattttaaagcctgaagcccaaagaggccccgggtgagacaggagatgagaagccccagagctgacagctctatgcccacctg

SEQ ID NO: 142078 - DNA, 379 bp, Homo sapiens
ttgctgacttccttgcagttcctgccccagggcgtttgcacttgtcactccctctgcctggagcaggttccctcagacacccatatgactcactcacctcttcactcttagtcccacctgcagcctctgcagtggcttttgctatttcttcactttatttttttctccatggtgcttactactaaaatgccacataacttgtttatttactttgttgtatcatttctgtttctccattagaatgtaagctgcataagggtggattttttgttccgtttgttcagcagtgcctagcacagagcaggcatgagaaaaatgtttgtggaaatgaattgaaattgaattaaaatagtcataaggatgtccagaattctaattt

SEQ ID NO: 142079 - DNA, 196 bp, Homo sapiens
atttcttgccattggtctctcaaagtggtgttaacgctggcatgccctgtgagggtcagtagccctgtgcccctgtggtcccattttcaacttgggctttcaggagaagcagtagctacttaaatttctgtaggatactggcttctgcaatttgagcttactgttttacattacctacactggagttaattgggct

SEQ ID NO: 142080 - DNA, 200 bp, Homo sapiens
taatagaaagtttgtacttcctttgcatttttatcttatttccttttagttttgcctacctggaaccacttcatgccacattcaaatgagaaagtctagttttatgtaagaaacattgaatttttaaggttagattttatgtctttttggcccatgtaagaaggggaaaaaggtttttccctttttattagcctttgtat

SEQ ID NO: 142081 - DNA, 915 bp, Homo sapiens
  misc_feature (743)..(743): n is a, c, g, or t
  misc_feature (746)..(746): n is a, c, g, or t
cggggaaccgcggatcccgcagctgcaggaggcgcccggcccggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccttgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctactggcagcgaaaacagggcagaaagttgtagaaatgaaatgggatcaagtggaggtgatccnaanatattggcctgtggggaaatgccaggttctagcagctactgaggggtggccgcctggatatcctttgaaagtgcaacaggagcaccttcagtccacgcattcgggcaaggaatgcccacttggctacacttgacttttgccctggcaaggcacgggccaccggcattca

SEQ ID NO: 142082 - DNA, 279 bp, Homo sapiens
tgctagaaggaaatgtaggctactgggaaaggacagagccaggtctgtgtgcctctccctggagtccctgacacttgctgttttggcttgaagcctttggccattaaagttgcctgtatccaggcatgactggcccctgctcagggccaagagagggtgagtcttgcaaaccaaggaagcccaggtaccctgtctgcttccttcagggtctggaccactcctttccctataggccttccagtcggctggagagtgttggtgcatgtgtgcatgtgtgca

SEQ ID NO: 142083 - DNA, 685 bp, Homo sapiens
aagtgcttgacaaaagtggctggccaatggtttccttttcttgctttagcctcaaggaaagggtaagcctcaggtccccttcactatttgtgctcttattagtcttccacctgataaggatctggtgaacaaatttgaatagaaaatggaagtttccaaatgccattgcaacactcagtcttcctcataagtgtcaagggaggcacaatatctggcctactgcctgcatgttggttgcagcagctcctgggcatacagctaaagtcagtgtctcgcaccactaaaccaccaaggaatttataaacttttccaaaacagcctctgagggtcatgcttctagaaacctggtggacagagatctggctgtacctcctgagatgctctgttcttaaagctgctgacttctagccctagctctggagacagaaccaaaagtctctaaaacaggggctaattttaacgctggaatacagagaggtggaatgactccttctgcccttggagagccacctgggcaatccagggcaactgcaagaagaagaaagggctactcaaaaaaacaaaaactgatttggtgcctgtaatcccagcactttgggaggctgagttgggaggatcacttgaaaccaggggtttgagaccagcctgggcaacctagtgagacaccgtctctacaaaaaaaaca

SEQ ID NO: 142084 - DNA, 665 bp, Homo sapiens
aaggaccagctttttctgcagctgaagaaagtttccatgaggaagaaaaacggaggcgaaaggagcagagcgacctgaccttctgacatccgctgtgagccggcggagcccgattattcacgtggggactcgcttcctcctcggcatgcaggcagcgctggagggcacgatcgcccgggcattgtcatagcagctgacccagccaagcagatgttcaggccccacgtgcttacgacccggaagtccgtgggctcagcggcggcttttgcagggaccccagagcaggcagcctgggcggtgccgctgggactgctcagcccctacctcaatatgggcccacatagctagcctatggccctagtcggcagctcagagcagttcagtgctccctggggtgcattcatgtcccagccacaaccttatgttctgctgggccactttcagcacacccagacagggttcctcttctggtgctgctctgtctttgaaaccgcagatagaccatgctaaccagcacacaggtttccctggtccatcctccctgacccccatgcatgcccaggttctgcatccaggccctagactccttgcctaatcccagctccccgcgaagatgcagccagcaggaacgtctaggttttgcagctaccaaccaaccaggccct

SEQ ID NO: 142085 - DNA, 291 bp, Homo sapiens
taagaaccctggccaaatatacaggatttaatgtcctcagcaccaggcatcacacaggaacgtgcgtgagcccatgaaatacttgctcaataataaatgctgccaagctgctaagcttggggaacctgatgagcactcggcttatgggagactgatgctccccacaggccggcccctgtgccgagactccacgcagtggcttcctcgctgtgacagcctcccctcatctgacgaggtccaaacagcgggtccaattctacccacacctctttgcatagggtgcttctctgg

SEQ ID NO: 142086 - DNA, 154 bp, Homo sapiens
atgcaagaggctccttagaataattgccaataataaaatgtgatttatcaaatagatactatgtactgttaattggtaaatagggatcacgtgctagactgtgtagggcttgatctgtgctttaaacctcagcaaaaccctgagtgaagtacat

SEQ ID NO: 142087 - DNA, 273 bp, Homo sapiens
ctgcaccaccgtctgtcagccaattcctgatttcagtcattagactaagagaaagtcctggacctaataggaataagggtctcacatcaagaattcagtctttaccgggaagtcctgtacttagctagtacgtaatagagcctttccacattctattaagaagtacaggccaggtacagtggctcacgcctgtaaccccagcactttaggaggccgaggcgggatggtcacctgagatcaggagttcaaaaccagcctggccaacatggtgaa

SEQ ID NO: 142088 - DNA, 333 bp, Homo sapiens
tgcggtgggggttaagagtggaaatacaagttagatcaatgccagatcaaagactttgtatctaattcaataaacaactagggaaagcaggatctatttaagattttcttttctttttcttttttctttttttttgagatggagtccccctctgtcactggagtgcagtggtgcaatctaggctcactgcaacctccgcctcccaggttcaagcaattctcctgcctcagcctcccaagtagctgaaattacaggcacccgccaccacgcctggctaattttttgtagtcttagtagagacggggtttccccatgttggccaggctgtctcaa

SEQ ID NO: 142089 - DNA, 428 bp, Homo sapiens
gatgagctccgacccctcataatgagtgcccattccttcttgaaaattctttccccccttagtatcagttacactatcctgcttcttttactgctctagaacctcctcattttccctaaagccgcagacctccataacgcaggttttaggcttttctttcttaatagttctttcagtgcaaatctcctcacatagtattcacctgcctcactctgcatttgactcccaattctttatcattaaacctgtcatttatctgagcttccgagatgttctatcatcacttcaaattcaaagcgtctgaaactcaacttggcatcttttctattttagctctatttctactaatactaaaggactgtcattgccaatatttcactctaattcaaacttcatgttgccccttgagtctttacacctcatccttg

SEQ ID NO: 142090 - DNA, 656 bp, Homo sapiens
atgttcatggattgtaagacttcctattgttaggatgagcatactacccaaattaatctacagatacaatgcaacccctatcaaaatccttatggccttctttttaggccgggcacaatggctcacacctgtaatcccagcactttgggaggctgaggcaggcagatcacttgaggtcaagagttcaagaccagcatggccaacacggtgaaaccccgtctctactaaaaatacaaaaaattagccgggtgtggtggctcgtgcctgtggttccagctactcaggaggctgaggcaggagaattacttgaacccaggagatggagggtgcagtgcactgagattgtgccactgcactccagcctgggagacagagtgggattctatctcaaaaaaaaaaaaaaaaaaactagaaaaaatcaaccctaacgttcatttggaatctcccctaataccaaaacaatcttgaaaaaaagttcaaagactcacgcttcctgatttcaaactggctataaaactaccatcatcgaaaccacatggtactgtgtagggacagacatacagaacacagatcctagaaagaaaatgcttgcatatgtggtcaaatgattttttgacaacagtgccatgatcattcaatggagaaaggatggtctt

SEQ ID NO: 142091 - DNA, 430 bp, Homo sapiens
tgacagatgtcctgtaacacagaggatcgtagaacacaatgaagaattgtcctgtgtactgtcagacttcaggatgtctgccagatagtcatgcaggtgtatttcagccatgaggctgaaaccatgtctcttttggtcctcagtagtgtatttttggtgtggtatacggcatacagaatgacatatatgacatatagagtttgaatcaaaaaagataggcagcagaggcattctcagaaaagatgactgcagataagccgggaaaggcaaagcatcttcctgccttctgctgctgtcttctcatccacatctaggtattaagtgtctgctactattgccagtgtctctgaggacacacagcttcagtgtgctcatctgttctccgctgagctaaggacactaagaccatagcttcccaggctagatgtgg

SEQ ID NO: 142092 - DNA, 346 bp, Homo sapiens
gggcagccggtgctgtcaatggaaagaagcaaccacgtggtataaagacttaagcaatctcatagtaagaaaggatgaaccttgaagtgtgttgacaggtcttggtgtcagcagagagaattctcttaggaacaaaaggattcttctgtgtttgttagagagactgaagaaaacaagcaagaaatagtgctatatcctggaggcagaaaatgtataattgatgacagcagaaacaatagaacaaatatattaggctctattttagagggattgagaaaaaaataattaggaaattgcaaagagaaagtggaaagaaaatatttcagaagggatggcaaataaaaga

SEQ ID NO: 142093 - DNA, 728 bp, Homo sapiens
gtgtctggcccagcctagggggcaggtgacatgtaaagagagctttggctagccttgtgactattttcttaaagtctcgctctgtcacccagactggagtgcagtggcgcaatcccagctcactgcaatctccgcctcccaggttcaagcgattctcccacctcggcctcctgaggagttgggattacaggccaccacgcctggctaatttttgtatttttgtagaggtggggtttcacgttggccaggctggtcttgaattccgcgtaacctcaagctatccacccacctcggcctctgaaagtgctgggattacaggcatgagtcactgcgcctggcctctctcctttcaaatcatcctccttatgacactcaaagtgtctttcttcttctttttttttttaaatttttttgagacatggtctcactctgctgcccaggctagagtgtagtggtgcaatcacagctcactgcagccttgacctcccaggctcaagcagtcctctcacttcagcctcccaagtagctgggactacagacacataccaccatgcccgtctaatttttttttttttttgagacagagtctcgctctgtcacccaggctggagagcagtggtgcaatctcagctcactgcaagctctgcttcccgggtttatgccattctcctgcctcagcctaccgagtagctgggactacaggtgcctgccaccatgcctggctaatt

SEQ ID NO: 142094 - DNA, 237 bp, Homo sapiens
taactcttccattagtcagggagacatcagattggcaaaaatttgaaagacatctggtattagtgagattgtaggaaaatggatgtttattgttagtagtaaggattgcaaactaacctttttggaaagcaatctggcatatttatgaaaattcaaagtgttgtatcccatctaaaaagtgttattgcatgaagtttgctaacttcattataaggaatgttatgtagctgttaagag

SEQ ID NO: 142095 - DNA, 288 bp, Homo sapiens
caggcctgtatgttttacctgtactattacagtgagctcctatctgatccctttgcctcttgtctctccatttaaccctgtcttaagcacagaataaggctctaattatgctgcataatatgttaacaatcttttactgcatatagagcgtagctttagtttcccagcctggcatttatttaagccaaggacactgcagtcagttcctgacctaccttcccaactaatttcccacagctctcccctctctctttttttgaaacagggtctcactgtgttgcacaggct

SEQ ID NO: 142096 - DNA, 464 bp, Homo sapiens
aagaaaaacaactgctccagatcacaagagggaggagggctcagaaaattcctccctatctctcatctgtggggtattcattcttatcttagaagaacaaacacaatttgaaaatcactgatctaggccaatcctttaattctgaggataagaaaatgagggctcagagaagttcagaaactgcccaaggtcatatcataagtaacagatagaggatagaagccaggactgctgaccttttgtgcagttctctttaacttccccaggctccttcaataaaaccaggagctggccaggcgcggtggcgcacgcctgtaataacagcactttgggaggccaaggtgggcagatcacctgagatcaggagttcgagaccagcctggtcaacatggtgaaaccccatctccactaataacaaagtagccagacgtggtggtgtgtgcctgtaatcccaactgcgtggg

SEQ ID NO: 142097 - DNA, 1292 bp, Homo sapiens
gaaacagcagagctcggcagggtcagagggcaagcagggcagagaaaagagaggggaaaatgagccccgggagaggggaaggaagtggagggaagtttttcatgcccttcaagtaccaaacaaaacaaagataatttcaaaagtggtcagccactataacactgcttagagaattaaagtattgacaaattgaagagtgctttaaaataaagtggatggggcataagcatgtatgtcttggtgttagttgctccttatacagccggtactaaaggctggtgggtgaagcttaccacattttaaaaagaaaaaggcaggcacacatactaaagttgaaaatgcaggcaggaaggacatttacttttcataaaagcggatcagaaaagcatctcctatcacagatcatgtattttatgccatgctgaccaatgttgggggataatctcattattttgtgatatgagaagatcctttgatgctggtaacaagaaccaatcatcctgacttaaatcttaatatccccacaggttctttgtcatgcgtcttcaagatgtgccctggccattcatgcaagtttcaaggactctgaatctgttgagaaaaagaggttacgttccaattctgctttagttccaacccaaatgctgagaaacactccatggaatttaattacagggcgataactgtgatcttaccaagatttatgaacaggaagatccttggtgattgtagtcagtcaaagggtggctttgacatagcacctatctgttagggcaaatactgccagggaaaaggtgacatttggaatcatctgggattggactcttgatcaatagatgcgaaatgtcaggtggacatgagaactgttggtctttggtacatatgtgttgcaatgagtaaggatgagtaatgtgaaggaaaagtagaatcttgggaccccaaactcactatgccaaagggaaagttaagcgtgggagactgagtcaggcaaaaactgccttccttttgttcccaaatagatggctgtaatttcacatgcttgcgttatgtgaaatgtggattcattgagtgctaatcagagccccacaagaatgaaagcacttgccttgctgcctaccctccctcctcttttttcttcccctcctgcttgctcttttccctttaaataatgaagttcccaaaaccctctttggaaaaagcataggtcacaaatcctattataacttgcatttctttttcctgggtacattctcaacctgggcaaaataaacctctaatcaacgaaaaaaaat

SEQ ID NO: 142098 - DNA, 821 bp, Homo sapiens
cgagctcggtaccctaatctgtactcatcgcgcagacaacagatatttatatgaatgttctttgtcatgcgtcttcaagatgtgccctggccattcatgcaagtttcaaggactctgaatctgttgagaaaaagaggttacgttccaattctgctttagttccaacccaaatgctgagaaacactccatggaatttaattacagggcgataactgtgatcttaccaagatttatgaacaggaagatccttggtgattgtagtcagtcaaagggtggctttgacatagcacctatctgttagggcaaatactgccagggaaaaggtgacatttggaatcatctgggattggactcttgatcaatagatgcgaaatgtcaggtggacatgagaactgttggtctttggtacatatgtgttgcaatgagtaaggatgagtaatgtgaaggaaaagtagaatcttgggaccccaaactcactatgccaaagggaaagttaagcgtgggagactgagtcaggcaaaaactgccttccttttgttcccaaatagatggctgtaatttcacatgcttgcgttatgtgaaatgtggattcattgagtgctaatcagagccccacaagaatgaaagcacttgccttgctgcctaccctccctcctcttttttcttcccctcctgcttgctcttttccctttaaataatgaagttcccaaaaccctctttggaaaaagcataggtcacaaatcctattataacttgcatttctttttcctgggtacattctcaacctgggcaaaataaacctctaatcaacgaaaaaaaat

SEQ ID NO: 142099 - DNA, 528 bp, Homo sapiens
tccaccagggaactcctatgcaaagattgtctggaggacaccctcactgggcagaagtattcatgaggagcacatgacctcagctcatatactgtggcagagcaaaaggcactttagctggacgctgtcagataactcactttcaaagggagatccgagctaagtgttctttcttctctctctctctctctttctttcttccagaggcttgcttcttcgcccaggctggagtgcaatggcacgatctcagctcactgcaacctctgcctcctgggttcaagcaattctcctgcctcagcctcccgagtagctgcgattacagacgcatgccagcacgcccgacatagtgaaacccccgtctctactaaaaatacaaaaattagctgggcatggtggcgcacgcctgtagtcccagctactacggaggctgaggcaggagaattgcttgaacccgggaggcggaagttgcactaagccgagatcacaccactgcactccagcctgggcgacagagcaagactccgtctc

SEQ ID NO: 142100 - DNA, 912 bp, Homo sapiens
tccctgaaccactaaacttgttcctttcatttacaaaagagatacctgacatcctgagacactgagaaatgtcctgaagtcacacagctaatggcagaactggcactaggtccaaatcttgtgataatgaacaccgtaaggttagctagcttcctactttcccttgaatagtgcttttctccctatgtaatatcttttattatgatatttgtggtttagaaggcatattgagttattttgcagaatcataatggacccgcacaaaatctcagaaccatatctgttgacattttttctcatagaaatatcatggttaccccatttgttaatgagcattaatgttttctgaacacttccaaagattaatcaaacataaatattcattgtctgaaaatgtctttaagatacaattcagaggtccctatttcctttgtacatacacacttagaaagaaaagacagaaaaggaagaggaaggaaggaaatattttgagaatatattgagaagaattaagaaaactcttcaatgaagtgttaacaaccaaaccctacagacggtatcagaaacagcaaatagatattcctctaccctttcacagtgagtgagtgagtacagaagaatgctcatgatagttttgccttcattctactttctgtggacacagagtaatgaatatttaatgggacattaaatatgcccttcaaatctataattttactttggtaaacgagatttaacatgatgtcttttatgctcctaaaacatcttttttcaaactccattccttagaacattcttctactgagatgatccaagaccaaaagtgttctttggtacttgcttataaagtgatagtacatgttagcatataatgtattttgaagagtgaagtaaatgctattgataacagta

SEQ ID NO: 142101 - DNA, 947 bp, Homo sapiens
atgaacttgtcaacaactaatggcatacagtaggacagactgagaggaagggacaccagagttcttgttgatgacaacttttggaaaacctgcttggccaaactgcagaggctcttagggaaagtacagatcatctgccccagatgatttagtcagcaggcagagtgtttgatttcttctgacccaccattgaagttggagaaaatatgactatccctcccatgacctcactttactcttagcccttgactttgctgctgaagctcaaatccttcctccagtggcaatctctgcccttctcccagctcaccctttagaaatgcagggaggtcatctcttgatgatgctctctgccagaacagtagaagagaaatgaaaggaatgtggctattgttctttgaaacctccctctgaataaggtgaataaaatttcagtttctggaaggaattgtgatatgatttggctgtgtccccacccaaatctcatcttgaattctcatgtgttgtgggagggacctcaggggaggtaattgaatcatgggggcaggtcttttcaatgctatccttgtgatagtgaataagtctcatgagatctgatggttttaaaaatgggagtctccttgcaaaagctctcttctcttgtctgctgccatgtgagatgtacctttcatcttccaccatgattgtgaggcttccccagccatgtggaactgtaagtccaattaaacctttcttttgtaaaaaaaaaaggggggcttaagttcccgaaggggcaggctaccgttccagtttgtacaggggcccaggggggaattaaaagacggcgggtaacaccggcggagaacgctcggctgggagcccctcgcggcgatgcgaccaccagaccggaaaagatggcacgcccgggcgtgtagttataaactatagtcatattctctcattcccag

SEQ ID NO: 142102 - DNA, 182 bp, Homo sapiens
tgcagggtaggtgaggcaatgcggaggcacagatgcagagcacatctaatggtcgtcagcagtcatggcaagtgaccaggaaatcccaagcctcccggcattgtccaagtcacttatgcacagaataagtctgttccccttgtgatcccattgtgtattttctcacataccctcgcctaaac

SEQ ID NO: 142103 - DNA, 201 bp, Homo sapiens
tgcaatgccatgtacagaatcatgagttagatatttgccctggtaatccattctggattagttttgcatgaagcagaatgagggaaataattattttctctgctgacaggtagttgccaagtgtgaccagccccagccccacttcttcccaggaattctacaagtacctactctattttttacagaatgtagttaatggtg

SEQ ID NO: 142104 - DNA, 496 bp, Homo sapiens
gatttagcaataagctgattccatgccgctggtggaagacggaggaatgcttgagggaacgtttattgcatgctgaatccagagctggaaaccaggtttgagccaatctaggcacgggctccctgagcagggcaccctctgtctctccacctgatgggttgattagactcacagagaaaggaccgtcttacacctggaaaatcaaaagccaggggcagcctgaagacacgctggtcatgccagtactctaggggctaggattgctgtctcatgacggtgcttggcccgagaaagcacatggagagtttttcgtcaagaagtgttacctcttttatggagatgctcacagactgggcatttcactgtcccctgtccctgagacacagattctttttctgaaatctggtcaaaataaactggcgatgttgctgcagccaagctggcttactctgggcagtgccttttttctcacgaagatctggcctgacgggactcc

SEQ ID NO: 142105 - DNA, 320 bp, Homo sapiens
aaaaagtgtatttagccgggcgtggtggtgcacatctgtgatcctgggtactcaggaggctgaggtggaaggatcgcctgcttgagcccaagaggttgaggctgcagtgtgccatgatcacgccactgaactgtagcctgggcaatagaacaaggccctgtctcaaaaataagtagtacaaaaataaaaagtaaaagtataaagtttatttactccatcagctgagatttgttttcttctacaagtacaatatttaaaaatggcaaatttaaaaacaaactgctccacttgtctaaaatagtaaatatacaaaaaaactt

SEQ ID NO: 142106 - DNA, 946 bp, Homo sapiens
cactaagaaccaattaagtgacaaatcctggatttgattttgggaaaatgtctgtgcataaggaagtgaagactcccaggaacatgcaggcaattaacgttgcaaaggtcagtgatggaagtaatcccttggactgggcgatagagcaggcttgctaaaaccacaatttctgtggttgaggagtttttcattgcctaccccatctacactgtgtaataattagatgtgtgtggtattgtttaattacacataagttatcctgatgggaattattagtgttgacatatatcctgtttacaggaggagaaaatgaatccagggaaggcagctactcatttatatctctttatgctaaatgttattctttattaggttctgtgggagtttacttaaaaaggaaatcgaaattacttgttctccaatttcacatcttcttaggaaaataataacactttgctttttaaaagacataaaaacatttaccaagcaagtacaaaggagcatgtagtagcgaggtacaaaaggaagcctggagtgcagtgggcgatctcggtcactgcaagctccgcctcccgggttcacgccattctcctggctcggttccgagtagctgggactacaggcgccgccacaaaaccggtaattttcggatttcggaaaacaggggttcaccatgggtgggccggatggtttcgaatcccgactcatgatacgcaaagtcggggtccccaattgtgggtgtcaggtggacccagggccggcaaacattccaaatctcaagggtagcccggagaaaagagaacacgggaaaggctcccaaagtatgggaagacaggcctcacagaatgggtggaaaccaccagctgggtgtcgcagaactcttcacagtgtgaacacaaaaaacatcgtggtagagggaggaaaaagccgctgaggaaaaactcaa

SEQ ID NO: 142107 - DNA, 495 bp, Homo sapiens
taagccaccgtgcccgaccaaattttttttattataccacacaccctaagtaattctgatacagatgaaccacagactacactttgagaaacaccattctggatgttcacaggcaatgttatcaccaatttgaaacttcatacaaccatgaaaactgaacctacactggtaatttatgttaaatacactaaaactagaagcaaaactaatatgatacacaacagctaacttttatactgaggtactgtgctgtttttcagttttcccttatttaatccctactatcatatgaagtagatttcaccacccatttcacagataagaaaaataactttccatatcacatggcttctagttggcagaacacaggtattaaactcaaactgtctacccaaagtatatcctcctcacctcgatgttataccatctctccatttgtaatctatttgacattttaataagtaaaatgaagttgggtaaaaggagagaaggcac

SEQ ID NO: 142108 - DNA, 650 bp, Homo sapiens
ggagagttgagaactgagatttttgtttattttatttatttattttttgtgagaatagcaaaggctttacaatgtgactgcttactaatgtcagaaaaatagcaattcagctcttactttctcccctatactttcagggcgttatgacagttttaatgtgagttgtaaaatgtagggaggtatactctaattctctttcacacacataaatcaagtttcaggctcttttggaaatgtttactagaaaaaacatcatgggcagattttaaaatgcttttggattgcatgacggcgtggtgccacttccattgaagtgttgtaatattttattttccttcccaaagcgtcaagataaatcctgtaaacattttttctccttttgttgttttggttgtactattgtgtttggctctagccttttgcccccagggaaacaaaagtgtttttttttaactgcagtgctcccgctgagtactccagctgttgggcagcagtttcaaagttgttccctatttacacactgcaagtctggcggatcacaaagcttcctacatcttatctgaaacacaatatactaatttcagggatatatttagaaggaaaattgttgtcaaaatttactataatgtagcttattttatcttttaaat

SEQ ID NO: 142109 - DNA, 459 bp, Homo sapiens
tctatcattctgtttgtatgaaacatctaaaataggcaaatctatagggaaataagaatccttctatttccagaaaatagattagcagttgtctacggctgggagtgggaatggggagtgacagcttagtggaagccaccgtcacatgttgcatagaggaccgtgtcagccgcctcactggtctccacactcctgtttcctgacaaagcattctggagtcctctgctgaaggtctgatggagtgagccaggagtaggcaaacagcccaataggtgtggagggtggttagtccttgagaaatcatatgaacaatgcaggggttcgggatgcagatacatctaggaggtaggggcatgtgtgtggacagatttgacggtggtgagaaggcaggggccagctgagccttcggggtgtatctgactaagtacaagtcaccatggccgtgccctcacagcatgt

SEQ ID NO: 142110 - DNA, 434 bp, Homo sapiens
ttttgtgttttttgtaaagaattttccacatgctggatgaagtgttttttcttaagtacccatatttctcttctaacatttatatgttttcagtgcttatgggtacaacttcattgagatataattgagtatgatgaaatcttcagctcatctagaatttactttttgttatggaataagaactcagctctgcttattttccaaaccattagtcatgtggattagtggcatttattacattacattttggcactctattctgttccattgctctctgcttttccagttacactttttaaacatgagacagggtctcactctgttgcctaggctggagtgcagtggcgtgaccggagctttcagtgagctgagatcgcgtcactgcgctccaacctgggcgacaaagtgagactccgactcaaaaaaaaaaaacc

SEQ ID NO: 142111 - DNA, 290 bp, Homo sapiens
cctcacacatgtctactgaaggatttcctactcagaagtggagccccacctttgaacccccaggcctgatagggtttccttgccctacctcagtggcatctacagtcaaagcttaggcttggcagacattgacatttgcagtcaggatctgccacttatgttcccgcctgaggcttagtttctgggacttcagctgttagaaaaacaccaaacttctgaagacccaagatgccttcagtctgggtctccgctttcgcctgcaaggggctgacttccagcttggcaaaggg

SEQ ID NO: 142112 - DNA, 745 bp, Homo sapiens
aaagaaaaatcaaagtaagacaaaaagcaggtcctttgaaaacatcaataaatttgataaacctttaacacgactaaaaaggaaaaacagggaaagaatacaaattatcaataccaggaatgaaagaggggctattcctacataatattcagacattaaaaggataataaataaatattataaataactttatgcatataaacctgacaacttagaatagatccatttctcaaaaaacacgcactgtcaaactcactcatgatgaaatagccgaaaaagttctatatctatcaaagaaattgagctcatagtttaaaacctttcaaaaaagaaacttcccattccagatggtttcattgtttcattttaccaatcgtttaaggaagaagcaatgccagggctatataatctcttccagaaaatagaagaaaacacttcctaagtcattttacaaggctagaattactgacaccaaaaccacacaaaaatagtatacaggctgggcgtggtggctcatggctgtaatcccagcactttgggaggctggggcgggggatcacttgaacccaagagttcaagatcagcctgggcaatatggtgaaaccctgtctccactaaaaatacaaaaaagttagctgggcgtggtggcacacgcctgtagtcccagctacttagggaggctggggtgggaggattactcaggcctggaaggcagaggttgcagtgggctgagatcacgccactg

SEQ ID NO: 142113 - DNA, 513 bp, Homo sapiens
cacagccaagcatcagaggtttcccaaggaaataaaagctaggagagaaacacatgcttaccttgtagggcatagattcaaagaagatggacgtggcagagattttcttcttgtctgtcatgaacccatgggtcaggtggcccccatccggaaggtccaggcccatgatgcgcccatggggttccaccagggcagtgtacacagcaaagtttgcaggggagcctgaaacgagtggaccagaggagacatgattatttctaactgaggtaccaagtggcatccgggaccttggccactaagccttcacccaggagtggcgagaacaggccttgtaccttccctgagctccaggaggtgccccttcaccaccagccttgagaggtgaagttcagagagagggcactgcctgggagggggtatagagctgggagcccaagggtaatgcagagggatgcgtgacttatcttttatttatggcagtttttttttttttttttttttcagtgcaggggc

SEQ ID NO: 142114 - DNA, 264 bp, Homo sapiens
tgtgcttcctcaaacctctctgcctttgcatatgttgttccctctacctggaacatactgcacgttgaacctgactcatcttccgggacctgcttcaagcttccctgctctgagcagttctccctccctacccctcctatactctgctgaatgaagaatctgcttctctctgttcccactgctccctgtgcacaccatttaacaaaaaacagttccattcacagatggccatgggcctagcaaagagagggtgcttcatggggc

SEQ ID NO: 142115 - DNA, 214 bp, Homo sapiens
tctatacaatcacccacaagcttcttttttctttttaattaggtttaagcttcattgtacacaaagcttcctgaaaaatcactcccccctcccccaggcatccatcacgtcttcccatgatagcaggcccatcttggctttctcaggggatgtagtgcgcgtctgttcatgacttctttaagttcttacctcagtgtttaacctcagtcctcct

SEQ ID NO: 142116 - DNA, 460 bp, Homo sapiens
ctgtgggcctggactgaagactccctgtccactctgccactccccaaaggcttttggtaggtatttatgtttggatcagggagatttttgttcttgactacagtggtgattggatgcttacatgctgtctaagctggccctgtagaattggaatacacttaatgagcagaataattgaaaagtttccttcctccttaggaattcatcattacagttataaagttatactacagtggccttggaccatctcacctcaccattatgctctcaaagggactcgaaactctgtcaggtgtgggagtccctacaaattgaaagcttgttctatagtttggacttcttccttctcaaatctagtctcagtgctgtagatacagattactcaaggcatctcaatagatgttgttgttgacgtatgaggacctgtggtcaagtagatactaatggaagactgctagac

SEQ ID NO: 142117 - DNA, 520 bp, Homo sapiens
gtggagttggatctaagagaccaggctgaggaggctctggcgtaggacactgcacaggtgacaagcagcaaggagggtggggcgaagtcagcattgatggccacggggctggagcagagaagaaggtggggcacaagtgtcatctcatgggaggctggcgccacctcagaaggtgaatgggttcagcttgggttccaggccagagtctgaagttgagaggactccgttgggtgctgggctgtgagcccaccgtgggggcaagactgggagcagcagacccagcagggcccttgtaggtaatcaccggctggcactggctgggggccaggtaaagccagcagaggctgaggggtgctggagtctgggtgtgtgtgaacgcagagtgggtacgctggcacagtgcatgggaggccgtggattcccaaggaccccagggctgtggctggagcagctggaaagacggagccgccgcttcctgagatggagaagcctggtaggtgggtttgggggagctcaggaa

SEQ ID NO: 142118 - DNA, 427 bp, Homo sapiens
aaagagcaggcatctggagggccccacacacatagaccaaaggactgagcccgcctggcattcctccactcacagcacaaatactcagccctgcagccagggaagggtggggtctccctttgctgcccaagtgtgcccccttgcccgtctgatctctcctgttaggtcagcctcattcagggctttgtgccaggtcctgtcctggagtctcagtccgggacagcagcctggctcttaggcagtccagaagcagcagggcaaaggggggcaaatactaacacggggtgtcacgggatggccaggaggagtcctgctcgccacccaggctcactgtcctaaacctccatctgaaaccgcatctcgggtgacctcagattgtgctaggaaagcctagttaataaatctgcctcatctcaaaaaaaaaaaa

SEQ ID NO: 142119 - DNA, 518 bp, Homo sapiens
tgaaggggtaaatactttaaataaggtggtcagggtagggctttctatgtgagtgacatttgaacaaatgaggtgagggcatttgccatgtgaacatcaagtggggtggaagtaagggataggcaatgaaaatggcaaacacatcctgagctcttcctatgtgtccagatgttcttcacactttacatgggttaaatcatttaattctcataataaccctacgaagtaattttcatactgatccccaacttatagaggaggaaaatgagggacaggttgaatgatttgtcctcagagaagccatgtggtagggctaggacaagaacctgttcttgcactgctataaagaaatacctgagactgggtaatttacaaagaaaagaagtgtaattggttcacagttcagcaggctgtacaggaaactggcatctgctcagcttctggagaggcctcaggaaacttacaatcatggcagaaggtgaaggggaagaagacacatcacatggccactcaataag

SEQ ID NO: 142120 - DNA, 431 bp, Homo sapiens
ttagtttcccagagaagagtttaactctttagaatattgtgggacaccctaggattgcagagaatggggacctattgtgtaccttgtgttgaaggcagaatacccctaagcacagtagagttagtggccactgcatcccagaatattttgtcctgtttctttgataaacagcttaggatcatagtaagcatgactcttatcagagaggctctaagctggatattaggagaaagacattctgtatgtgctttacatttttaggttgttgctgtcattgtttgttttgttttgttttgtttgttttttgagacagcctcgctctgtttcctaggcaggagaatcacttgaacacaggaggcagaggttgcagtgagccgagagtgcaccattgcactccagcctgggcaaaaagagcaaaactccgtctaaaa

SEQ ID NO: 142121 - DNA, 1484 bp, Homo sapiens
cgcgcgcgcgcgcggctccgccccgcccgcttggcgcgcgcccccgccaggtccgctctcgtcccccacccctggcgcggacggggtggttccagctcactctcctcccccgagcggcagcggcagcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgt

SEQ ID NO: 142122 - DNA, 1992 bp, Homo sapiens
cgcgcgcgcgcgcggctccgccccgcccgcttggcgcgcgcccccgccaggtccgctctcgtcccccacccctggcgcggacggggtggttccagctcactctcctcccccgagcggcagcggcagcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagtaggttggatcttcaaaagtggtttgtataactttgtcctgtcctccacctttctatccctatgtatttaaacatctaaatcctacatggtatcatacaaaggactaatccagtggtttacagcagtaaaggtactaacatgtattacttcttaatcacttgttatgattgagccaatatacaaatacctcatctgttctttttaatattttatctctgtttgtagagagctaacgtttgatagttctaatttaaatttcttcctttcccccatattcaatcattgaatccttatagaatttgtcttttaatagacagaaaaattaatgaaactttttaaaatagaaaaattactcttctttaatgctaagtattgacacatcgttgtttgtttttcattgtttttgcggattgagagacttggtccatcttgtctcaggagaagaaacctttctccaatgtagcagaattatcctcttccctgtattatagcaagttctttattaaagatttttgaggccgggcacagtgactcacgcctgtaaccccagcactttgggaggccgaggcgggtggatcacttgaggtcaggagctcaagaccagcctgaccaatatagtgaaacactgtctgtactaaaaatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtct

SEQ ID NO: 142123 - DNA, 870 bp, Homo sapiens
ctcaagcgatcctcctgcctcagcctcccaaggcactgtgattgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgt

SEQ ID NO: 142124 - DNA, 247 bp, Homo sapiens
gggattaatataatgcatcctccaataaatacaaagcagcataagcctaattccatagggtaacatgatacaatgtaagataatactctgcattaaaaactgaattggagagagacaagacagatggagagagagacagagaggcagagaaaggccgagcagaacagggacagagagtgagggctgaactgaaagagcagcgaatcaatgttgtactgtaatttaaaaaccaatatacagtaaatat

SEQ ID NO: 142125 - DNA, 154 bp, Homo sapiens
ggtggtctcaaactcttggccccaagtgatcctcccacctcagcctaccaaagtgctgggattacaggcataagccactatgcctggcctcttatgtatttttaaaagcagttaggtgactgaggtagtacaatttagatttagaattaggtga

SEQ ID NO: 142126 - DNA, 560 bp, Homo sapiens
ggaggaaagcagaggctgccgctgaccatcctgcagccctcgctctggctgctcacagctctccaccttctctggacttcgtcacttcagtatgtgaaacaaccatttcaaccagcttggacaaaagagagaagccaagatggggctgagaaaccaatgcaggcaggcccagggacccaggagtcagggaccaggtgctaccagatgcttgctccgactcgtgttgctgctgtcttctctgtgcctcaactctgtcctctgtcactgcaggcagcttcctcccaaggtgatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacataaaaagtaa

SEQ ID NO: 142127 - DNA, 453 bp, Homo sapiens
gattgagaactgcttttgagcaataaatcaaccagtgaggtagactcttgtggtatcacctttcaacatggtcaagctatggaaacgtgattttaatttctcaggttttttgtttgtttgtttttgtttttgtttttaatctgccagatggagaccatgccattgctagtctaccttgaaagacagatgtgaagaatgaagtcaggggctttgcaggaaggtgatatatcccacctcatgaaatcaggcttcaccacaagattgctttgaccaaggggacgtgagtagaagtttgaagaaccacagactggtccatcaccttgtttcttatccctctgacataagcaatgtcccagactggggctgttctgttagcctggcttccagaatgaagagagctgatctacatggcatatgtaacataaataaacctttgttattacaaaccactga

SEQ ID NO: 142128 - DNA, 526 bp, Homo sapiens
ggaggaaagcagaggctgccgctgaccatcctgcagccctcgctctggctgctcacagctctccaccttctctggacttcgtcacttcagtatgtgaaacaaccatttcaaccagcttggacaaaagagagaagccaagatggggctgagaaaccaatgcaggcaggcccagggacccaggagtcagggaccaggtgctaccagatgcttgctccgactcgtgttgctgctgtcttctctgtgcctcaactctgtcctctgtcactgcaggcagcttcctcccaaggtggaaggtgatatatcccacctcatgaaatcaggcttcaccacaagattgctttgaccaaggggacgtgagtagaagtttgaagaaccacagactggtccatcaccttgtttcttatccctctgacataagcaatgtcccagactggggctgttctgttagcctggcttccagaatgaagagagctgatctacatggcatatgtaacataaataaacctttgttattacaaaccactga

SEQ ID NO: 142129 - DNA, 498 bp, Homo sapiens
tgttgagtctcattgttggtagaaagtttataggaaaagtgcttggaaactgttgctggtcttccttccttcctttaaccttgagataagaatgcctttgtttgagtctcaagcatgtctcaagttatgtaactcacttgtattaaaactctccctgactgttttatattcagctttctagctgccctggtttgcagctttaattgaataggtggccttgtatttatgctaattttttgtctttctctttcagatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaa

SEQ ID NO: 142130 - DNA, 423 bp, Homo sapiens
aggcaaggctgagcagataagaaagggtgctctccggaatttatggtgcagagcaatgatagaatggattcctacaaacatttctctgtccaaaaattgttggcagctggcacagctaactcttaagttctggatgctacagtttctacccaatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacataaaaagtaa

SEQ ID NO: 142131 - DNA, 233 bp, Homo sapiens
gatgatggggagacccttaagcagagaagggaactgattagatttgtgctttatatatatccttctggcagttgtgtgcaggatggatttgagcagaggaagactaaagctagaggttagagtggaggctggtgcagttgtctaggacggaatttggaataacagaagtggaagcaagatacagaggagctagggttgagaaataactaataagttacattggcgagacttag

SEQ ID NO: 142132 - DNA, 1265 bp, Homo sapiens
gttgctgcctcaatttctatatgagaaatgactgattgatttcatttttctgttcacgctaccattttcatatcatactagcacatgttacccattaactgtattgcagatttggtctcacaaaattcttctaaaataacatttttaaaaagcatattaatcaaaaataagctttatatttctgaagcttgtttgagcatagaatgcctttggataaaataccattacctagtaaagtgtgaacttttataatccataaaaattattcttttataagaatattcataaatgtagttagattaatagaagattctcgattctttgatcagaaaactaaggactatattgaaaaatcagtgacaaatttaattcttatagtacatctgaaagaaaaaagaaaactcttgggagaacttttacagtgatttaattttgctgttgatatatttctttgggtggtaagtatggcaaaacatgttaaaatttaatgcaaagagattttgtacatttttccatctctaagaaggacaaagcctaagcccctccagatagatagaaaaactcatttagagagttctccttcatgttaatctaatttcttcttaattcagctgtaaaacagaaatagaatgatcgtattaatcatttaaagctgtgtaattgcatagattccttgttcctttaccccctcttatatcttgtttcctatcctttgtgactttttttgcattatatataaggatgccgaaatactgtttattgttgatagtttacaaaattgaatcttacattagtgcataattttggtgaatgttgaagattatggtagattgccttacatttctgcatattgtttgcaccttggaatgatagcactggcatgaattatagagctgaggatctaaagatttttactttgatttatcccattatcatctgcagggaaacaattgcttttactgattaaaaatgcaggctgggcacagcggctcacgcctgtaatcccagtactttgggaggccgaggcgggcggatcacaaggtcaagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccgggaggtggaggttgcagtgagccgagactgtgccactgcactccagcctggtgatagagggagactccatctcaaaaaaaa

SEQ ID NO: 142133 - DNA, 735 bp, Homo sapiens
ctacgtagaatctcccaactttgaagaccattactaggctattttaacttcaccaggctactttgagaataaatttatatacctatcacatggttctgtcatggggttatatttcatgttgcagcatgagaactgacatgcatacacttatatttgatggagatgctgtgaagtgactagatagaatctgtaaataaattcatattccttgaagttcagtacttcctaagcagaaagtagtataacttcacagagatagtgcccagaaatctatctgaaattctttatgacaatactcaatctttaagtagcacttgtatttttaaatagttggatatattgtaacatcttttccctttgcctattgaatgcttctaccttaaaactcactgtcgatggatttatagggtatattccagaaaaaaaacaaaaaaaaaaaaaaaaattttgggggcgccacgggcccgaaaacagcttctcaaacccaatcggtagggagcgcgggccccaaaaggacaacgtgacgagggccaaaggggtaccaaagagacaccgggccacagaacagagcgcgcgagaatacacacaccgaaataaaaaaaaggcccgggggaagccgcaagggtttcaggaaacaacaccgcagaaggaacctcgagagaggcataagggggagtaccaacacgggaggagtcccaggggaacccgaactcagaataagccgcgacggccgca

SEQ ID NO: 142134 - DNA, 445 bp, Homo sapiens
gttgcttccccttccgcctgaggccttcccacccctgtggaactgtgagtcaattaaaacctctttcttttataaattacccagtctcaggcagtccttcatagcagtgtgagaacggactaacacagatgtcatgaggaggacttgagaaagagacaagagaagaggattcttcagaaatgttggtgttatgaatggaacccaaaccccaccctttggcatctttaagagatttcagtaaagacataaattgatttaaaaactgtgttttggtcaagcatagcggctcacttctataatcctagtactttcagaggccaaggtggaaagattgcttgaggccaggagtttaagaccagcctgggcaacatagcaagactctgtctctcaaaaacaaattaaaattagccttatgtggtggcatacacctgtagtcccagctact

SEQ ID NO: 142135 - DNA, 236 bp, Homo sapiens
ttactgacaaggtgatattattatgtactgttttctaaggtcagttaatttcaatgaatatacttttcacccatttacaatttgaaaaactgataatgaaaattcatttacaacctttctgaactcaactgggcaagaaattatttcatacatatatggaattttttcccatctactctaataaaaataagcaattcaatccacaaacatataatcaccaaacaaatcaaggaatt

SEQ ID NO: 142136 - DNA, 462 bp, Homo sapiens
tgcagccccccccccgcacattgcagatactattgtaaaatcatgaactttgattcatcctcccctaaaactacaaaatgctgattaaaacaaaaatgcgagcaagtgaagggacgtgcactgtgttcatgggtcaggagactcacaatagttaagatgtcaactcctcccaaactgatctgcagaagcaatgcatcccaaagtcccagcagcctcctgtgtagaaactgacaaggtgattctgaaattcatacagaaatgcaaaagtcttagattaaccaacacaactgtaaaaaaaggtcaggctggccgcagtggctcacgcctgtcatcccagcacttcaggaggccaaggcgggcagatcatttgagcccaggagttcgagaccagccaggccaacatggtgaatccctgtctctactaaaaacacaaaaaattagttgggcatggtggtgcacccc

SEQ ID NO: 142137 - DNA, 398 bp, Homo sapiens
tcactctgactgggggtggaagaggaatgaacaagtccaccccagcgtaaaaataagatgaaaatataaaagaatgtcagtgttgaaggttactccttttgattttgccaatatcccggaaccatgtgagcacatgaacattccaaagaagaagatacctccaggttcttcagatgagtctcactctgttgcccaggctggaatacactggcaccgtctcagctcactgcaacctccgactccctggttcaagcgattctcctgcctcagcctcccaagtagctgggattacagtttctctaaggcaatcagactgcagaacctagtcctcttgtgtgcccagaaagaaaatgaaaaggacttcaagaaccactcaggattgtccctgctacaggaaa

SEQ ID NO: 142138 - DNA, 505 bp, Homo sapiens
gatcgccatgatttgctacacacctggagtcagaaggaaagtctaccaaggtatcttgctgttcctcagcaggcaggcctgttgaagaacctcttttctgctgacacacacaacatacatacactatctgtatcaatgtaagtaaatgcctaattgtttttaaagtgaaaagtagaaaatgttctattctttcattttaaaacttatcaagaatatttaataagtgagacataatttaaattaaacaatagaacttaattatcaatagaatacacttgtcagctcatctcagctctctgagtgggaagcagaagcagaaaaaacctcaaggaagtcagagtagatggctgagcccaggcagtaaagtgcctgcatgtggcccaagtccctccctagtgactttcctgatctttttgtggtctacagttcccacaagttcaacagattgatttctttttttgttttgttttgttttgtttttttgcaacaaggtctcatctgtcag

SEQ ID NO: 142139 - DNA, 501 bp, Homo sapiens
gtactgtaactcttggttctgctcagaagctggtcttaacgggctctaggaccatggtaactcatgtgaggcccctagatataggcaggcaggcccctgagcccacagttcgccccatctgacaaacaatattttccaaagatagctcacaatatatcccatattacatgccttttcttacagtgcgacactatcagtcttcctatcaagtgataggatcaatattccctcccctggatctgggtagctctttgtaactgcctcaacaaacaaaatatggccgaagtgactgtatgttagtctccaagtccagagcataagaaactgatagtctccacatctgcactcaggaagatcacttttggagtgcaaccaccctgctgtgaggaaacctagtccacacggagcagccacatgtagttcttctggccaactgtctcagctgacatctcagccaaaaaccagcatcgaccaccagctatgtgaataaaaacacctccc

SEQ ID NO: 142140 - DNA, 347 bp, Homo sapiens
cttgtcttcctcgatcttccagggtccgcactcctgcagccctcggttttcatcactgaacaatgtgacggttcctgccccctttgcagaacctgggggttccagcagtgagaactgcgggttggggaggaggagtcagaaaggggaacgcccccacgccacacccacacagcgcacacctccaaatgcggacccagacccgaaaagttggccggcacacacacacagaaccactgttgacccaccgagaaggatgctttcacccagcttcacacctggacaaacagcctcacagaccttactgacttccccaaggtcacaggctaaccagaggcagggcaggctgg

SEQ ID NO: 142141 - DNA, 687 bp, Homo sapiens
aggacccaaaatgcctccagacattgccaagtgtctgctggggtgaggggtggggtggggcggtgcagaaccacctaatgttgaagaccatttatgtagggaaggatgtggtaggagatgggagatgtacctttagcctatgggggaggcatttggtgaaggggaagaaaaaaactttattacaaaagaaaaaaaaaggtaacttaaaactaaacacacttttaaaagacacaattgcctgtatatttttccagttttatttctgcacgatcatcctaggcatactcgttggcaaaccgttcttaacataaccttacttctatgtcattgcgtattttcctacaatattatctgtagtagctgaggaatattgccttatctgattgtgccataatttatttaaccactaccttcaccaattattgattggtttgctgccagctgctctgctagaaagaagttaatccaacaaggccctgctttttggagccacaggctagcagaaaatgaagacattgagcaagtcagtttggacatgttgagtgttaataaggggtaatgtgggaatttctaacaggggagctgaacctgggggtagggagggggcgtcacaaggaacatttaaggctttggttctcgagcttcatgaaccatcagaatccctgaggagcttgttaaaacacagct

SEQ ID NO: 142142 - DNA, 727 bp, Homo sapiens
attgcattttaattttgttgactaaaattttactttctaagagctcatcttgttttctgatggtttttcttcctcctcctcaatccaacccatcccctctccttccctggcatcactgcctttccccctttccctttttctcctctctccctctccttcatcccctcttcttctcctctctccttcctgtgctcctcctcttccctctttctccacctgcatcctgttccccatcccttgctgtattattttcttttatctctgagggcagagattgtggaatttttaatttgttctccatttactctactttagttatcttttgtctgagccagcattctgtttcctccaagttgctcttatctgtgttttggttttggttatatttgatgtccattcatctctatgggcaaggctctgcaaagctcattggaagatgtgtgtgagtggggtgggtggaatggtaggcttcactgtagaataacagagcatgatccagttgatttagctgaaggacacccagatgtctgtatctgtgtttttggacgggctgttctgttccttccagaataaagatctttcagtatcctccatgtaaataaaagttaccccttcatttattatttgtaagtattgggattttaacatcacactgtcttaaagtaggacacagctcagtttattcattaaaataaaagagttggacttgatcctttctacctataat

SEQ ID NO: 142143 - DNA, 460 bp, Homo sapiens
ttcccacctgcttcaggatgtgctccagtaagtctctccctctctgctgcaacctgttactcccctccactgggtcatcttcacacagcctgcgatctctcccatcttttacaaacctttttggaaccctctaacctccaatttctttccccccattcaaagcaaagtccctcaaaagagctgttcccatttaacatctaccattctcatttgaacccattcgaaacaggtttgcgtccccacaactcctccactgaaacagctctagtcaaggccactggtggcctccatgtagctaagtacaaaggtcaagtctcttcatctttgcacttgactagccgcatcatcttggacaccttctccatgtggcttccagggctccacatcccttggttttcctcctagtgctctagcctctcctgaggcctcgatccagtctttgctggctcttcctcacctc

SEQ ID NO: 142144 - DNA, 155 bp, Homo sapiens
catttttgcagatgtttcttctgttgttttgtttctttcataaataaaatgtctacagagctaccatgaagcatgtttcctgtctcttagttcaaagaatatataactcctggcatttattagagaactccaaaagctcatttgatatttagtaa

SEQ ID NO: 142145 - DNA, 264 bp, Homo sapiens
tttctggaaggataaacatgaaatagataacattggctgcttccagggtaatgaactggaagccaaggatgggaagaaaaatgttcactgtaggcctactctttaaagctggaatgactgtttcaattctccgccaagtcttcccagaacgcatgcactgaatggtggccgtagctcacccagagtgcaggtgacacaatggaaacgcctctagacgcttgctgccagaggtttgaaccaggctcactgcctccaggcctcccc

SEQ ID NO: 142146 - DNA, 1615 bp, Homo sapiens
ccatgaattctatgtatagcaaagttgtccttcaagaatgaaggaaaaagtaacacattttcagataaccaataattaagggattttattaccagtagacatgtgctacagaaaatgctaaaggaaaccttttaggctgaactgaaagtacactagacagcaattcagagcctccaaaataaagaatattcataaaagtaacaatagaggtaaatataaaacccagaattactacatgtgtcatatagtttataacttctcctatttatagctttctatatttatatttatctataacttcataggcaaatgaataaaaattataaatatgatagtggtcatataatgtataaagatgcaatctgtgacagtcttatgaagcagggatgaagacatataggatcaaaatgtttgcatagttattgaagctatgttgatattatgaaattatattgttacaagtttaagatgctaattataattctcaaggtaaccactaataaaattaccaaaattatgcagaaaaggaaaaaagaaaaacaatacactataaaaaaccaattaaatacaaaaaatgtcagtaacagacaacttgagaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaaacaaaataaactaaagtaaaatttacaagagaaaaagaagggcattatgcattgacaaaaattttgacatagccaaataattatctgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaagaatctacccaacaagagcagaatattaattcttctcaaatgcacatggaacattcttaaaccatatgttaggccacaaaacaagtgttagtaagtgtgaaaatttgaagtcataaaaagtatcttttgcaattacaatggaatgaagctagaaatcaataactagaaaaaccagaaaagtcacgcatatgtagaaatttaaaaacccgctcttcaacagccattggtcaaagaagaaatcacaagggacattagaaaataccttgagacaaatgaagtaaaaatacaaatagcacgtttatggtatacactgaacatagttctaagagggaaatttatagctgtgagcagttaactaaaaaaagaagaaagatctcaaatccatagcctaactgtacactgtaaggaactaaaaaaaaa

SEQ ID NO: 142147 - DNA, 1247 bp, Homo sapiens
gacttagagatcccccaggtcttctcccctcaaattatatgaagcaataattgctataatttaagggagaaaagaacagttctatgaaaagttagagaatgaaatattccactctcaacatgagattaaacaactagacataagatcaataaggaaaaggaaaaaagaaaaacaatacactataaaaaaccaattaaatacaaaaaatgtcagtaacagacaacttgagaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaaacaaaataaactaaagtaaaatttacaagagaaaaagaagggcattatgcattgacaaaaattttgacatagccaaataattatctgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaagaatctacccaacaagagcagaatattaattcttctcaaatgcacatggaacattcttaaaccatatgttaggccacaaaacaagtgttagtaagtgtgaaaatttgaagtcataaaaagtatcttttgcaattacaatggaatgaagctagaaatcaataactagaaaaaccagaaaagtcacgcatatgtagaaatttaaaaacccgctcttcaacagccattggtcaaagaagaaatcacaagggacattagaaaataccttgagacaaatgaagtaaaaatacaaatagcacgtttatggtatacactgaacatagttctaagagggaaatttatagctgtgagcagttaactaaaaaaagaagaaagatctcaaatccatagcctaactgtacactgtaaggaactaaaaaaaaa

SEQ ID NO: 142148 - DNA, 503 bp, Homo sapiens
tttttttttttttgagatggaatctcgctcttgtcgcctaggccggagtgcagtggcgcaatctcagctcactgcaacctccacctcctgggttcaagtgattctcctgcctcagcctcccgagtagctgggattacaggcacctgccatcacgcccagctaatttttgtacttttagtagaaaggatggttcaccatgttggccagactggtctcgaactcctgacctcaggtgatctgctcgccttgggctcccaaagtactgggattacaggcatgagccactgcacctggcctcatcttcaagtttctgtactgaagtactctgggactgaagtccaaattatttatttgttgagatggagtctcactctgtcacccaggctggatgcagtggtgcgatctcagctcactgcaatctctgcctcctgagttcaagtgattctcctgcctcagcctcctgagtagctgggattacagatgcccaccaccatgtccagcta

SEQ ID NO: 142149 - DNA, 268 bp, Homo sapiens
tttttttttttttgagatggaatctcgctcttgtcgcctaggccggagtgcagtggcgcaatctcaaaaacacaaacaaacaaaaagcaaaaaaactgcttagcaattaatgaaaatgaaaacacaacataccaaagctgaggaggtgcagccaaagcaatgctcagagggaaatgcacagctgtgaatgtctatcttggtatttgtggaatgaacaaagcgatgagactaagctgatcaaactcccagaggaacggagggggacatg

SEQ ID NO: 142150 - DNA, 317 bp, Homo sapiens
gcctgggggtggagaaagaagaatggagagaagtgggagcgtttaatctggggaagagaaagacaggggtcgtggagggaggtggcagtgctgtgggtaaaggcctcctggactgactctgcagcggggtgaggaaggactggacacagtcactgcggcccctggggaagcaaaggaacagtggctaggatttacagtgctttattttggcacaaaattagaaatatttccttaaaagatttaaatacatttaaataacactttgccaaaaggtaaaaagatcacagaagaggatatttggggcccacactgctcct

SEQ ID NO: 142151 - DNA, 434 bp, Homo sapiens
ctctccacaatctgctttcttacccacagaattactaaagctcttctaaaataaaaacaaaaaatgattcctaatcctttaatccaataggctgtttttgtcttgctgctcttcaatgatctctttgaatctatcaactgacactgtttattatcatcctataaaacactcccctctcactttcatgaagctacactgcgttgtttgtattttacactctgatttctctaattttgtctttgttggttcctcattttttattctcaataaatggggatctaaagcagcagttttctacttttttttctgctacaacaggtaatattcacggaaaagagaacaagagagcttactttatttatctgatcttgtttaccacttgtgtcaaagaattgctcatcgaattgaccagattcaaggaccattactggtcc

SEQ ID NO: 142152 - DNA, 765 bp, Homo sapiens
gagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaa

SEQ ID NO: 142153 - DNA, 522 bp, Homo sapiens
gatctagaggatccctatgtccacagggcctagagagagttccatcaacacgagaaatggagaaaaccaaatggtttgttgctgtatatttagtaagggctttttcacagtggccagaagtaatgttacatttaaattctgcatcccaatcccgcatttcagaaagggacatgcttttttattaaaaaaaaatgtttaaaagtgagttttcatttgagaggctcttcccttttgtatgggtgccccctgcaaggccgggtctagctgagtcgtatttacaggtatagaagtgagttgctgctgaaatgcaccatgttgaaatacactaactgttgtttctgaggggcagtagtcctatatggataaaaatgtccaggcctccatctatggacacctttctacaagtgtccatagctcttatctgtctatgggttccactcagctaaagtacttcctggaccataaagaaagggacacagcgaacacgtaattgttagctgtatttcatgttcacaattcctt

SEQ ID NO: 142154 - DNA, 304 bp, Homo sapiens
ggtatcaaagtgatcctgcaccccagagttcccagaaactagctagaaggtcggtggggggcagcctggaattttgtgattgctatagataatccacaaaatggataatgaatataggaataatcaaaactctacccagatacaagaatggggctatgtgggtaggcagctaagagcagaggctgcaatgagttgctagcacacaatttagtatcattaaggaacaagcatgaccctggatgctctaaataggaaagaagcttgtaggaactatgaagtcgtcttccttctctattccatggtc

SEQ ID NO: 142155 - DNA, 411 bp, Homo sapiens
ttcttcaaagttttagggtcaaaggactcccagtgcttcagaatgcactccagaggagtgccggctgaagatggcttgttacccatctgcaaaagagacaagaatagaggtttcctcggtctcctggttcttttcaatgtgactcagggaggaggggacacagtaggagagtcctcctggctgttctccctccttggtccccgggtcccagcaccatagttgcagccccatggttgcaggtgtgacccccaagcgtaataccagaggacctaatcaatgggctagtcatgtttacccatatgacctcagtcctctgcctaataattgggtaattactctctgacctcctagacctgtgtgtctgcctgtgtcttcccactattgaaaataaataaataaaactaaactgca

SEQ ID NO: 142156 - DNA, 472 bp, Homo sapiens
gagtgttggagccggaataggggtgttggagctgggataggggtgttagagccgggataggagggttagagctgggatagaggtgttagtgctgggatatgggcagaggccctggagggagtttgaggcaggggtggagtgtgccaggccttctgcctctcaggggtactcagctgggtggtaaacatctggggcctatttataggaagctgtaatagtaattttctttcctcgcctgttctgccctcatcgtgattagcttttttttaacccaacctccaaaaagcatgtgtgaatgccaaacccagctctcagttgctgagcaccagcttcaggcactgctggatccaggggcttaaaatgatgtcacaggagaaacggtttctctccgcactggcactcctgcctgtcctctctgtggacatcttcctgtgggctggtagatccaggctcacatccagtctctgggaaa

SEQ ID NO: 142157 - DNA, 298 bp, Homo sapiens
aaaccctctaataaaaaaagaaagcaaaatgaaaggtaaaacaaatagatttcagtcttagtttataatagacttatttaggtggttatgatgaaatgggacatggagaatacacatggatggtcaggcatttcaaaattttgcttaggttcacgttgcttttttgtttttggagacagggtgtcactgtgtcacccaggttgaagtgcagtggcatgatcatggctcactgcagcctcaaccttctgggttcaagcaatgcccccaactcagcctctcgatagctgggactacaggc

SEQ ID NO: 142158 - DNA, 418 bp, Homo sapiens
cttccaccaacaatgtatgagagcttcagttgctctacatccggccaacacttggaaggaaattggaagggtagcagatccaggatttagggggagaaagactcaaatagaatgcaaatagctgggcctggtggggtggctcacgcctgtaatcccagtactttgggaggccgaggcgggtggatcaccaggtcaggagtttgagaccagcctgaccaacatggtgaaactctgactctactaaaaatacaaaaattggccgggcgtggtgtcgggcgcctgtaatgccagctacttcggaggctgaggcaggagaatctcttgaaactggaaggcggaggttgcagtgagccgagatcgtgccactgcactccaacctgcgtgatgggagcaaaactccatctcaaaaaaaaaaaaa

SEQ ID NO: 142159 - DNA, 156 bp, Homo sapiens
tacctctgagagacatccaacttttgttcacactatttacaccacaggaagtgaatattccagctctataatctccacttcatttttaatactgttttcaaccctgctaaaatggtccaactctgattttggttcaagtaccactgatgtttgcaa

SEQ ID NO: 142160 - DNA, 489 bp, Homo sapiens
catgagatatttgatatggcatagaatgcataatcacatcaggataagcagggtatccatcttctcaagcatttatcctttgttagtgctacaaacaacctgcaaggctcttgtattggtttgaaccccgatgacgcaccaacaacccccacgacatgaggcggtgtggagcaacatgctgttttaataagcgcctgggtgcagacgggtttatgcctaaatggcatcagccccaagtgaggaatgggttttataatagcatcagccccaagtgaggaaggggttttatagtcctctgtaagcaggaagtgtcccagtctgacgtggctgctgcgtaaatgtgtccggaattggttccttccagtggattcttggtctcgctgacttcaagaatgaagccacggactgtcgcggtgagtgttacagttcttaaagatggtatgtcgagagtttgttccttctgatgttcagatgtgtccagagtttctt

SEQ ID NO: 142161 - DNA, 451 bp, Homo sapiens
gcgccatcagctggtgctcagagcccggaggaaggaactccccccggagttggggggggtggccctagggatgcctcaccggccccatctctccacggagctacgggtagcatcgcccatcgctcctacaccccacgcgccctggcccagaaccggcgctaggctcgggcagggatcacctcgaggccggggctaccccaattttagggcctgaagttacctgttgctttcagggactccgagccctgtatttctccgtctgactcagctcctagaccacacgggagcctctgctcttttcccgacatctccggatttcagcatctggctcagcttcctggtcatcggtacctgcaccatcatctgtccacacatctgcagctttcagttcctcctagatgcccggctaacccccaacccacaagattctacacccgctcgaatctaggca

SEQ ID NO: 142162 - DNA, 477 bp, Homo sapiens
caggtggatcacctgaggtcaggagttcgagaccagcctgaccaatatgatgaaaccccatctctactaaaaatagaaaaattagctgggcatggtggtaggcgcctgtaatcccagctacttgggaggctgatataggagtatcgttttaacccaggaggtggaggttgcagtgagtcaagatcgcgcattgcactccagcctggccagcaagaacgaaactccatctcaaaaaaaaagtaaccttaaatttgaaccaacgtgaatttagggtatgaaactgatttatattgacataatctatgcatttctcacataaatgaagtgaataaatacaaataaatggtacgatgctgaacaaaagaataccttttaagaaaatcttttgtgtttccatataggtttaggacattaatatgtattgttcatctggttgtgtgggcactctaatttataagctgatcacctcaaattccc

SEQ ID NO: 142163 - DNA, 524 bp, Homo sapiens
ctaggtgagcagtgctattcacttcagttcaacaaattacaccaagtgtctgttgttgaccaggctctgcacatggcatcagggacctggagatggataagcatggcactatgtgtgtctagtgaggggcggaaggacagaggcatagattgacaggctaataccacttgaaaagtgcaccaaaggagggatggatgaggtactttaggggcataagaagaaagctgctagctgggcatggtggctgacacctgtaatcccagcactttgggagtctgaggcgagcgggtcacttgagctcaggagcttgagaccagcctgggcaatgtggcgaaaccccatctctacaaaaagtacaaaaattagccgggcatggttgcgcgcacctgtagtcccagctactcaggaggctgaggtatgaggaccacttgagcccaggaggcggagactgcagtaagccaagatcgtgccactacactcctgcctgggtgacaaagccagaccctgtctcaaaccaaaaaaag

SEQ ID NO: 142164 - DNA, 229 bp, Homo sapiens
ccgtggtactgacagattcgtggccaggacactggcgtctgaatttcactgtaatctgcccctccaccctgttctccagacgtctccagtttatctcctgatgcagtcagggcgaccccatgtcctctgtgctaccactaatgtggcccagggacgataaattgtgccttgtaataacactccccgatgggttaattgaccctgctctgacgggcagtccctgctggcc

SEQ ID NO: 142165 - DNA, 588 bp, Homo sapiens
gttttaatgttcttcattgaggcttctctgttcatcaaccctttgagcaggaagcagtataaggtttcttatgattattactactaacacattgtaaagatctttttcctttaatccatttagtacaggatctatttagtactggcctgtgtcctagaataccatcagagataaggctattatcctttcattgagtattatcctgggaaagtatttataaaattgaactccattgcacctgctgacctccttttttaaatgaagaaggggtggggatagagattatgctaactgaattcagatgaagcagtgtatttgccagcactgacacaaagtgctttagttagggccttttgttttgtgcaaatcgattccatcttggactctgaaagaaataagttgacaattcagatcaggaagttgataatcacattgggtcctctgcacttattggcgcagttgctatttttcatgagcaattctgtactaggactcctagctatttcaggattagtctaaaatgtttgtttgccattattgtcatgttttctgcaaaattgctataaatgtaatctagtggcattatat

SEQ ID NO: 142166 - DNA, 294 bp, Homo sapiens
agccccagggccctgtctacagggtctctccagctggggccggcccatcatggcaggagtaaaggcccgggtcccagctgagctccgacccgccgattatcccagattagggagcctgtgaccatctggacacagctgataatggcagtggaggaggggagtggggacagttagcctgcctgcgcccaccctatggggaacgctcaggacaaagcaaagaaggcatcatatcactggcctacccagggaaaaggcaggggcagatccagggcacgctcctcccaaacaagtggg

SEQ ID NO: 142167 - DNA, 190 bp, Homo sapiens
tttcaaatcaagaaatgtgggaggacatatctctgatgagtcagaatagtggaagggagtggccccggaatgtgactacctggaagaatctagttccttaggctaagtcactagtgttagcccagtataaaaatgtgtttttcagaatggaatcaggatgggatacaggtcgacgcggccgcgaatttag

SEQ ID NO: 142168 - DNA, 309 bp, Homo sapiens
cacgcctcattcagtgatgcctcatctcatgccctcatccagtggcatgccctcatccagtgtataaatgccctggaaatatctcaccctctttgaatatgcaggtgatgcctgctattggtggtgttttgtttctgaagggtgggcatgagtcatcaaactgtggtgtgtggctccaggcctggcatgctcatactttccctccgtatgtttccagaccatccacctctttctgtccccactggatgaggctcatccagtgggttcaccctctaaatcaccacgtcaaacccggtggatgatggcgtg

SEQ ID NO: 142169 - DNA, 513 bp, Homo sapiens
tgctgggattacaggcgtgagtgtatggcgacagttcttaagttcttagatgccatacttagagatgtccttgtggttcagtcttctggcctgggatatgccgcacagggtaagatgtgtaaagtgacttaaagcctacgtctggcagtgaccaagaaaagaaagcgaattgcatttgtaatgaactagtgccaaagactgttggtgttcataggaaatagttcatcacaggaaaaagagtggtttaatatataaactattctgactataaatgccctggaaatatctcaccctctttgaatatgcaggtgatgcctgctattggtggtgttttgtttctgaagggtgggcatgagtcatcaaactgtggtgtgtggctccaggcctggcatgctcatactttccctccgtatgtttccagaccatccacctctttctgtccccactggatgaggctcatccagtgggttcaccctctaaatcaccacgtcaaacccggtggatgatggcgtg

SEQ ID NO: 142170 - DNA, 675 bp, Homo sapiens
agcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaa

SEQ ID NO: 142171 - DNA, 495 bp, Homo sapiens
tgtgagcctgttgctcaccctcgcagacggacacacagccaagtctgaggtggccgctcgctcagcgccaacccgccagccaacagatcacttttgaaaaaaggaacagcaagagaacatcttctctgcctagaactgcaggcgggtggaattttcgggaagcagaatcgtatgaccaaaatagaaacccagctagggaacctctgagaggcagccgtccttggggggcacagggaggggcagaggcaaatggagctttcaggcttgagtggctgggaagagagaagcagggcctggcctgggggctggatgcccctccgatgggcagcagggccacagggctccactgatccctggccaagctgatccgacccacggcttgatgagctcaccccgatgccgaggtggcgtgagtcccagggcctgggtttgggacatgacagtctgtcgccaaggcagcacttaggatgccacagctggcaccgcagatctgta

SEQ ID NO: 142172 - DNA, 667 bp, Homo sapiens
aaacttatcaaatggaagtttttgtgtatcaattatgcctcactgaagctgtttaaaatgctttatacatttggcctcatacggccagtctagacagattataggccaagttagtaaaataatttataatatgtgtcattttatctagcctagtgcttcctttgtgtttctgtttctcatgtgtacagcactttgacattggtgtgcattaaattactattcatttgtttaaatgaacaaatcttataaatgttttcaaatatgctatgtgtggatgttcatatgatttcatgatacagaatattctgtgtcaaatttgaatagcttcacctattttttttattacgcagtatgaatatcatatattttccatcaaagcaaaatctgccatcatcataaaagtaaatttttgtgtaagtcatttcagtacagttgagttgtctatagcaatttaagtcatttgaccagaggtttagaaactgagaacaaagagttattcaagcagaccttgggtgaccacttgtttggggtactatagatgggatttatcttaaagacaaaaggctaaaagagacaaaaatccctttcaattcagatttttactctgcttggtatatagtctttaaaaaaaaacataagaataagtcaaacaaatatttcctggtag

SEQ ID NO: 142173 - DNA, 590 bp, Homo sapiens
atgcactccctgctgcctgggaaccccactgaacatctctgccagctgaagtatctcttttcaggaagtccttaccaacttccctggaaaagtcaatttccctgtcaaacaggatgctttccatgagcaagacaaggacttgcacctcttctagagctgtggctctcatttatgccagggactgtgctaagagttaaatcattctcttaagataattctcaccacaatcccacttggtgaattatcagcagcctcatttccagagagggaaagggagcttacagggtcagttaacctgcccagggtcacacggctgctaagtggcaaagccagaacccgaacctggatcagactctaaatgctatatgtgctctcttcccaccatcccatgtggcttcattcatccatggccccacacacccacttgctttctcaaagcctgtggaaagtaagacagggcaacaaggttgcacagctggatgataataagcaagtgtaaatctctgccctccacaaagccatgctctgtgacagtttcatttctctaattcattgtgtgtacaacagactgacaggcacaaagcggagca

SEQ ID NO: 142174 - DNA, 373 bp, Homo sapiens
cccaaagtgctgggattacagctgttagccactgtgctgggccctaggcatctgttttaataagcgtctctgtgtctgatgcacataaaagtgtggaactcatggactagagttagtttgctcttcttttccactgattgtaatgtctttcaaaacaccttagaggaactgtaaggcaacggtctcattttatagtggaggaaactaaagaaaaggcaaatgatttacctagagttatacagctaagggcagaggcaagacttaaaacccagcagtatgactcccaatccactgcttttccactcacattgttcctgtctttctcctagttgtggggtcccccccggggatttcgtcctgagcagatcctgca

SEQ ID NO: 142175 - DNA, 806 bp, Homo sapiens
aacgggtgggtgtatgtttagatccaagagaaacaaattataaccatggatgtgaacttttcacagtcttctcaaaataaaagcttgaaaaaatatttttttatatttttcttctacaaagaccaaatctccttctgaagaggaataaagcaaagacaacatgttaagcacatatgcatcttcatgttgttgacaccttccctaaaattagcggaacacctcaaaatgtttattatttttggccatgattttaaactttaaaaaccagtacaaagatgtagctatatcaagtccaacagagctgaacggtaaaaaaataaaaaaagaagtagatacgtagtggagttcaagtaatattggacattgctgttttaacgaatgtgttttgagtgtgaaggaacaaaatactgtaggattagatttatgagggtaagccaagtaaaatgtggatgcccagtagtaagacctttctactgtatcaaacatgaattagacatgttgaaagcctcttaaatttattaaataagaatatgattgggaaagggtgaaggctctgtaaactgtaaagcccctgtaaatgtctccttggtatactacactgattggtttcttaagctacttagcacccatatgactaccattgtgttttgtgtgtgtggaagaggacatagctgtgggggtacacattactaacatggcagatgggggcagtggaaatcagggtagaaaaggagtatgacagacgcaaaattgacattttaagttcagaactactggtgtttccaagtcatggccttgaaccaaga

SEQ ID NO: 142176 - DNA, 2450 bp, Homo sapiens
  misc_feature (1675)..(1675): n is a, c, g, or t
  misc_feature (1728)..(1728): n is a, c, g, or t
  misc_feature (1795)..(1795): n is a, c, g, or t
aatgaaacatacattatgagttagagaacctgatagaatcacagtggggtcaggaagggattcttacggaagtgatttttcctgtttggcctttcttaagggcagattataattataaacagttaaaactttgtttaaggaggcccgcactaaggtgcagtgggaatgaaaggaagtagtagattctagtgacattgtcaggaaagatgaactggtgcttgagactggtttggaggaggggaggcagacagtaagggaaaggaatccttcaacggttgctccctgtggaattgaatcttggtgttgccattaatggtagttagaaatatgaagaggaggccgggcgtggtggctcacgcatgtaatcccagcactttgggaggccgaggcgggcggatcacgaggtcaggagatcgagaccatcctggctaacatggtgaaactctgtctcactaaaaatacaaaaaattggccgggtatggtggtgggcacctatagtcccagctactcgggaggctgaggcaggagaatggtgtgaatccgggaggtggagcttgcagtgagccgagattgcgccactccgctccagcctgggtgacagagcaagactctgtctcaaaaaaaaaagaaaaaagaaaaaaatacgaagaggaggcagttggaagagtagttccatcttggccaggttcagttgctggtgggcagcctaccagagaatactcacaggcagtcgtggctgcagatggggacctgagcataaacctttggaaagatgcagtttaggacaggggaggagaagggtgatcagaagtatggggaaaaccaagagcctggatgctcaggaaggatccgccggaaggaggagtttggtcagcagcatcagatactgctgtcattttttagaaagatgaaaagagcaacagtccttggatttagtggttagaaggtagtctttgttgctttctggaggaccatgtcagtgaagacgcagaaactgcatttcgggagaggatgtggatggtggggaagcagaattggggctgttagagaccttggtgcagggttgtggtggaaggaggggatggagcagggctaagaggcgtggtttaggagtggagagacgtgagcaggtttgtggactgaggggagaggagctttggtggaggaaaacattgatgctataggaaagcaggaagatggaacaaggtctcagaagagctggagcttgggctcactggtgcagtgctcacttggagttgcacctctctggccaactgtatatgtactctttatagtctttctctggtatatacttaaggaacattttagaatgtttacaaagaaggtcaagcatagataataaaaaatggcatggtttgagtggtatgttaagatatttgaatggtgatataccaaaataaatattgcatcatgcacatttggctggcagttcatcatttttctgctcagttgattgacgatatgtttattacacaatgtgtctgtgagtgtcttgtgcatagagattgtattagtccattttcacactgctgataaagacatagctgagcctgggaagaaaaagagatgtttttgtttgtttgtttgagatggtgtctcgcttcttgcccaggctggagtgcagtggtgcgatctcggctcactgcaacctccncctccggggttcaagcagttctcctgcctcagcctcctgattagctgggattncaggcacatgccaccatgcccggctaattttttgtatttttagtagagatggggtttcaccgtgttngccaggatggtctcaatctcctgacctcatgatccgtccacctcggcctcccaaagagctcggattacaggcgtgagccactgcacctggccaaaaaagaggtttaattggacttacagttccacatggctggggaggcctcagaatcatggcgggaggtgaaaggcacttcttacatggtggcggcaagagaaaatgaggaagatgtaaaagtggaaacccctgataaaaccatcagatctcttgagacttattcactatcacgagaacagtatgggggaaacctaccctatgattcaaattatctcccaccagtccccccccagcaacatgtgtgacttacaggaggagtacgattcaagatgagatttggggccaggcgcggtggctcatgcctgtaattccagcactttgggaagctgaggccggtggatcacctgaggtcaggagttcgagaccagcctgactaacatggagtaaccccatctctactaaaaatacaaaattagctgggcacagtggcacatgactgtaatcccagctactcgggaggctgaggcaggagaatctcttgaacctggggggcggagtttgcggtgagccgagatcttgccattgtattccagcctgggcaacaagagcaaaactctgcctc

SEQ ID NO: 142177 - DNA, 344 bp, Homo sapiens
gttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagc

SEQ ID NO: 142178 - DNA, 274 bp, Homo sapiens
aattctcctgcctcagcctcctgagtagctgggattacaggcgtgcgccactacgcctggcaaatttttgtatttttagtagagacagggtttcaccatgttgctcaggcaggtctcgaactcctgacctcatgatccgcccgccttggcctcccaaagtgctgggattacaggcgtgagccactgcacctggccggcttaaaaaacatttgtttctgaggcttaagaatctaagggctatttagctatgtgattcgagctgtctaactttcca

SEQ ID NO: 142179 - DNA, 740 bp, Homo sapiens
ctagattatataactgaagctccctttctttgctagaataaggagaattttctgtaccttctgactccttgattgattactccgaagtccttctccaagctctataacaaactgtgacaaacctatgtaattaataggattcaattatcaccagaggaggaaaaacaaacaaaacccagaggaaaccaaaattctttccttgttttattttttgagacagagtctcccactatcacccaggctggagtgatgacagctcactgcagcctcgaccttctgggctcaagcgattctcccacctcagcttactgagtagctgggacaacaagtgtgtgccaaccatgcccagctaatttttaaattttttgtagagatgaggtctcactatgttgcccaggctggtctaaaatcctgagctcaagcgatgttcccacctcagcctcccaaagtacggaattacacatgtgagccactgtgcctggctggaaccaaaattcttcaggagaaaaagtctagcacttagttagctcccagcatcagactgagggtgagcggatctatggacttaggggttctgactttaatctcttcttagtttcctgggctagatgaagaatagctaaaatatagtcctggttctgacaggtggctcttccacgtccatgacaaacacggcaaatcaaacagcctttttttcactgagcacatatcctcccgcagtgaaaaataggcagctacta

SEQ ID NO: 142180 - DNA, 267 bp, Homo sapiens
caaccatagaatggaacgctactcagctgaggtgggagggtagcttgagcccaggagttcaagaccagcctggacagcatagtgagaccctgtctctaagaaaatgtccacctttgatttctcttcactccttttttccatgcagggccttcactcttctgtttctcaaattccttctttagtattatttcttccttcctttaagcttcacacagtaaagtttgcttccctactttctaaccgagagtatagcatataattaaaatt

SEQ ID NO: 142181 - DNA, 577 bp, Homo sapiens
tactaagcctcgagtgtttcactgtgaccagataaaatttctcgtgacacctttgggtatgccggcgcttgaaggaagtccttgtggacacaccctgggtattcaccccaaggtgttgggcagactttttccaaaaatgatcgaacctgtcgcttcatggagaactagtggcaacatctgttacagtagtaaaattcaagtgaaaaccagaattttggaaaacttaacgtcgcttgccatgagcttggtgtcttcccaacacctagagacttttctggtgaggtctgtgggggtgacagatggaatgtttccaccattgccagtgaaatgtgtcagcctttggaagacctacttgactcggtgggagatccttcctgaatgaccagcagagtgtcacgaagtcacatggggatggagtggcaaagagttgtcacaggcctgcagaaacccacctttgtccagcttgatgtggcctcagggctggagactcccagccatgcagaaaggctgtaaaaacaaacccatctccctttccagcctcaggcatccatgaggcctggcttccccacagcgtccc

SEQ ID NO: 142182 - DNA, 275 bp, Homo sapiens
gccccctcagataatccagaataatctccctatggtaaggttcataaccttaattacatccgcaaaatcccttctgctatgtaatgtaacaaattcatagtgtttagggtgtagatatattaggggaccattctgggtaccacttcaggtgaacatttctgtgccaagatggctaacaggggtgaatgataatgctaaatctgccccaaaacaacaaacaacaacaacaacaaaaccaaaagaagaatttcactgacattaaattctaaatttta

SEQ ID NO: 142183 - DNA, 1704 bp, Homo sapiens
tacctttgtattcttatgtattttatttaatgtatttaaaaacatttttctgatagtgctgttattgtcagactgctacagaggtccatggcagaaaattaagattaagataccttgatctaagaagttagtaaatgctgtgtgacagatctcagtaatatagcgcagggatttgtacccaggtgtgagagattcaatgccagcgctcttaaactaatgataaaaataaaatgagacacaagctaaattggacactgctgtgtgccaggcacagcattaagcagctttaattggattagctctgactcttctcaggcacctaaatgggtaagtacttttattatccacatttgttagttgaggaaactgaggtccagcctggctgtttcttgcctgaggtcacaaaggtggagcaacgcctgactccagatctgctttgcacacttcctcccttatgcttcctctttaatgctgaggtgagatgttaaagggagctgccaagcctcagtataacagtacaaagaatgattcctgctaaaattggttgtttgtaatatgtaataatcctgagttatcagtgtggtggttcaacttgccagcaattaaaataggagaattgtgcttatttctgatcctctaccccaccttccgacatgccctggaactaggaacaaagccacaagactgttatgtctgttgttttcttagtctgtgtgttgggagtatatctcacattttgtaaatgtgcattttctttggttacacctggaatgtggtccaagctcattcagataattgtgctctgtgggagagaaggtaatctttgagatccaaagagaatatatggagaagattcaagatattttgggatttcagggaaactctaaagctgggccacgttgccctgagtaatgctaagagaaaccaaaacatcacctgtgatgtaaaatctcaggtagtgaaatcttgaccatgtactactacacattagtgtttgtttgctcttgagacaattaatttagaccgacagactcattgtacttacagatttgtagctcagtgtttaagcacaccagtttctttgttcattgtttagtttgattcctgatttgttattgatgggtgatatatgactaattttttatgcaaatggattaggcggtgtattcccatccctgtagttcactccttaagacaagatactgtctcccacattttagtctcccctacataagctagaagtactttgaattgagagattacctaagtatttcttggcttgtggacttttataaattaaggctgtgttaaaacctaagagtaggaaatttgttttgtggctgatttcttctcttaaagctggaagacatttcttgactaaaatgcaattaaatgcttttaaaatttagatttttgggggtcatattttgaaaacaataagtatttggtttattgtattcctagagttgagaaaggtggtcactgagaaatgtcttgtcaaagcggattgtatgctgtgtctgggctctcagataagtgtgtgctttctttggaacctataaacataacagacacattgaatatatacttccttgtggaaattgcaacaaacttgctttctttgatgtgaaatagttacagaacatggctttagttactggactctgatggaaagtgcatccagactattttatagaagtataa

SEQ ID NO: 142184 - DNA, 905 bp, Homo sapiens
tctctgagcctcagtgttcccctcagacctctcagatcctgggccctttaccctacattttatggcccgcttccctttctgcttctttctgatcattttattttgtatttgatgttctgagttttctctaaagaacaacatatattcgttttagattaatggctttaagaaaatcatttattgttaagaatagtacagttttgtggctcagcaaaaaataattctactgttcagccataatcattttggcaagtttacagcctttttctcaagcgttggttagattaactgaacttctgaatacctttgtggtattttaaaaatctgaaatcacttgtctacaaatagtatttcttttttttttttggccttaaagttttaataatgaaatttttctatgtagtcctctttaaaatatttaagtatagtaggaagcagcagagtttgttccacctaatgtcaattcagagaacattttacattttatattaaaattatgatgccttaggatcgttcttttacctgtgtatttattcattttcacactcgggagttttagttgccactccatatcagtggcacagccatgatgatttttcccttgtccaatcatgaaggtttaaaaacacctgtacagtttttagtctcttattatgatatcaattaaggtgattttataggaagaatatcaattaagggtgattttataggaagaaaaatgtaccctgcatttcattgggaaaaaaaaaaaagaatcaactattaaatgaggaaattaaaaaaaagtttaggtttaaaaagaaacatacttaggaggattgctttgagcctgggaggctgaagtttcagtgagccgagattgcaccatcacactccagtctgggcaacagagcatgaccctgtct

SEQ ID NO: 142185 - DNA, 796 bp, Homo sapiens
taagctttctatttcaaattctcctacttagaatttctctctctcatatttcttcttaaatggtggcaccttccaaagagctgttattaattcccacatgccccctatgattcagaccacttctctctttttttctctctctctctgcactgttacttggtcttctttttattttttttcctataaattttcctcttccttctgatatgcttcacttccatgaactcccatacctcctgttctcatttctacctactctttctcctctggaccacccaaatctctcttgatagctcccttttcttatcttctatctaaaatatagtcttaacgtgacatgccacacaaacctgaaagtcatttctttttaatgtcatgccaaaaccatctcagtttatttttgtttggttttagctcaacattctaatagtacactctataaatgcatttcagcttatcaaaatcattacaaagttctgactaagaacatcttatcaatcttgtgaattagtcatatttacttcaaagcaaggaagtgttttcagttactgtctgtttcgtcatactagtgactgtaatatatcatgaaccattctgttaccatctcagcaattacaattattgctcacccttacaattattgagatgaaaccaatactcaaaagtgaaactttaatttttaaatacctcttaactccattgaaagaatgactcatgatcacaaaactgtctacaaggctgggatggcattcattattgggaatgatccttggcattacctttacaaacactttgg

SEQ ID NO: 142186 - DNA, 434 bp, Homo sapiens
ctcgcccggggccgtgtagggagcgctgccccgtcgctgcccagcagccagctggtgacctgacgcccaagatccccgcagaggctggccgataagcggtagagtcctggcttgatctgttctccttcatcctagcttcagtttccctatacgtaaattagactcaacaacgcatgatagggacacttgtggggcgcccggtacactactcttaggataaggtgatcattggtaactactctcacttccgctgttccccgccccaaataaatacacctttaagttgcatccctccatccaacccccctttcgccctcgattggaattgctcattcagctccttcagggctggcacaggggcaggaaggattggaggaacttcgtcgcttcgctccgaactcctggcgtctctcctttcaaactttgcacgtgct

SEQ ID NO: 142187 - DNA, 523 bp, Homo sapiens
agtgcccactgtacgtgttcaagtgagctgcactcatccatctttcactagggctgattcatagggcggccagaaccctatttagaaccatagcttgctgcttacataaatcaatgaaatcatatgaaacacaatataacatggtttcattgaaagagcacaggtgtcaaaaggatgtgagtttacatattacataacttaatatttatttgaacttggactcgtcacttagcctggttgaacttcaaatcctttattggtgaaatgagcatccactcataaaatttcataagcctatttcaaaggattgctaccttatataattttataaactatgaattctcatacaaaagtcagtgataccagatcacacaatttaaaatttataggcagacacttcactacttttgcttcccttcactgtgaagtaacacatgctatcaccttggtggcactcgcagggtatctgttggctggctgttttattgggcttcttcctgccactcaagtgatcatgactgag

SEQ ID NO: 142188 - DNA, 443 bp, Homo sapiens
tatagtaacgcaaggttttcttcaaatactgtaagaaagttttcagaatttcttggagaggcagcattcaaagactgtgttaaccctatacaacaagtaaataacaactaactacccaaaaatattattaaatttcatcttgattagatctttggaagaaaattttctttgattcctcccccttcctctagatctccagtcatttagttcttgttggctctttaaagtgtctgtgtatggtcagttactctgttctcactgccactgcagagccaaaattacctcatacccggactattattacagaagcttcccagccagtctcccaaccttcagtctcttaattgtcccatcaccaataaattatcagccatcatcaataagtcttacaaaaatactcctcttgctcaaaagccttcagcagctaacgaataaaatctaat

SEQ ID NO: 142189 - DNA, 422 bp, Homo sapiens
tcgagctcggtacatacatgtcgtgatgacaaagatgtggaattatgcatagggattttagatgagctatcttataaatggcccaagaagtaattatgaacactctcgaaacacactgaaaaatataaagtctcactgtgttgcaggaagtcagggaccccgaacagagggaacagctaaagccatggcagaagaacataaattgtgaagatttcatagacatttattagttccctaaattaatacttttataatttcttacacctgtctttactgcaatctctgaacataaattgtgaagatttcatggacatttatcacttccccaatcaatatttttgtgattttctatgcctgtctttaatctcttaatcccatcatcttcgtaaactgaggatgtatgtcgcctcaggaccctgtga

SEQ ID NO: 142190 - DNA, 368 bp, Homo sapiens
gccagggctctgaggggaggcgcctgaggactgcagatctccactgacctctttccctagattaagatgggacccagtggccgggcacggtggctcaggcctgtaatcccagcactttgggaggccaaggtaggcggatcacctgaggtcgggagtttgagaccagcctgaccaacatggagaaaccccgtctctactaaaaatacgaaattagccaggcgtggtggcgtatgcctgtaatcccagctgctcaggaggctgaggcaggagaatcgcttgaacccgggaggtggaggttgcggtgagccgagatcatgccattgcactccagcctgagcaacaagagcagaagtctgtctcaaaaaaaa

SEQ ID NO: 142191 - DNA, 305 bp, Homo sapiens
cccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgt

SEQ ID NO: 142192 - DNA, 226 bp, Homo sapiens
acttagtttgaaagtctcaactaaacatttatagttcagccatgaaggtacagtaagtctaagatttaaacacactcaaattcatcagcacctacctgtaatatgaaaagtaggcctgagcatgctgattggttattacagaatacagttttttattatttttgtttttaatatactgtacttcttttggcacagtctgagatagcattagttatttttgtagtac

SEQ ID NO: 142193 - DNA, 784 bp, Homo sapiens
gctgccctgaagtttcgtttttggaaataactgttatcatacattttgtatgatgttgcttgtgggcaccatgaagagagcctggctgtaaaggacagagggagctaaaccaacaatgcatggccctgcgtgcccacaagagggagccacctgcccgggatgcagcaggcctcctgccctgtcctctcagcacccctgagccctgcactcaaaccccacctccgagacagagcactccagcagggcaggcatcccaaacaggggagagaccctccactcggactagcctggggcacaccctgaggcaccagactggagattcctggtgggcccacggtttagccagagagcatgaggcagctgtgccagggaggccccaccaccaccaagtgggacacaagtgtctcctaagacacccacagggggacggcctgaggagcagggagcagaggaaacctgtcccgtgacattcctgggggctggcaggaagaccttcaggaggccacagggccaggtccacctggccccgggctgtgagccgcaatcggggcaggactcctgatgggacacgtcagaagagatcctggaaagcaccatgtgagacgccttgtggcactcaagaagaatgaagttggattctggggactctacatactcaagatcttcccagaggaatacgccacgcatggatggctctcagctgccagggagaaaggggaagtgggccgggcagggctcccctctctagctcatgtgtttctgtgaggtcacgtttctccacaag

SEQ ID NO: 142194 - DNA, 188 bp, Homo sapiens
tcagtcggtaccgacgctctctctgtggggattcactggaattattagagcaaacttttcttttcttttattattcagacaaagaccccgatcttcctccctgaacaaagtgaattcatttcctcaataattggcaaccattgatgctgcaggggacacatgagagcagaaggggcggagtggaaggg

SEQ ID NO: 142195 - DNA, 134 bp, Homo sapiens
tggtaggatcgctgaagctcaggagtttgagcccagcctaggcaacatagtaagatcctgtctctacaaaaaaattaaagaaatagccaggcacagtgatgtgcacctgtagttccagctatgcagaaggctga

SEQ ID NO: 142196 - DNA, 434 bp, Homo sapiens
ctaggccaatgtccagaagagtttttccaaggtgatcttctagaatttttatggtttcagggcttaaagcctttcatccctcttgaactgacttttgtataaggtgagagataaaaaaaacccaatttcattcttctaaaaaaggtatcagttttcccagcaccatttactaaataggatgcctttcccccaatttatgtttttgtaagcttgtttgtcaaagatcaaatacttgattacaagtatttggctttatttctggtttccctattctgttccattggtctatgtgcctacttttataccagtaccatgctgttttgctaattataaccttgtagaatatgtgatggctacatacttgttctttttgcttaggattgttttggctattttgggctcttttggttccacatgaattttagaattgtttt

SEQ ID NO: 142197 - DNA, 195 bp, Homo sapiens
caccaccctccctcctttgagtaaaatgaagggcattaggtgttttgatttttgacagctactttcagggtcctggagcctgttagcttgcttcctggcccttgcctctatgttctaggtgagtggcacctcagataattgatttttgagtaggtaaaggcactactaggcaacgtgaacccagctttccaacag

SEQ ID NO: 142198 - DNA, 490 bp, Homo sapiens
taataaccaaaataacaatagcaaggccaataatcatagaagcagctcatgtttaccgggcatttccctagagacattctcataagagcttcatgtgattctcttaggtagggactgttgttctcattagcaggtgaagaatctgtcttggagaagctgagtaggcgacagaagagcagagcagtgagggcatgggctggggagccagacacctgggttcagatctcagctccgccactttctagcctcttactctctccgcatcagttcctcgtatgcaaaatggggataatatcctgtacatcaaaggagtgttgtaaggaccaaatgagctggttccataaagcactgagaaaagagctgggctcacaccgggccagcagcagctgctcctatggtgcctggaggccatgtagctggtggaccttcagtctgagcctgagcttcccaggttgaatcagccttgtgcgctgctgagtcctgtgtacct

SEQ ID NO: 142199 - DNA, 351 bp, Homo sapiens
ggaaaagggatttttttagtgctctttcaactctactcaacaatcaatttataacaattgtcaaaatttccctgggagacaaaattccctcaggttgagaaatattgtactagacactgcctcctacttgataaccaatccatatatttatataaagttgagtatttaaaacctttatcagataaattcttttgacttcctagtgagagtattaggacaagataagaaacagtccctattgtaatggtattgctatctcctttttcttctttttttcccaaagcgccactgcgtcttcatggcaagtcataccttccctcaaattctggattccagacagcataaactcct

SEQ ID NO: 142200 - DNA, 729 bp, Homo sapiens
gtgcagtttatggtcttgttaaattgagatgcatttagtatacccaatcaaaatcccagcaaatgattttgtggatatctccagaggcaaaaaacacctaaaaaacccagaatagctaatacaacattgaaaattggaagacgacactacctgacttcaagatttactgtaaagctgcagtaatgaaggcagtacggtactggtgaaagaatagacaactaaatcaatagaacagaatggaaagtgcagaaatagacccacacagatgcagtcaactgatgcttgacaaagaagcaaaggcaatacaatagagaaaagtcttttccacaaatggtgctagaacagctgagcattgaggtgaaaaaaaaaaaatgaatcttcacccttcagaaaaattaaagtggacggaccatcgtccaaaatgtaaaagacaaaaccataaacgtcctagaagatgatctaagagaaaatctagatgaccttgggcttatcatgactttttagattcaataccaaaacaatccatgaaagaaataataagctagaattctttaaaattcagaacttctgcccagtgaaagatactgtcaagagaatgaggaaggccaggtgcagtgagtggctcatgcctataatctcagtactttgggaggctgaagtgggaggattgcttgagaccacgagtttgagaccagcctgggcaacatagtgagactgtctctacgaaaa

SEQ ID NO: 142201 - DNA, 664 bp, Homo sapiens
caataaactggtctatcgaccattttatagtgaaccattgagtaaattgggttctgtttcttagtcttaatagttcttgtatatttggataatagccctctatcaaatttgtcattggtaaatattttctagcagtcaatggcttcacccttcagaaaaattaaagtggacggaccatcgtccaaaatgtaaaagacaaaaccataaacgtcctagaagatgatctaagagaaaatctagatgaccttgggcttatcatgactttttagattcaataccaaaacaatccatgaaagaaataataagctagaattctttaaaattcagaacttctgcccagtgaaagatactgtcaagagaatgaggaaggccaggtgcagtgagtggctcatgcctataatctcagtactttgggaggctgaagtgggtcaatcacttgaggtcaggagtttaagaccagcctggccaacatggcgaaactccatctctactaaaaatacaaaaaattagggttggtggtgcatgcctgtaatcccagccattcaggaggctgaggcaggggaatcgcttgaaccccggaggtgggggttgtggtgagctgagatcgcaccactgcactctagcctgggtgactgagacttcatctcaaaataaataaataaat

SEQ ID NO: 142202 - DNA, 647 bp, Homo sapiens
ccttgtcagcacttggagctatccaatggtcgattccgcctgcctccaagggtaactccccctcttccagctgacttggatgctggaattccaagtgagctggcttcaaatgtttcaaaaacacatcatgtcttcttcctgccagttccatgcccctgtgcaaagtggccagggagggtcccttctgcacaggacatggtgctgctgcgtgtccctgcagcacagctgctgcttgggcctacgaaaatccattctcccttcccctgtgacctcatcttgactttcctcacccacactttgccccatatggtttcaatgtgaccgggcccatagcctggctccagggtgcgcacatcaccaggccttcctgtcacctttgcaacagtgatgggctcaggagctgccatctgaccaaggtggcccagtgagcatcacgcacagggcaagaggtgctgtgttttggctgtgatatgggcctgcagtaggacccatgctgagtgcctcacggagagaacctgtctaagagtgaagccaacagagttcagcagagtgatagagagatgctctggacttcacttgtgcccctggatcaagctatgcctagagcccatatggacttcagctacataaggccatagactgccttt

SEQ ID NO: 142203 - DNA, 353 bp, Homo sapiens
caaaatgaactactgctaatttgaccattgaaaacaaaattggcttgtctgttgctattatttcctataaatatactttccagtgatagttcattatttaaggctcctgtcattcttacctggcttaatctggcaactcggtaagtggatgacttcactcaacaaaagccatcttccatactgtggccagagtggactttgtagtttgtaactccgatcgtgaaattatttttacttaaaattttcttaaagttacttctagataacatgaagtcaaacttctttattgcttcccaaggcccttaatgtcctaattccttttaagcaataacctaatatctcatcactcccca

SEQ ID NO: 142204 - DNA, 332 bp, Homo sapiens
aaaaaaagcgaagatgtgctgaggtgatctacagggattaggcactgcttcggatgcctgggatggcaagtggcaccagcgctgtgagatggtttccttcctgccgtcaggcgtcaggaggcctgctcgggtctgcatgtgcctgggcttggcaggtggggaggcggcacccagggcagcccccgcattggaagctctaggaacttggatctaggctgaaggcctttgctctagagttccggattgctgagcttggaacagctcctcctagacacagtgtggcgcgggagcagctgcatgagggcccacgtactctgcacacatcagcagcc

SEQ ID NO: 142205 - DNA, 382 bp, Homo sapiens
atctacagaggacttgaggagctccttactctcatttgcctccaatgggtggaggttatacaggtttgatcaaaactgagtaaatcatttgagaactgagactactttgtccacaaagcttaactattaggattgataattgagaccatctgtgtcaacataacgtaactcattcttccaggatcttcttgcccagaaaattaagactgtaaaccaataaataacttcactgtttgttgcaggaaatgtctacacactaatttgtcctggcaagcaatttgctcacctgggaaaacagctcacttatcaaacaagggtttacttgtcaagagccacttcaatatactagtcttgctgtatccaccagtcccaagctattgtg

SEQ ID NO: 142206 - DNA, 471 bp, Homo sapiens
ttcccccagattcttaagatgccaaaacagaaaagatgctgcagtgccaaaaaaggagccttctgagtttagaaacttctcacacactctcagaagtcctggagaaactccaccctaaccccaaaatatgaatcaggccaagagttctaagtccaaattgcaacctgtttcaaaaagccagtccaaatacatgcataaattccaacagaaagacatttagttaagcaagatcaattgcaaacttcacacatatccatcttccagcttctaggggcaatgcagctcccacattcaatcttacattactgactaaaaacaaacttccctttctttctccagcaatcttagagaagatccaagaaagttgttctttatatgcttggcaagtgaaaagactgatagtaatacggtatgtgcatacgcttcagggctggcatctactcctgcaatctgtcctccacgcacagttcc

SEQ ID NO: 142207 - DNA, 354 bp, Homo sapiens
aatacaattgtctttatgataaaaaggataaactgttaagaggggcaatggatgaaacaaacctgtcaggagattatctcaaagaattctggcaggaggagtactctgaactaaggcagtattagtacagaaacaaaaagcacagattgaatcagttacttccttagatcagcagtcaggcttcatgggcattctaagcaaaattttcttaccttttttgaaaaaaaactagaagaggctccacagcattcataatatatgcaaaggggactatacaatcccccaaaaaatcaagcatcagtgaattagaatatactttaggatactgatgttacctatattacttagcctttt

SEQ ID NO: 142208 - DNA, 271 bp, Homo sapiens
ttatgatggtgatgtgaagaaggatgctcttggcagaagaaaagggcatatagcaagacatggaggggtaaaatcgaatgaggtatttgggtaatagcaaatatttgtgttagttgagcagaaaaagccagggagacagccagattgtgaagcgtctttgtgtaagatatttggcctttattttgaggacagtcagggaggcttttaaacaggtgagtcttacaaaaagatttgtgtttaggaaggtctcagtggaggttggaagggacaa

SEQ ID NO: 142209 - DNA, 370 bp, Homo sapiens
ggggaaaataatatttttgtcccatgtgtcctaaaataaaactcagtaacacatgacacttatttgattgacagatgtctaggaggtgacactttaaggtgggctgtatatatgtgttggattgactataaatgtgttgtaactgtgttgtgaaagtcaaggatggaagtaaagtttcaaaaagtgggtcatgtaactttttagtgcagggagggaagatttgcaaccacttcactactgctcacattttaagttgcttgaaggctaggttttgaggtgtgcctgcctgcatgcacatttactcctggggaaggcagccagctctcttagttttgatgaactgacaataaagatttgtagagatagattg

SEQ ID NO: 142210 - DNA, 742 bp, Homo sapiens
ggtcttcaaggaaagacaggagtcatgaccttgtggctcatttctgagattagggcagggatctgtgtctccaggcgctgggactactttgacattcaaggagcctaaatacccagttacttctagttttgcgtaattgccaaagttactttctaaaattgaaaattaaaaagcctgtttccactgctcatgattttcaggaagttgatattttggcaaaatgtagatagcaaaccaagtactgtgactcaagcagtaattgaacagaatccctaggaatagtgagttagagatcataaaagtcaagctttgttttttcaagttcgcttctcttcctatttgctgctaggtaacagaagcagccccttccataggaaagtggaacgaacctgtgttagttttctattgctgcgtaacaaataccacaaatttagcagcttaaaacaacacccatgaatgaccttacgggttctgtaggatagaagtctgggcacggatgatctgtgttctccgctccaggtcacataaggctgcaaagtattagccatgctgtggttctcatttggagatcagggtcctcttccaggctcatgcagtttgttggcagaattcagtcccttgcagttacaggactgaagtacttcttttcttgctgcctcttgccagccactgctcccagcttctacagcctgcctacagttccttgcctcaaggcctctagaggccattcataacattgatg

SEQ ID NO: 142211 - DNA, 396 bp, Homo sapiens
ccaaggatgcaagtgtcaagccaggactcacacatagcatgggcctggagcaaaaaggaggaaaccaacataagcacaccatcaaacacacagacaacaaacagctattagtacagggccaaggcatatagacaagttaggtaactgccagggcctcagtgagcacatattaccaagagccacccccaaccatgctataggagaggatttgtgggaacagaagagcaaggagaatgaggcttctgctgtgctcagagaaacctatttcatgaacctgcaggtgagcactttcagggatcccaactgatgaggtctggagagagggaaggaagaaggacagggaagaagagggtaaggtaaagaaggacactttgcatccagaggggtaccgagctc

SEQ ID NO: 142212 - DNA, 649 bp, Homo sapiens
taaataaataaataacaaaaattagccaggcatggtggcgtgcacctgtaatcccagctactcaggaggctgaggcaggagaactgcttaaacctggaaggcagaggttgcagtgagctgagattgcaccattgcactccagcctgggtgacagagcaagactccatctcaaaaagaaaataaaaagaaaaaaacaagttactttaaaatgtcttataaaatctgtttcttatagtaaaactatttgtagctaatgaaaatgaagttttgatacatttaacagtattaccactaagaatgccatcctttcaagtactctaccactggtcaaatttcagaacctcagtttaaaatttttggggaggccagatatggtggctcatgcctgtaatcccagcactttgggaggctgaggcaggtggattacttgaggtcaggagttcaagaccagcctggccaacatggtgaaacccagtctctactaaaaatagaaaaattagccaggcatggtggcgggtgcctgtaatctcagctactggggaggctgaggcaggagaatagcatgtatgctggtagaggttgcagtgagccaaaatcaagccactgcactccagcctaggcaactaagagcgagactccatctcaaaaa

SEQ ID NO: 142213 - DNA, 236 bp, Homo sapiens
agggcccgggttatagaagataagagaaagacggagaaagtcacggggagggaggggagcgattcaggcactaactcttgcatttcacctcagcaggaacgtgtcggtgtggaaggtctggttgtagactctctgcccactgtccactatcacagctcctctcattgcacatacaagacacagacacctgtcaaccagagaccgtttctctgttcacataaacatttaaagtagat

SEQ ID NO: 142214 - DNA, 186 bp, Homo sapiens
ggagtcaacgtccttccagaccaggcccagcctcaactctggctatttgccttacaggggtaccatgctggccacatcagacttaagtttccagactacaaagtgcagtttctggacaggcagagctgtttgaacctataatcccaaagctttgggaggcaagggtgggaggatcgcttgaggcta

SEQ ID NO: 142215 - DNA, 209 bp, Homo sapiens
tacttggtggtaaaatgctacccaatattataacatcatgtggcgccttcttttaaaaagtctttaaacatgatataatttcctcaaagctttatgatgtaaaatgaggtatctcagatatggacatctccagtgagaggatcccaaaggctttatacccccatattctattgtgggttgggatgcagtggagaagaaatgccaggatg

SEQ ID NO: 142216 - DNA, 136 bp, Homo sapiens
tatgtataaagggagtaaaatgttctgattgtgataacaactttctgtaaatgatatgtgcctaagtaaaatggcacttgataggcttgaaacatacatttaattctattgattaaaatatcctctttactctgtg

SEQ ID NO: 142217 - DNA, 161 bp, Homo sapiens
gatgcattctaagtgccatgatttcagagaatttacattttattatctttctcagtgagtgtaatcacagtaccatcacagcacattattttaaggaccagtttacatttatacttgcagtttttaatttttcctctttgcccttttttgaggtagggggt

SEQ ID NO: 142218 - DNA, 277 bp, Homo sapiens
attaggtttattttaaacataactatctctactagaaataaccacgttgctacacgttagaatatagatgagatttgaagagcaggcttgtgtaactttagcaataacgtaaactgcagactgctctatgaatgggagcattatggggatggatgttttgatgcaattgaaataaaaaccttgaacttttgcccctctctcaaactaagtgaagattcagttataaatctctgttttcctttctgaccttcatcataatctcctcttgcatgatcat

SEQ ID NO: 142219 - DNA, 300 bp, Homo sapiens
tgctctccatactgtctcctaatctaagcttgaccatgtggttctcaataacaatttagggaggaggggttcagatcatctagactataattattaaacggggacaaaaaattgaagaccccaacaatgatcaatttggtaactttacagaggactagcctcaccccagtcatcattaggagtttcttttcagtctgctcagtaatgtggttgaggaaaaggatccccgggcctgggttcaaagcccagctctgtcatatattagctacataatgttgggcaatttgcttaactttccat

SEQ ID NO: 142220 - DNA, 487 bp, Homo sapiens
atattgctctgaagtgtctttaaagttcagggtattataagctcttgccaagtaaggcggtgcttaataatttttttatttcatcagtattaatttagaaggaaagcgagcacattataaagaaacacatgtacaaagtcgcattactgaaatgtagtttaaggaagatgggttgtagctattgttaactcatgattaccccagctagttctctggtggctttaaggatgatgtcgaacccattcctaaggttttgcttcttggcaattcccattgccaccatggattcacttcttacctcatccaaccacccactgctgcccacacctcttctccagaaccgcctgtgtgtgtgattagagaccaggaaagcttgccttgaagacacctcatacctgaaattctagccaagcaggagtcagagggcagccccagctcaccctctccactccactgaaatggaggccagggacacttagctcccccg

SEQ ID NO: 142221 - DNA, 737 bp, Homo sapiens
acgcagcaagaaagtgccatccatgaagcagagagtgagaccccatcagacactgagtctgctgatgccttgatctgggacttcccagccttcagaactgagctgtaacactcactgtgaaggtctgtggcttcacccctgaagtcagcgagaccacgaacccactgggaggaatgaacaactccggacgtgtcacctttaagagctgtaacactcactgcgaaggtctgcggcttcactcctgaagtccagcgagaccacgaacccactggaaggaagaaactgtggacacatctgaaggaacaaactccggacacactatctttaagaactgtaacactcaccacgagggtccgcggcttcattcttgaagtcagcgagaccaagaacccacccaaaggaaccaattccggacacagggtggaggagggggtgaaggttaatgtgcaatttctagatgagaatgcctgtggcttctcttaaccacataaatgaacaagcactggcagagagacagatggcttagcttgcccagagcagccccagtgctcttagggaaggaaaagagcccccttcacttcacttcagttcctcctttccccagcagggtgagcaacccctaaagaccatcgttattttgagggcttttgtttaagtatagcacatatattagaatgtactatggtgatggcctatggtgctcttgaattgtttcataaatatttatcctgaatccc

SEQ ID NO: 142222 - DNA, 168 bp, Homo sapiens
atacctagagaagggagaaaacaattttctcccattttttttcactctcctcacttttctgcctcaaaatagacacttctccctcttagagattttagattaaacctttcagttctatttttcccccttctcactagcttgtccccacaggatgatagcaatttatat

SEQ ID NO: 142223 - DNA, 198 bp, Homo sapiens
tttccctaatgattagtgatgttgagcatcttttcatgtgcttattgggcacatggagaaatgcctactcaaatacattgcccattttaattggattacttgtctattattgagttgtaatagttctttgttctagatacaggtttcttaacagatatattatttgcaaatattttctcccattctgtgagttgtctt

SEQ ID NO: 142224 - DNA, 517 bp, Homo sapiens
atgggacagggctctgggctggcggggagaggggagctcagcttttcgcttaatgaagggagagctgaactcttgaaccgattggatgtatttttcctttgtttggccttggcctgaactggccaagaagcagtgggcggatggatgtcactgcctatttcctcccagttgtttttgcaggcctacattttagaaggctaattgttagagtcctcatttttcttccccacaagaagagggctttgttcaacaattaaatcaggctgtgtcagaggcaaagcctttccatttttgaccaaggtttggctccaaacataaaagaaattttggctctatttcatttagctgacaatgtttcctccctcagagcctgaaccgaagttttctacccaaaagaaacactggccccaccgtgacgtatcctaacatccaaataccaggaggtgagatccctggtagccaagccgagaatgaagacagccgtttagacatcttgcttctgcttccagtgaatgaa

SEQ ID NO: 142225 - DNA, 837 bp, Homo sapiens
tgtctgatggtgaatcgtgtcaccttccttctttctctttctttcgagaagagaaagaaggaaggaaggaaggcacaggaaggtagtgtaatgtagaaatgggtagcttctggggttactaatcagaaaccctgagtgctacactaattctgtgattcaattcgaatccaaagtttggttaagttaatcaaacatttagtaagaatcagcaatgagcaagatattatgtgccaaattcttatcctcaagaaactattgtttatcatccaataaacatcaagtagaggtggaattctgctgaacactcaaggaacaccgatcaagtccattattgaagcaatcgagtacttacaaaactagtaagtaggtagaggagaagagatttttgtttctgctgtatctcttaggcaatttctctaattcttgtggcatccacttcctcaacagttaagtgaatgttacactgtggagctaacagatgagacaatgtatgtgaatgtctgtaaactagtgtcacccaaatgaggatggtgatctgtgtaaattagtataaactatcccactagtctaccatcatatgtgcctaacttgtcctaaactcagctttctttaatgaaacctcattatttctaatgtgttcaaattcaatgataagttttagtaacatcttctctgtcatctttcccctagttgatgtgtgaaaatcaattgatgtgaaggtactcaatggaaaaagaataagatgatcattctttcaccagcacacagctggtgaaaaaataatggttttgtttgtttgtttgtttgtttgtttatgcacgatggtataccttcctt

SEQ ID NO: 142226 - DNA, 829 bp, Homo sapiens
tgtctgatggtgaatcgtgtcaccttccttctttctctttctttcgagaagagaaagaaggaaggaaggaaggcacaggaaggtagtgtaatgtagaaatgggtagcttctggggttactaatcagaaaccctgagtgctacactaattctgtgattcaattcgaatccaaagtttggttaagttaatcaaacatttagtaagaatcagcaatgagcaagatattatgtgccaaattcttatcctcaagaaactattgtttatcatccaataaacatcaagtagaggtggaattctgctgaacactcaaggaacaccgatcaagtccattattgaagcaatcgagtacttacaaaactagtaagtaggtagaggagaagagatttttgtttctgctgtatctcttaggcaatttctctaattcttgtggcatccacttcctcaacagttaagtgaatgttacactgtggagctaacagatgagacaatgtatgtgaatgtctgtaaactagtgtcacccaaatgaggatggtgatctgtgtaaattagtataaactatcccactagtctaccatcatatgtgcctaacttgtcctaaactcagctttctttaatgaaacctcattatttctaatgtgttcaaattcaatgataagttttagtaacatcttctctgtcatctttcccctagttgatgtgtgaaaatcaattgatgtgaaggtactcaatggaaaaagaataagatgatcattctttcaccagcacacagctggtgaaaaaataatggttttgttctgtaagaaagatcgccataggttttttcactgaat

SEQ ID NO: 142227 - DNA, 522 bp, Homo sapiens
gtcatttcagtcacgacctgctgtgtatctgtggagttgacatgttctgcatagttgagtgctcccctgctctgggaagcctgcacggggtccctgcacacatcccagcatggaggggctcagggctgggtttgagacgaaggtgggcgaaaggttcacatgaactgaggtcatgacagagtgatcaggtgggaccaggcagaactctcggcccccagggcttgctggtacacagattgctaagtgtcttcattgttaaatagaattaatcttcatatggtagttgtgggctgagttgcctcattcacttgtgataagtttagcggataagaaaatgtcctgacataatgagagcagagggcagatgggtgttggtgtgggaaaggctgagaaagccaggacttttgggtttgtaaaggtgaacgtggacacggctgtcagtgagggaatacacgcatacctcaggggtgctgaaacttagggtttgttcttgaagcctgaagttgtcctgagcttcatggt

SEQ ID NO: 142228 - DNA, 370 bp, Homo sapiens
ctcaagtagctgggattacaggtgtgcgccaccacgcctggctaattttgtatttttggtagagatggggtttcactatattggtcaggctggtcttgaactcctgacctcaagtgatgcacctgcctcgatctcccaaaatgctgggattacaggcgtgagccaccactcccagccccttcttgattcttgaaaaggacattgggtgctgtacatctcgttatagatgttgataaaaatgcttgtgagaagagtaacattaaggtagttatttggtcatttttgcagattattttaagacaattctaggactgatttgtggtaaatcacacattgctgtatcatagttgtgttcactgaacatattcag

SEQ ID NO: 142229 - DNA, 293 bp, Homo sapiens
tttagtagagatggggtttcagcatgttggccaggctggtcttgaacccctgacctcaggtgatccaccggccttagcatcccaaagtgctgggattaaggcgtgaggcaccgcgcccggccacttctaacctttttaaggagtatttgcgtgaacagaatcaatgagtttcttcaaattaacttctgacaataatctaaatggtctccattttctgattcacccttttttccaattccaagttgccattatccatgtaattggctctaaagagagcaaggaaatctatcttc

SEQ ID NO: 142230 - DNA, 295 bp, Homo sapiens
tggtgttttggaggaaatttcatcttgggctgctccccttcttaccacatctgttgcccagtatccaccacaaagcctgtaacttagcatctgcctataacaccaaacaggttgcatcagataaacaaaaattcttactgtggtaggtgaatattttagcaaacgtaaaatactataactcgaatttacaaactgggtcagaagtgctttctcatgttttggtgtctggagcaacgtgcacatggtcagaggacttcttatttcaattttcttgtttgtttatatttattttatg

SEQ ID NO: 142231 - DNA, 221 bp, Homo sapiens
gaaagatgaaaataacatgtccttctctaatctgtagctgttaagaaagaaatataatcctacatcattaattcacaaataatacaatgcagtttaataataataatgagaccacattattgagaatttcatgagaatatgaatgatatctcctagaatgcctgattctactttgtattaatatcaatctctctgtattattgctatatatggtgaatcat

SEQ ID NO: 142232 - DNA, 301 bp, Homo sapiens
atggaaagaatctacccacgcggaggcatcctaaaatcccagcacttttcatgggagggaagcacatccctttaagtcccgctccctcacagggccttgtacctctagagggcctaccaagatttagtcttttttttttgttatgagccagggtcttgctctgtcacccaggctagagtgcagtggcgcaatcatagctcactgcagccttgaactcctgggctcaagcaatcctcctgcctcagcctcctgagtagctgggactacaggcatgtgccaccatgccttggtaaagatgagg

SEQ ID NO: 142233 - DNA, 401 bp, Homo sapiens
tacggatgtttcctaaaaaagtgacagttaagctagatccaaagagataaaattagctaggaatggcaaggggagtataacggtgatccagagagagggaagaacatatatgaaggagtaaggagacacagtacatattgagaatataggggacaggtggtttcagctcaggatgaggctagagatgtaggcagaaagtacacaaaagatggccttatagaaaatgtttaaaaactgtggattttattcaagggcactgggaagccactgaaaagttattattagaaagctgatggccgggcgcggtggctcatgcctgtaatcccagcactttgggaggccgaggtgggcggatcatctgaggtcaggagttcgagacctgcccgaccaacatggcgaaa

SEQ ID NO: 142234 - DNA, 815 bp, Homo sapiens
tggtgtctcctagcctcccttcagctgaggtttcatggtgggagacaggagtgtggctggggtggagggttgagcctggccctgtgacccttgcgtgctatagttccagctccaggccagtggttctgagcagccatggtcagaagcaagtaagttggattcagggcctggcctgagggagctgtgccccggtgcttttaaggctgccgttttctcagacagcctgtgtcctgatgccaggagaagcagcagtggttttagtcagatccctggagcaaggatgtggaagacgtagaggacttggggtgtaggaaagctgggattgtccggagggacatggccgagttgggccagtgtccgaggcgggttcagcagcccctggggctggctctccctccatttgtgcctggggctgtcttccgtagccacctggctccccatttgtccaccttaccgtggtcttatctttctcataccctccctgggtggctccacaggcacggcttggtggctgctttctcttgcttgggtttggtgagggctaagcacgcaaagcccagggaagcttttttggggtctgggtctccttcaagggtcagtcctgtgcgtcagctttgcagccaccttggtcagccctaaggccgagcccaccgcctgcaaggtgcagccgtcctcactcccctcatctctctctctcctctcccctctgcatttctctcttctccagaccagctcctccactgtggctctgagtgccccggggctgtccagctctgctccgtcctcatactgctcccttcctccttctcctcctc

SEQ ID NO: 142235 - DNA, 537 bp, Homo sapiens
cctatcaaaaataataactacaacaacaacttttccaaacatagacagtatgataagatataaatagaaacaacaaaaattctaaaagcaggggaatgaagttgaagggttgagttttttttcattttctctttgcttgtttgtttatgcattcagtgttattggtttaaaataattggttataagaaattatttgaaagactcacagtaacctcaaataaagaaatacaacagatataaaaaaataaaaagcaagaaattgaaatatgtcaccatagaaaatcaccttcactaaaaggaagacaagaaggaaggaaagaaggagtagaagatcacaaaacaaccagaaaacaaataacaaaatggcaagagtaaatctttagttatcaataataacattaaatgtaaatggattaaactctccaattaaaagacatagagtggctgtatggattttgttttaagaaagacttaataatctgttgcttacaagaaacatccttcacctataaggacatgcatagactaaaaacaaaa

SEQ ID NO: 142236 - DNA, 259 bp, Homo sapiens
ggatttgctggtgcagtacaactaggcttaatagggactcgaattcgagctcgaattcgagttcaatttttcattttcatacagatacccaacgatcttgttaaaatgcatatcctgaccccggagggctgcggcctgagattctgcatttctaacacactcccaggtgacgtcaccatgctggttcatggaccatattcgagtagcaagggtataaatgacatgattacacttccaaataacacaaaaagaccaagaa

SEQ ID NO: 142237 - DNA, 910 bp, Homo sapiens
ggccaaggaactccagttaaacttcactgccagttaaagtctggtagattttaatcagagaatgaaacagttttaaactcaaaatgaaatgtcttgttataactgtgtgggttcctgtcctgtagcgttcttagaagtcaatttgggccaggtccagagagtgcagtttgtatgtaatagtctcaacactgcatgcacgtcgtgcacttcccacgcactttacaaagtactctgtccagaatctcacatggacctcggaacaaccgagacctcttccagccagattggaggcacccagagtagggtctgggatgatacaggctcttgctcaggactctgggaaccctttaagggcctgcttgaactcagaagttggtggctcagccagcagtctctgtccctattctgtgtcagcgttgatatcacacacttgtgatgtgactcgtttttctctttttcccctgactggtttttggtttttactctcccattgtgatttatcccaattacatggaaggaatttagctaaattaaaattaaatttgcagtcatggagcacgaattaattttctttctttctttctttttttttttttttttttggagacggggtctcactctgttgcccaggctggagtacagtgggtacgatctcggctcactgcaacctccgcctcccgggtttaagctattctcctccttcagcctcccgagcagcggggactacgggcacacgccaccacacccagctttggtattcttagtacgagatggggttcccccatgttggccaggctggtctcaaactcctaacctgaagtgatcgaccacctcgggctcccaaagtgttgggattacaggcgtgagccaccacgcctggcctcttttattgttttgcttacccaactcc

SEQ ID NO: 142238 - DNA, 175 bp, Homo sapiens
gagaatcacttgagtctgggagttagggagctgtagtactctatgatcgtgccaatggatgggcactacactccagcccgcacaacataacaaaattcacacccacctttttttttgagagtctcgctctgtcacccaggatggagtgcaatggcacaatctcggctcactgcaa

SEQ ID NO: 142239 - DNA, 591 bp, Homo sapiens
gatatttgccagtgtttttctaagattgtttctcgtcaaaattattttgtatttttcggttatctttttagtgtgattctgctgactttgtgaaattaatttggaatattttcttttttatgttatctgctttattttttccttggaggttttaaagaaaatgtatgtttttcagaggtaggacctagaaaactttgtcagtttcttttgtgattattagttttatggtttctatccctttttggatatttcttagggaaatgattcattcctccattttctttttcacagttcctagcatagctgtgaaagtggatttggacgggctactggactgtggccatttggaccctgattttctaggctgtaattctttgatgatgtgtaaattttattccatggcacttggtcctttttttttgttttttcacaacttgagtcaattttggccactcataaaatgatcgaatttgtctgaggatggtgtctcatgcctgtaatcccagcactttggaaggttgagatggaaggatcacctacgcccaggagtttcagactagcctgggcaatatagcgagaccttgtctctac

SEQ ID NO: 142240 - DNA, 242 bp, Homo sapiens
aacagaaatcattataatgaatgaagtcatcaaaacaaaatcactgggtatactttagtaaagtgaggtaaaattagcataaattacaatatacttttgtgaacagaaaataccatttcccatttgtgtgactgcagcttacttattttgaccctttagattaaaaaacaaaagataccacagctttatttagaataaaaaaccttccaaaatatgaacattaggaaaagcctttcagtata

SEQ ID NO: 142241 - DNA, 235 bp, Homo sapiens
agtataaagagggcatgaggtagcttggctagagactgatctcctcctgctgagtccccccatcagactgtgcttcctctgcagcgagtgtctgcagggtctggatgcgggaaaggaattctgatctgttgaaatttgtctcctctgtgtgtgtcctgcactaaatgcccaaaccccagcatgggacgtaatgcagagagggacacaggcgatgtggggacctgagcaagccagg

SEQ ID NO: 142242 - DNA, 625 bp, Homo sapiens
tcggattgttgctgtctgtgtggaaagaagtagacataggagactacattttgttctgtactaagaaaaattcttctgccttgggatgctgttaatctataaccttacccccagccccgtgctctctgaaacatgtgctgtgtccactcagggttaaatggattaagggtggtgcaagatgtgctttgttaaacagatgcttgaaggcaaaaaaaagtaacttcaacattacttattgaagttacagaacttacagaacaaatatactcttttcaataaattaccataattaaatcaatttagaaaaagcatttctaaaattcaacacccactcataaaaactcatagcaaacttggaatataaggaaatttccttaatctgataaaagcaaatacaaaaattactcacagtaaataccacacttaatggtaaatgtttaaaagttgacccctgatgcccactaccagcacttgaactggccagtatcaaaagcaagaaaaagaaagaaacagcatacggactggaaaggagaaaataaaggcaatcttgaggaaccacaactaaaactacaccaccatgtaccaggtaccaagataacacaaagtcataatgatttagacagtg

SEQ ID NO: 142243 - DNA, 121 bp, Homo sapiens
ggagcttggtgccagtcccagctctgccccctgccaagacacagccccaggatttcactccaccatctcaaagggccactccctcccatagtgttggtacataactgttatcagctcttag

SEQ ID NO: 142244 - DNA, 674 bp, Homo sapiens
gactttctaagccgttttatgtttttcttagttttatggttttcttaggcatattcctcctgctctccctaagactagattgatctgaacatagacataacagaataaacagaatttggaaggaaatgattaatttaccagcaaacacctcatgcaaattaaaaggaatggtaccatatatgataaaataaaatctgaagcatcttaaagatcacttgggctgggtgcggtggctcacacctgtaatcccagcactttgggaggccaaggcaggcggatttcttgaggccaggagttcaagagtagcctggccaacatggcaaagccccatctttactaaaaataaaattttaaaaatatcacttgtttctgctcttacaaaaacaaacaacagaactattctggcccacatactgaatatctgggtctagtttacgtctttggaagttgtgtggcatgctttatttcagcaaagatttttttttggggggggtgtggggtttgacataaaggattatagatgggtgataaggctactttgtagttttttgagagtctaggtcacttagcacaaaattctatagaagctaaattaggtgactttagtaagaatagtcagggcaaggccaggcacggcggctcacacctgtaatcccagcactttgagtggctga

SEQ ID NO: 142245 - DNA, 304 bp, Homo sapiens
aatcaaatgagaacaaaaagatgtggattttaacctaaaacctttttccaagtgataaccctgccagaagcacatcaatacttcataactgcaaccctagacccgtaaaagaaataaattccagatgagatacaggcagccaaggggcaactctgaagcaaccaacaagaaagcctcttctcctacttgcttctcagctttttaatcccaatgtttgaaagattagcaggctactgatacagaagctgctgagggaaaaaaacatcagaaagactcagtcctagatccaagataaagaaggcat

SEQ ID NO: 142246 - DNA, 277 bp, Homo sapiens
ctcagaacccaggtcgccctgactgtggccttggtaaagtctggaaacagtcctcagcctctgatatgccagatatccccagggctgctggttccgatgtagggacctgcccagggtctgcacgctcggcccggtccatcctaccacggccgccccctgaggggcccagggcagcatctcccagccccaggggcaccccaacctgctgtgtctggggaagtggaaggcccggatcctcgcagtatgggggcggagctgcccctaccaccaagtcccc

SEQ ID NO: 142247 - DNA, 486 bp, Homo sapiens
ggttttgctgttgagttgtttgagttcctcgtatgttctggatattagttcctcatcagatgaatgaaactagatccctatctcatcatatacaaaaatcaacttaaagtagattaaagacttaagcataagaccctaaactataaaactactagaagaaaacataggggaaatgtttcaggacatgaacctgggcgaagactttatggcaaagacttcaaagcacaggcaacagaaaagaaagtagacaaatgggactgtattaaactaaaagcttctgcacagcaaaggaaacaacacagtgaagagacaacttgcacaatgggagaaaatatttgcaaactcctacttaaactaaagaacctctgattttatctgatatatacattggccttctgaatatgttttgcttgttatatatacatattccatatataaatatatatatttgcatgtgtgtgtatgtatactatggctaaaaagaag

SEQ ID NO: 142248 - DNA, 238 bp, Homo sapiens
tcacaaaaacactaagtggaaaaactaatgattggcagggctagcatgcaaatactggtttgcctggttacaaagcccatgctttttctattacccgaatttgtcatataagtaatgtgagcttgattcaaaattttcaatcaacagaatttaatagaagagttgacaatataagtgctagcaaaattcaagacaacatattattttctgaatcctaagccctgaccacatgacatag

SEQ ID NO: 142249 - DNA, 280 bp, Homo sapiens
tctactgataaaagcatttcatttaggtggtctttaattgctctgtatgtatgtggcaaaatataaagggaatgtattttttggatggggccaatacaaaatcttccatcagaacaaatcctcaaaatgtttgaattttagaatggatcatgacctaggtgaaataaaacaatcttctgttacactctcttgacagccaaaatcctgatttggtggaagtggccctatgcccagattaaaaagccacagtctcagacttctttgtagttagagatgggca

SEQ ID NO: 142250 - DNA, 391 bp, Homo sapiens
ctcttgttagcttctcatcccggtctcctgtcctggtccctcaggcaggtattactcgctactctagcaccctttaaagctatctgctctccacaagtgacctcttattctgactgttctacatgctcctgccccatcaagatgccattttcaaagtgcaggaaaacattccatttgtgtcaaagagataacgctttacaattacaagctattatacagatggctttgaaagcacttatatgcacagcactgtttttatgaagtgggcagggcaagcttcatccccattttatagatgaggcaaaacagactcagaaagtaagtgaaaatgttcagtgaggggtgagtcaagcctcccacccaatttgactttcaaaggatattagctttt

SEQ ID NO: 142251 - DNA, 287 bp, Homo sapiens
gcggccgcctactactactactgctcgaattcaagcttctaacgatgtacggggacatgcctgtagtcccaactagaccggtggctgaggcaaaaggattgcctgagccctggaggtaaggctgcagtgagccactgcaccccagcctgggcgacagtgagaccctgtctcaaacaaaaaaaaaaaaaggaaaggaaaaaaaattttttttgtttaaaatatacatatttgcttaggaaaatatttgggaggaaatacatggaaatattaatgttcattctctcaga

SEQ ID NO: 142252 - DNA, 279 bp, Homo sapiens
agcaatagccaacacaggccctggcgcatggctgcagctctgtaggtatttgctgagtaagtcttgggggaaatggtgtgaataagccagacatgatcctgatgagccaaacaggacctgcccggggccatgacagcagggcaggctgggtcttggcaggggagcagagagccttctagccagggcatccgaggcagattgaaccagtgctcacagggatgggcaggaagtagacttgagggatagagagcttagggaaatgagaggtcccagtacaca

SEQ ID NO: 142253 - DNA, 111 bp, Homo sapiens
accaagtgaatgaatatcctggctatgtgtatacaatcaaaattagaaaggcttcaactcattattgggagactgttgcaacactccaagagggagttattaataataaag

SEQ ID NO: 142254 - DNA, 142 bp, Homo sapiens
gcctctgattcctcatgtgaagatgagaacagtaagagtatctatttcctagggatggcgtaagaatgaatagagttaagatctataaagtacttcgaataatgtctggtatacaataacgcaccaataaacattagctctt

SEQ ID NO: 142255 - DNA, 646 bp, Homo sapiens
cgctgccattgtagtgcagaagcagccgtagacaatatgtaaacgaatgcgcatgattgtgttcagtaaagctttgtttacaaaaacaggcagtgagctggatttggcccctgcgctgtagtttgctgacctaactagaaggtaggttaaggtgagttacctggaatgcatcacagagagcgaaatgaaagatacaaaagagaaaaaatcctgtaggagaaaatccaacacacatttaatcagagtcccagaaggagaagagagaaagacagaaccttccaaaactaatcgataatagtaatccacagattcagaagcccaacaagtgccaaacgagaatgcataaaaggaaactgattctaagacctgtcctagtgatactgaagaacaccaaagatgaaatattaaaagcaactagagaaaaaagacagattatcttctagggtgccataggcagactgacagcagacttttcagcaatgaccatgaaagccagaactggccacctagcatttctaaatccagcaaaaaaatatctataaagaatgaagagaaatcaagactttttttcagataagcaaatactgaaataatttatgtctagcagacctgactccagtctgggcgacagagcaagactccatct

SEQ ID NO: 142256 - DNA, 765 bp, Homo sapiens
gaatagctgttttttatttactgcccagccaactctttctttaggtttggctaaccggcttttataactcaccaataaactgttaatttttattagtgtacttttaatctccataagttgtatttagttctttgtcacatctgcctagccgtttttaatttatttttgttaattcgtaatttggatatgctgtttttatttttaaaagcatgttaaagtgatggatacatgaacttacataagtaataaaaacacccacaaacaagtatgagtgaaactggggatatctgaacaagattgatggattggatcaatgtcagtatcctggttgtgatactgtattatagtttttcaagatatcatcattgaaggaaaccaggtaaaatgtatacaagattactctgtaatatttcttacaatgggaatctacagtttatttcaaaagaaaaaatttaattaaaaacattaggcatttaaaaatattttacatcagctactctgatatttgatattactgcttgctcttcctcacagtgttttgtttcttcatgggtgctttatgatttttgattgtgagtccatgttccttaaaactttatctgttcaatttctttccagcctgagttaaatctatgctgtgttacttctgacaattgcctagggcactaccaacataaaaccactttaaaatatattattggcatgaatttttttataccataccatcttatgaatttgcggtgcaaatctgtgatatttggctgg

SEQ ID NO: 142257 - DNA, 406 bp, Homo sapiens
taggggaaagttcagagttagcctgttgtcagcactacctgctttacgagaacaataatctatttgcattttaatatatacatactgataagtgtagctagggactcactgtggccttggactttccaagaaatgagtcaagtcttcatgttcacttgaattccctattcttgatttcctattttgatgttcccaaagctggcacttcttttactcagtataatttagtatcctactcactgattgccaacatatccattggaaattccatttctttcttaactcaaaggcttttttttttccatgtgacacatatcctgtttttcccaatatcctgggtaactcccaatgattggaaattaggtatgctgttccccatacctacaatcaattcaacatctcacaa

SEQ ID NO: 142258 - DNA, 315 bp, Homo sapiens
tgctgtctcccaaaacacacagaaaagtaaaagatgcacaattttcttgttgttttgttatttttgtattcatatatgttacacatacagacttcagacattattagccatataaattcctaaacagccatcaaaaaacgtcaaggccaatactcctgagagctccaggagactgtagtctcccaggggtatacttaactataaagataagattatggtaatgtattaacatgtcagcacgactaggcacttgaaagtgacaacataggaaaaatgaatgaggtgctggcatggtaccagtggagggagcagcag

SEQ ID NO: 142259 - DNA, 240 bp, Homo sapiens
ccccagcttcccaagccttcctcttttccagatataccatattcctggttgccacaggaaatggggtccagattgctttgctacaagtgttcctcctttgcacacactacactctagatatgcgtcattgaaaatttggtgcccagaattgaatataatactttatatatgatctggccaatctaatttaaggtcaatcacatcattacatttcttctttttcttttcgtttcttttttt

SEQ ID NO: 142260 - DNA, 476 bp, Homo sapiens
accagaagcactggttacttcccccgtcctctcagctctgggaagggtggggtggtcatgaagtcctgagagagcagagggacacaccaacttctcttgttggttccctcaaccctgcccatacctatgggtaatcagagatggattcagtctccagttaggatcctcatcaaggtatttgtatgggggattccatgcagatggtgtatagagagaagatagacacaaggtgagttgactattatgagaaggtcagctcacaggtcagtagacttcctgatgaaggacagaacaccattgcatgaagtaactgggactcaaagcttccttcttcccacttgaccaggatataagagctttggtccacaaggacaggttcaggaatcagatccaaagaaagaaagacaacttcatgtatcagagtgaagtggagatgtccttatgagaaatgacattgttagaagttatcagggaag

SEQ ID NO: 142261 - DNA, 313 bp, Homo sapiens
tcctaatcattctttctaacaaggaaaatgcagacctcagactcagctcccagcagacaactgtatctggctagaacttactaaagttttgttttcgttgcacttatttattgtttattttctattttgggacggagtcttgctctgtcacccaggctggagtgcagtggcgtgatctcagctcactgcaacctccaccttccgggttcaagcgattctcctgcctcagcctcccaagtagctgggattacaggcgcccaccaccatgcccagctaaattttttttgtatttttagtagagacagggtttcac

SEQ ID NO: 142262 - DNA, 266 bp, Homo sapiens
tgggggtggagagaacaagacacaatcaactgggggccaccgagctggtgctcatgagataatgtgacattattcattcataagcaacaagtcattcattctctctcttttttatgtgtcttttaaaaacagctgattgaagtacaattaactgcacatatttaaagtgtacaattgacatgcatatacatttgtaaaaccatccctgtaatcaggagaataacgtctccatcactccaagagtttccttgtgccccttgatagtc

SEQ ID NO: 142263 - DNA, 481 bp, Homo sapiens
cagaaagaaattggagtaaaagaagtatattagtttcctatggctgttgtaacaaatttctacaaactcagtggcttaaagcaatacaaatctattctcttacttttgtggaggtcagaattctgaaattaaaatatcagtagggccctgttccttctggaggctttaggcaagcatatacttccttgccttttcaggttctagaagctgttacattcattggcttgcagccccttcctcacatcactataatctctcttttcatcatcacatctactgctaactctgatcttcttgtttccctcttataacgatcctaacaattacacttggttcatctgaaagaatcagggtaatcttcccatctaaagattcttaacttaatcacacctcctaagtaaggcaagatattcacacgttctggagattacgacatggacatctctgggatgcaattatctagcctatcactggggaaaaa

SEQ ID NO: 142264 - DNA, 304 bp, Homo sapiens
ctctgcctcccaggttcaagcgattctcctgcctcagcttcccaaatagttaggactacaggtgcataccacaacacccagctaatttttgtattttttgtagcttcttccctggccaagaagcttttttttttttcttgacacggagtcttgctctgtcgcccaggctggagtgcagtggcgtgatctcggttcactgcaaccttcgcctcccaggttcatgccattctcctgcctcagcctcccaagtagctgggactacaggcacctatcaccacgcccagctaatttcttctatttttag

SEQ ID NO: 142265 - DNA, 360 bp, Homo sapiens
atgagaaagtttgagaggtctgctgtataacattgtgcttatagttaatcatactgtgcacttaaaaatttgttaaggccgggcgcggtggctcacgcctgtaatcccagcactttgggaggccgaggcgggcggatcacgaggtcaggagattgagaccatcctggctaacatgatgaaaccccgtctctactaaaaaaatacaaaaaagttagctgggcatggtggcgggtgcctgtagtcccagctactcgggaggctgaggcaggagaatggcgtgaacccgggaggcagagcctgcagtgagccgagatcatgctactgccctccagcctgggtgacagagcgagactccatctc

SEQ ID NO: 142266 - DNA, 226 bp, Homo sapiens
gttgcgaggaatgctgaggacactctcctacattaacaccgtactatgaccacacattaatactgtactactaccttacattcactctgtattcaaaatccctaatagtcatctctaacgtctcccgtctttcatccccatcaccaagtcctggtgattttatctcccgtctctctcaaatctactctccatccacaccatcctgccagcattcctagtccaaggt

SEQ ID NO: 142267 - DNA, 148 bp, Homo sapiens
acacatatttaggtagtttcccctttctctgccattacaaacaatgctaaatgatcatttttatgcacatctctttgtaccaatgagtgagagttcttctagaatagacagctagaagtggaactactgcagaggatgaacattttca

SEQ ID NO: 142268 - DNA, 111 bp, Homo sapiens
gccgggaagagtccctgtctgaggagcagccgggctctttagctcaccagggactcatgatgtccccagctctggacgagctgtggggaagctacataccacccagacaag

SEQ ID NO: 142269 - DNA, 205 bp, Homo sapiens
ttttgtatttttagtagagacggagtttcaccatgttagccaggatgctctggatctcctgacctcgtgatccacccacctcggcctcccaaactgctgggattacaggcatgagacaccacgccccgccgagtccctgcttttaattctttggggcagggatccccaaccccctggtgatggaccaatactggcctgcggcccc

SEQ ID NO: 142270 - DNA, 109 bp, Homo sapiens
aaagctaattactaaatgcatttaaaataactaagtcacttcactgttgtatacttctctggggttgaatttcccaggattcacctacgaattatgtattgtatactag

SEQ ID NO: 142271 - DNA, 416 bp, Homo sapiens
tctagcctcccaacctcagacacccccaaagttaggaggactctgtggcactgaagctcagatctccaaactaccccttttgtccccaaacttcagtcaccctacactaagcaccccataggctgttacccccagaagtaggcaagtcaagaacccccaaatcaggtatgtgcagctgaccctcaaggtcagtcttcctaatccaaacaccaagaagctcataatcagagagacctgaacttgggatttagagtacctgcctcaaacaccctcatagcaggttggatggtggccccccaaaaaggtatgtccacatcctaaccccagaacctgctaatgtgaccttacaggaagagtctattcagatgcaattaaatgaaggatcttgagatgggattatcctgagttgctggggt

SEQ ID NO: 142272 - DNA, 598 bp, Homo sapiens
ggcctcactgtgttgcccaggctggactcagacccctaggctcaagtgatccttccaccttggcctcccaaagtgctgggattacaggtgtgagcacctggcttctgagggctttttaaatgtaatgtttgctgctagatctttaattgttcctcacttaatgctatcttaatatgttgtatttttatttatattactatatacagtaaccaagttaattcttacacttaatttttttatacttaggttgaaatgaagtttatcttcagtctagccagattttaagaggataatattaatgacattaccagtgtaaaaaaggttacaagggactataaataattgaatcaatgatttcaagagttttagagtatcagtaagcaagtccgtcctgctgattgcagttatctgtttgttaaattgggtctcataggactaatacaatattaaagatgatttttgagtatgtactcaatttatgagtatataatttctgtgaaaaattgcatttatcactgaagaagacaaaagcagtagatacagatcctgtatggcaaaagacaggaaaaaggggaaacagataaaaagcagaaaaatg

SEQ ID NO: 142273 - DNA, 286 bp, Homo sapiens
tcgttgaactggaaggtggaggtttcagtgagcgcatcgtgccactgcactccggctgggtgacagagcaaatctccatctcaaaacacgcgcgcacacacacacacacacatctttcagcctggcagaaaagataagtgacttacccaaagccagtgcagttcagaaagagctaagcagtaattcaaacacctgtaatcccagctactcaggcagctaaggcacgagaatcatttgaacctggaaggtagaggttgcagtaaaccgaggtcacgtcactgcactc

SEQ ID NO: 142274 - DNA, 171 bp, Homo sapiens
acctgcacgttgtacacatgtaccctagaacttaaagtataataaaaaaaaactattaatgtttttagcctactttttgatggaattttgtttttcttatttgatttccttgtagattctaggtattagtcctttatcggatgcagagattataaagatttctcccactct

SEQ ID NO: 142275 - DNA, 519 bp, Homo sapiens
ggcagaaaaatgccagctgatgatgtcttgcttaccttggttacaccagctctgggccccacctgcctggcctgatttgaaggcagactgcctggctactctgggactgccctggaaaacagccactctcacacctcttacagggaggaaaacagccagcgggagagagtcagccctgagctggggggaaaggaaggctggccctctgcttttggtgtcaggattactatttaatgcagtagtcctctattttccttcttcccccaaataaagtgttagtatatgtaattttcaaaagacattttaaaagagcctttccccacacctcaaaaaatttgatgtggaaaggcagattggcggttacacccctaatttttcctacccctttaaaaaatgaaattatatatatttccttccctttccctttccttcatttccttctttcttttctcgtttccttcctttccccccgtcctttcttacagtctcactctcacccctcgaacttctggcctcaag

SEQ ID NO: 142276 - DNA, 915 bp, Homo sapiens
attatttgctagctgtgttgcttaactttaactccttcttggcccacctctgcaaataaaaattaagtataattatactgatctcagaggtgtcttgatagaataaaacaggatgtttagctgaagcatactactcttgagaaagtaaaaggaaaaataattatctactagaaattattaacactcaagtgcagttttagaagaaacagacaaaataaccttagtgtttgtcagaatgtttggttctggagaccaaaagtcataatccctttttaacctttaaatagtctggagtcactgtgagttgcctaccccagagctccaccagccatctttttccttctagtagacactgagtcacacaattgagattaaagatattatttacttgcttttccattctctcttgcaactagtgatggtcatatgataactgctggccaatgagacatacaggtagattttctgggtgactgccatggaggactttttctcccttaaaaaaaaaagcttaaaaaagacattcaaggagagtcttctcaactgcctgactctcttcttgtaattgcatgtggtaaacctgagacttcagaaatcgccttttgaccacagagtgataagcccaaggatagaagctgcatgttgaggacagaagtgaaatgatggaaaaagccgcgtagacatagccacatgcctgaactaccctagaaccacttttttctagattttaagaaaatgaaaccggaccagacacagtggctcacgcctgtaatcccagcactttgggaggccgaggtgggaggatcacaaggtcaggagactgagaccatccaggctaacatggcgaaaccctgtctctactaaaaatacaaaagattagccggtcgtggtggtgggcacctgtagtcccaacta

SEQ ID NO: 142277 - DNA, 751 bp, Homo sapiens
atcaaacttcaggtttcattcaaaagtaatacctgtatatatttgtagtgcataataaaaaatcatattgccttgattttgtatgccatttgtagcttgcaaaatgcttttacatacattatttcacagaagataaattattgggattggcaaaataagttcttattcagactttttatgtcagttttattagcttttattttcaaatattggctaatagcttataaaaatatattttaatttctttagaatatattgttttataagttttttaataaatcataaattgccttttaaaatttattgaatctgtattcttactttattcctttgttcctcaaggatttcagtcttttaacaatattagtccactccctaaagtagtcactgttccagaacatagttcttgggtttgagactaatcagactacttaaaaacttgtgtcggattacagaggaattgcaagaaagtgtaagaatttctaccccacttaaattcagctgtgagaaaatgctggctattgtgccactatcagcaactactcaagtgcatttaattaattaattaagtccactattcagtcagttcaactcacacttcttgactagacatagatatcactaaattgactgtttagaattcttgattcagtaatcctaatggtttcatagatacacaagcaataggaaaatgtgtttattcttttttgaccatgtattcattctcaaaacaaaaatggtagtgtggaaa

SEQ ID NO: 142278 - DNA, 304 bp, Homo sapiens
gaattcgggaccaacctggccaacatgtgaaaccccatctccactaaaaaatccaaaaattagccaggcatggtggtgcgtgcctgtaatcccagctattcaggagactgaggcaggagaatcgctggaccttggggaggcggaggttgcagtgagctgagatcgcacactaccgtactccagcctgggtgacaaagaaaaactccgtctcaaaaaataataataataaaaaagtatagtgtgcctggatgcagttttgtttttatttatcctgcttggggatcataaagctttatcagttttg

SEQ ID NO: 142279 - DNA, 246 bp, Homo sapiens
agaaatgagtaccaaaaaatgaggcatgagatggaggcaattatatggaacaagatattcattacgcttgtttagccataggaagccacagtggcaggaaatatggactggggtgttattttggctgaaaacaaggggtagccaagttaaaacactccttaataagcaccacctgagaacccagcatccctgatccacagacaagaagcctcctctcctccccagcaatgcctcttcccagctact

SEQ ID NO: 142280 - DNA, 262 bp, Homo sapiens
caagatgaatacattttaacagatgaaaatagaggtagagatggcagtattttcaataaaggaaccagctctctttcattcatttgaaaacaaattgttaagcatctaccctgcctgaggtaaaaagtggctaaaataaataaacatgctttctgaattccagaaactttcttttccttttttttttttttttttaaattttactttaagctccaggatgcacgtgcagaatgtgcaggtttgttacataggtatacctgtg

SEQ ID NO: 142281 - DNA, 167 bp, Homo sapiens
atcaatattgttgtctgctaaataggctctgtgatcccagagtagtatgattaggtggttaggagcccaaattccttatccctaaaaccaagggaatgtttgccagtgccatggtctcccttagaaaacatacagctgaggctgtgtcaccctcaaaacccctagaa

SEQ ID NO: 142282 - DNA, 785 bp, Homo sapiens
ttctagtttaccaggcgtttagagcacgggaggctgttgatcctggtctggaatgtaaattgcaaatgctcccccatctgtctgcttttctgctcattctttcggggcttccttctttctctgccacgtgttcttgcagtgccgagctctgatcacaagggtcacctctcttcctgctttcctcggcagccacattcccttgtgcagtcttggccacacccatgtgccggggctgcctcagttggaatccatgccatctggggcctgctcgcccctgcagcagcctgagccgcaggctctgtgcgtctgccctgtgctctcagcctcggtccctgcactcgtccttgacccagtgtctgagcagagcccccctcccagcacggacgctgagttttgggaacctcgcggcccaggcagagcgcgtccttgtggtgctgtgcacaccccgcccaccctccgtccaccctgcgcatgcagtgcctgtggtgtcctgaggccttggtggggccgtcctagtccctggtgcagacgaggagcctgagaggcttagcagctcatgtgtgtgtcagctgggaacccacagcaagtggattccaaagcctgccatgtccctgttgccactagcacctcctcctccactccctcctggcctctctgggtcctctccttgtccctcctggcctctctgggtcctctccttgtccctccctgacctctctgggtcctctccttgtccctctctggcctctctgggtcctctccttgtccctctctggcctctctgg

SEQ ID NO: 142283 - DNA, 268 bp, Homo sapiens
tgcttccccttccttcatatccggacctttcatagaccagatagatgcaatccatccacaagacaccatatcccggacaatgcagggctgtcggtgggagagctcttactgcatccaggccctcattcatctgtgcagagaggagttaggagagcacagacactgcctttcaaagacagagctacttcaatcccattttattcttgatcgtgaccagggatggtgcctcctgactttctcctgtgtctttatgtctctggaagagaat

SEQ ID NO: 142284 - DNA, 5162 bp, Homo sapiens
  misc_feature (3287)..(3288): n is a, c, g, or t
ctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttcaggagagtaaaaattcatataaagtgcaattgcacaaatacaagccaagctagaaggaagcacctatgaaagcaacaactttgtttctcatccatagtagtattgattttgatgctagatagttttgctaggtataaaaaataagtaaagttccacttagagaacaaagggccaaatagagtttttatatttgttatgataaaaggaagtagatgtgaaaaagcctaagaaaaaggaaattggacagttttgatacaaactttgtttgctaatgcactgatgagtctagtttcattatagcacgaagctatgagaataacttcagtcactcccttgaatggtgcaatgaattaaccagctgatttttcttagtgtgatgattaaccccttctttcatgttctgagctataacatttgctgaatatgcaatttgttattcttttattaatggcatgtaatattctgagcacgggcaaagaaaacacacaaaaaattatgtattggcatttatttatgtgcaaggtgataggaaaactgaatccatctttgtagaagagcactgggctaatttgtatgtttccatagctactatatgcataaacaacagtacctgaaggattattaagcaaccttaaagcaataagttcattaaacagaaggtaataggaagaacagtacatttttgtctttatctcaagtatataaagttttgccccatgataaaataagtaacatataaattaatacataagttaatattggaagtgaaattaggccttatgtaaggagaggtagctacacagcatctgttacggttaatgagaggcacactgctaaatttacgtatatttcattgaatactttatgggaagcctccacaacacctcctgatagtagtaaaattagaaaaaaacaaactctactaatttttagatattcattaataggaaagatttaatgttacagcatctactctttggcactttttcacataagccagccttagagactagacaaataactactgcaaaaagtacatagtgaattttaaaatgtagaagaaagcaaaaaataaaataagtcctaaagtgaagaagccatcaattttaacatttgatgtctagataacattcatgagattggtcattaaatactatttnnctccttttctggtgttacacatacacactcatacgtgtgtgtgtgtgtatgtgtgtgtgtgtatgtgtaatgatttgtgtccatttcaagtgttttcacaccagtcacacattatagaaattactggagccatgtctacaaaagcaaagtgaagtgatgagctgaaaagtgatcagggaatctgatcccataaagaaagtgagtctgaattgttgaaactaaagcacttcttttccaaaaatacttctgcaactcatgaacaaaatgaagttaacttagtgtttagcattaaaaataaaagttgtaccttgaccctagaattccttttataagatttaattgtaattgtctcaaagcatcaaataatacatctttatcattaaacatgaatttaatgtctaggataatttttaaaagaggaaattaaataattttacatgtctcatattttcagtgctttctcaaaatttgatggtgaatattacattgcattcaaaatcttcactgaatatcatatatatctaaatgaaaagagaattacttatattcatctattttctcagaatctattcagtaccctatggagtacatggaagaagtatatttttggaaccagtaagtatgggagtccacgattctcaggtattgattgaaaaaagagaaaggggcaagaaattcattaaagaaaaaccacagatactgaaacatttgacacataaaagtaattaattgctggagactacaattcctggcaaacaccattattccagatgcaccatgctacccagcatgctacctgaatggcggtttttatccatcctgtcaccctgagcatctgtctcaacctgctgaggcacagacttccaccatgtgcatcaggaaacacctcactcatactgtcatataatgcaacagggaggcatagtctctctacaggtctctctctttacgttgtaccattctgttgggcaacaattgtcccaacaaccacacttaaatccagtggggaaaaaaaggttaacagtaaaaatttcttccacgtaattcaatttctcacaatagacagaaacagggggaaaatgtttgccctgttcaaagtactaaaactagataacttaaataatttaagccaataaataatattatattgtatttaacccattattcctcacctaccctcaaagtaggtatacaaaagactagtttgttattaatccacaaatatgctaaatgttagcaagatgatttttaagtacaaaaaagtttaagattgcaaggaaggaaacaatggtcacaaggtctttacttatgcacatttgtgcataaatttccacccaatttccaagacagttgtatcacaaagctgtgaaatgtgcaagagtatactttgtacccatcatgtgctctgttttgacataatgagtaatgcagacatttacatgttcttccagcttcaatcagtagacctgattttcaaaatctgccctcagatgaaaataaaataaacgaaacatttagacaatggctatattaatctgggaaggcaacacctgtggataaaacattagaagaaaacatatattttattttcatacttttgatatgattgtaacatatttcttgagtaatttaaatgctttgttttcccacacatattcaaatcagcaagcttgtagctggactgcaatatcaacaacaagttgtttcaaacagcatcaaaatacaacttcattgctacacttacaagtaatgaattttatgtgactatgaaacgaatataagcttaaaataagtgaatctaataaaatggctattcctctttttacttggaaataataaattaacattatattttaaacataaattatgatttc

SEQ ID NO: 142285 - DNA, 256 bp, Homo sapiens
aaagagctcagtgtgtcaaggtacagcaaggaggccagggcagctactgggttaatttgaggctgaggaaactgacaggagtcaaccacatggtactgtgaagggccaaatagaatttgggtttgggatttgtttgcttgcttttgttttgagatggggtctcactctgtcacccaggctggagtgcggtggcaaaatctcagctcgctgcaacctctgcctcccaggctcaagccaccctcccaccttagcctcc

SEQ ID NO: 142286 - DNA, 395 bp, Homo sapiens
ccctctgaaccctgaatgcctaagcccagatcattcaattctaagatctggccacgcccaccctcctgcttcctgttaggacctcagcaagagagggaaactgaagaacaaagacaaagaacagatgtagggctttgctctagctcagggcaaaaggcagcttcaagatgtttcccctcctctccatctcttgtcaatacctgacccttgccaaactgcagagatcactctttgaaatgaaaagcatacaccatatacatgatggactagatttttctgtcctgattcagcagtgcacaggaggaattttcatccccataaaggaaactgtccaataacgcaactcaataaccattgaatgagcagctactatgtgctctctatttgccctgcac

SEQ ID NO: 142287 - DNA, 286 bp, Homo sapiens
ctgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgag

SEQ ID NO: 142288 - DNA, 110 bp, Homo sapiens
agcacttcatttttcatacaataccttttattatagagggtaaatggcagttttctgctgaattttaaaatagtgcatcatgtataattcataaaaactgccagtagcat

SEQ ID NO: 142289 - DNA, 511 bp, Homo sapiens
acattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcag

SEQ ID NO: 142290 - DNA, 207 bp, Homo sapiens
ctctggctccaaagcctctgctctcatctccttccaagtattttgtggttctgttttggctgcctcctaaccccaaggaaggtaatggtttgtctctgctgtcccctccatttactgattttgaatgatttcggaagggggaagtcccaaatgtacactgccaagttctaagctagagactttagaaaactaaaaaagaagaaatat

SEQ ID NO: 142291 - DNA, 346 bp, Homo sapiens
gtttttcatccctctctcctaagaggcagttgattatttatgtaactctagtaccagatatttacatggggaccatggaatgagaacaaaggcagggaaataaaatacaagaaagggaaaagaggagaagggaagggaagaaaaaagcaactagaaaggaatcaaacatattcaactcaaacaacagcaaaacgaggaatgcttgtgtcagcaccagcacccaagctgctttacaagacatggcagaagtcagaacacattgcatgcagctgctgcctgtacacacaaataaagttatataggaacacagccacacccatatcagtacctattgtctgtggctgct

SEQ ID NO: 142292 - DNA, 403 bp, Homo sapiens
tctcagctgtagaatggaaaaatctgtttcagttttaaggattgaattcaaatgtgtaaatagcttaagagtatccggcataagcactatagaagcgtctgctattactctgcagagtggcagtggtgaattatctgatattttttccttaacttgaatagcaatccacattacaatggataacaatacccattgtttatgatttgaggcatccaattataactgtattattgaagtgttatcaaattaccaaggctgtagggtatatttagtattcctagttaaaggtttgaactaatttgtatactagggcatgtttcttaatgggaagggggtgaaggttataataaaagtcacccctaatgcttgtttaaaattaaagaggaatttgtgggcctgggac

SEQ ID NO: 142293 - DNA, 321 bp, Homo sapiens
atataagccctcatggggcttatattttaatgagcgaggataggaaaaaaaaatgatggttataaataataaataatttatgtaattatgtatataaatagtaaagtatataaaatagtgtgcccaccctttgatccagaaattcacttctagaaattgatcccaagaaactatattagagagatatctaaaaacttagttacaagcattatttatacagtagaggggcaaattagaaacaacttaaatgtccaacaatagagaagtgattaaaaaaattaaggcagccaggtgcggtggcttaccgctgtaatcccaaca

SEQ ID NO: 142294 - DNA, 306 bp, Homo sapiens
agggggaagtgactgtcccaagtctacacaaccacagaagggatattctgggaataaatcacggctaaacccccctgctgctccaggcagttctccttctacagtgctctattgtgctgttttaataatctttcaactgggaagaactcccatttcaggaattaagccgtggacaaatcttttaattatccttgaaatcatcctaataagaaatccaaggaggaagtcttacagggtgcctcacccacttttctcatcactggaactttttagacattttattattttcttcctaaaccagagtac

SEQ ID NO: 142295 - DNA, 247 bp, Homo sapiens
agtagagacagggtttcaccatgttggccgggctggtcttgaactccagacctcaagtgatccgcccacctcagcctcccaaagtgctggaattacaggcgtgagccaccatacctggcctaggctaccctagatattaatgaaatagtttcatacttgctttgtaatcttgccccattggcatagcattttatctttattaaacaaatgaaaatttaaatagccaggcatggtggttcacacctgt

SEQ ID NO: 142296 - DNA, 187 bp, Homo sapiens
gatgaaaaagccaaacagttttcgacagctggaattcaccagataatacctaaagattgttttctaaataagtctgtaaaactacgtgactctctaaaatatatgtataactttgattaaaaataaaagcaataatgaggccgggcgtggtggctcacgcctgtaatcccagcactttgggaggcca

SEQ ID NO: 142297 - DNA, 353 bp, Homo sapiens
cactattgcattgaccagcaagctacccaagccttggtgattcggtagagaatgggctggtttagaaatcatactgacttgagtttaagtctcagctctccttttaccagcagtcaatatttactatgtgtaaatcatttaatttctctaagcccccaattttatgaatgttgtcaatcataaaattaggatgatgatggattcttctcaaggttgttgtagggagtaaatgcatgaaagtgtcttacacatcatggtgcatggtgagggctcagtgaacacttatgtctcctctctaccccttcctccttgcacgcactactgtgtgcatcaagtgttggcatcctgatggt

SEQ ID NO: 142298 - DNA, 242 bp, Homo sapiens
ccaaagtgctctccctgtttgctttacaacaccaaggttttgtcacaaaaagaaggaatgtgaacattatgtaaaaataaaaatttgcaataatttaatcccttctatttgtataattatttataatttaccaagtattttacttatatgtctttagatgacacagataaccctgatatatagtaatttttatgctatcttacaggtggagaaacacttccttacagagatcacatgcaaag

SEQ ID NO: 142299 - DNA, 399 bp, Homo sapiens
tgtttaaaaaaacagacttgtacctggaattcgcttttaaagtctgccagctgcccagggtcataggttcatttgcccaggctcctgcatattctaattttatccactgaggcccaggacacatggagtctctgctcagtctctatccttagaaggaagcttcaagccgggctgtcagagccgacggtaaacacatgatgaatgtccccgccgccctgaaccgtcttcctgagattctgtgtgcctgcccactcttccttgcagagtctgaaagtgcattgcagcgtgttcctccggctcccagaatcggacatccgtttcatcttggaggagcacatcctgaataaaggttattctaattttaacagcagcaaatgctaagctcaatggtgaactaga

SEQ ID NO: 142300 - DNA, 549 bp, Homo sapiens
aggtggtggtttaggtgctgagactacaggaatgaccaaaacaaaacccttgtgctcaggagctgttttcagtttggagagaaaggcattaaaccatataaagtcagtggcaatgagtgctttatagcaaaaagagaaaaagaaaatgaggcaggagacaaatgaaatgctaaataagctcttcatgcacatggcaactagagcagcccttgtaaaatgtcagatgttaatgctttggttgacctcctctaaataactttacacttaaaaaataaaatccgaactccttactaaggcctgttaagtatgcttctcattttatcccccatgttccagttacactgtactcgtccccagagatactaagcagttctctacttcaagacttttgcacttgcaattccttcttcctggaacatcttttcccagatttttgcattgctcatttcctcaggtggctgctcaaatattcagtgtccttcttcatcgaaaatagcacacccccagcacacatatcctcaattcatttgtctcctgcctcattttctt

SEQ ID NO: 142301 - DNA, 264 bp, Homo sapiens
cagttctgaatatccagatagagaaagttcatggaacttctaaggtgcagccatcagttgggaagttttaactacctcttgctcctgtatgtcatcagtcatgttcagctccaggagaatctcaggtactcactgctatgatcagagtgctaagatctgttataggaagtgaatgtgttggaaaagtgtctgagcagataatagcagtagctgcctgaagacctcttcctcaaagtttatcatatagaaggattgaaggtagag

SEQ ID NO: 142302 - DNA, 364 bp, Homo sapiens
cccattttacataaggggaagagggaaccgacctaaagctactcagttaatgaacagtacagccaggaccagaaaaaggtctctcaagcaggcttccttctacttttctggctcccttactacttgaataacaaggactcttagcaagctggaactttatctgatgcctactcaaatcgtgcatagaattagcatcacaaccatggctcagaatatgggctgtgggcccagactgctgagttcaaattctgactccaactcaccagctgtgtgacctgggcaagttatttgatctttctactaatctattaggccttattacccccatctgtaaaatggagacaccagcagcgcctactcagag

SEQ ID NO: 142303 - DNA, 694 bp, Homo sapiens
agagtttgtgtctttgttcacagtgctaaattgtcccccagttagcatcaacacacactccccaaactcctgcctgcaatgtctatatttggtggccttttatgatgttccttgcctattgttttcccttcacctattaataaattatttctttagctttattgatcaaagctgcccaggcattttaactaacatcacgtgtgcaaagtttttaggtgtggagtgtggggtttagcaggaggcctgtgtgggggctgtgctccccatcctgacaagcacacaaggaactaggatgatatccttgagattggctgggctaccattgtttggattctctttcttttaaaatatatttttcctatggtatatgaataaacatttaaaatttttaatacaatgtttgaatcttcttcagatattttatgtgaaagttaggtcactgcttgggaaggaatagaatttcaacctttgggatgaggatgcttaagaggatgtggaggacttccaaaccactctgaaatgttttcttacctgaggaagtcttctagacctggcagtagaaacctaaaaatatccctcatagccttcctctaattgatgctagttattagaatctgagctcaacattgcctggaaagggtgggcatggaggcatgtgtctgtagtcccagctactcaggtggctgagacagga

SEQ ID NO: 142304 - DNA, 267 bp, Homo sapiens
acagctgacagagtcctctcctggagggattcccaagttatctccagctgagctctttcatgaaacaaataatatttgtttcctattgctgcataacaaattactacgcatttagcagcttaaagccacaaccaattattatctcacagttccctaagtcccactgtatgggtgtgactgggttcttagctcagtctcaaaagggcaaagtctaggtgttggctgagctgggctcttatccagatgctttgaagaagaatccacttt

SEQ ID NO: 142305 - DNA, 836 bp, Homo sapiens
ggcaacaagagtgaaactcctactcagaaaaaaacaaaacagaatttcaagactcaactaaatctctgaagaatagaagcagggattaaaacttatttttacaaaggaattaaaaacttaattttacaaagttcaggtaattccgatatttgcctgggtttgcaaatcatgaatataattcaacctttgcattttatgatgtggttgagtaatgtgtccaaaacaacacggttagataacagtataacctgaacaagaactcaaagatgccttgtggcccagtccaagacatctactcagctacctctgtgtgcttgcaatatgaattggtggcaattaatgcaagaagaaggattctatgagaccaagagctgaggtttggatgggagtattgcctatgttccactggactggaagggacaggcagggactaggtctgacaggagtgtccctttccttccctggcagggtttccaagaagcaacctgtccaagtccacctattagtcacaggaggtgacactggcccctagtgatgctcacgccgtggtttttctgagcatggctttttcatttagcttttgctcagagatgcttaacacatggaacctagttgctgacagaatgacctcagcagggagaggaagggaactactttttcacacctgcaatgttactgattataaaaaatgataggtaacttccatagatagggagggctgccttaagaacaatgaagttgcaaacttctggagtattctataaaaattgctactgtgctgggcatggtggctcccgcctataatcccagtactttaggaggccaaggagggaggc

SEQ ID NO: 142306 - DNA, 273 bp, Homo sapiens
ccacctaaacctttccatttcttacctacatttggtctcattcattcgcatctagaaatgtattcaaatgaaaaacaatccaggatatatgcatacgttaattttcagggatgtttagcaaggctatttgtggtagaaaaattggaagctacataaataactaacaataggcgactgattctaaatcatggaaattcgtttagtaaaactttttttttttgagacagagtctagctctgtgacctgggctggagtgcagtggtgcaatctcgg

SEQ ID NO: 142307 - DNA, 463 bp, Homo sapiens
aaggaaggggcagaaagaaaggtaagggaagagatatatatagatatgtccatatttacaatctgattataaccactgacatatgtgtgcttttttcttggtatactttgtgaatactatatgaattgttaaataattaagtagaaacatcatttctggtaatattttaatagtgcagatctcatactgaactatctaagaagcattatacttacttgactgctttgtatctcattttatattgggtattaagtgaacacagtatttaactataaacctgccaatatgcatttccagagacctgttgccattttgttttttaagatatttttgtccccacaaaagataagaaaatgtatcgtgaatatttaccaatgtctgaatcctaaagccctgagtattttgatactcaagtactcatgatatgcaagaaagcatggcacatactatataagtgtaacca

SEQ ID NO: 142308 - DNA, 121 bp, Homo sapiens
aagaggaagaaaaggaggagggagaaatggaggggaaaatttgagaaagagtaggaggtttttgaatctagtttgaattcgacaagctagaattcagaagaaagcagggtgagaaaaatat

SEQ ID NO: 142309 - DNA, 329 bp, Homo sapiens
gccacccactctggggaccagagatcccataacgatgaaggtctgtccagacacttcactatgacaagagatcagccatgagtaggtgggtggagcatccgtctacctggcactgggaactgctcagctgcagctaactgtcggcctgggggctgcaggccttcccagtgtttaaacgatagccacaggctgggcgaggtggttcccacctgtaatcctagcactttgggaggccaaggcgggcggatcacctgaggtcaggagttcgagaccagcctggccaacatggcgaaaccccatctctactaaaaatacaaaaaattagcctg

SEQ ID NO: 142310 - DNA, 154 bp, Homo sapiens
atttggagttaggctatatttgtggtaagcaagcacagttcctatagtatgtaagtttcatatctttcatttccaaatactacattgaatccacataaatgaagtgatatgtaagcattgtattagatattataagtaatctagagatgattta

SEQ ID NO: 142311 - DNA, 292 bp, Homo sapiens
gtggtcatccttttgactgacacatcagggtttcaggctgggagaccccatggatggggattgtgtggctgtagctgtcatctgcgtgggggtcagaacccaggcctgcgcagggactcacctgacaactaacggcaggcagcctgggggctgtgctcccatgctccctggccgctggaggcatgtgtgggcagagccccccaccccactcaggacgagggccctgggagctgcaggaagcacacggaggcacgcacagggcggcctgggacccaggcactgacagacttgg

SEQ ID NO: 142312 - DNA, 378 bp, Homo sapiens
acttatgaacactgtgctgaactgataagcagtaatcgttttccctttcttttaatatactgttgccaattttagctggttgcttagaaacattaagtaaaacactagaagccaatgtaagaagaataagggctgtggtaggggttggcagtatattcaaaaatgtaaagatcagaatataactatgtgtaagggtgtgagattatcagccaaattttgctagctcactgttttcacagacgtcacaactctcgttggaaacttggaaaatgcagctttctacaactacacccgacaaaacaaagactgacattttgaattggccacatgattaggggattgataactgttcctggctagccagcacagatggcaaca

SEQ ID NO: 142313 - DNA, 277 bp, Homo sapiens
aaatatttaggaaaaaaaacctgagagagctgtgagacatcatcaagcatactaatgtactcatatattcatatagttattatattcattagtatattcatactcatatactcatataggaatcgcagaaaaagaaaagggacagaaagaatatttaaagaaataatgatagaaaatttcccaaatctgatgaaagacatgaatctacacatccaaaaagctcaataaaatccaagcaggatgaactcagatccacaccaagacatgttatattagg

SEQ ID NO: 142314 - DNA, 102 bp, Homo sapiens
aggtaggggaggatgatcgaaggtaggggaggataagcaaagactgcaaataagaaccctgatggtggccgggcgcggtggctcacgcctgtaatcccagca

SEQ ID NO: 142315 - DNA, 482 bp, Homo sapiens
agctcaagcaactgatcacagctgtgatagagaaaagacattgacagataagggcttttgatatcaggcaatcctgatggccttaaaataccagaaggacattctaattagattcagagtaggtgagtgataatcagatttgggatcagatcagggttaaattaagcagtgaatgaaagaagttaaagattaaggagatctatacctcccctccacttctcaggaaagatttgagccggattttcaaaaatgtacacaatcatgtagatagtggttaagagcctggacctcaggataaaagagaattaggtttaaatcccagctctgccacttcctgctgcgtgaccgtgggccagtcacccacctctgatttctcatctgtgaaatggagggcaaaatacttcttgcacatggcaggcttgttggaggacaaaatagactaggtacctgaaacgtgcttgctacagaacgtgcactgagcg

SEQ ID NO: 142316 - DNA, 648 bp, Homo sapiens
tttccaagtcaagaattgttttaaaaagaagcctggtgaaggcaaatgctgtctgtggccgaaggcaccgtgaggagctgaggctgacttatgtttctcctctgggctacgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccggctcctcaggagcacacggcaccccacgcgcgtgcaggggacagctgtcctcacaggaacagccctgggacctacaggacttcctggggtttaccctcagatcacccatgaggttagaatcacaaagcccgggagtcaggagacacagggcagctggagggaggtctttactgaggctactgaggcacagcagccccgtctagaggcctccctgagaggcacttcctgaggagtctggtggattttgagctgctttttaaacaaccttctccttagcatagacactgacactgaagggaaagaaagcaaatggtctgttcttagtgggaaggcaacttgctttcaggggaatgagtttggggaaagaggactggtagaagacacgactaa

SEQ ID NO: 142317 - DNA, 397 bp, Homo sapiens
gccaacccagcgcattcttctcacccttcttccaccctacgaaaggccatatcttacaagagatgctggtaaatgccagacattcactgtgtcaggcttcctcacagctagcagtggcatgagatcagttcaatccaatgacactgaaatggaactctccaaagtgagtttctgcaaaagacttctctgttaacagggagttataaggaaatatgcaccttccttccctgctttccaatccaggcatgatgtctggtgctacggcaaccatactgcaaacatgaggcaaatgagcctgaggaataaaagctaaaacactaatagaagaagaaaaagatgcagaacctagatccttaatgacatcattaagccactgcaccagctttagaaccaacta

SEQ ID NO: 142318 - DNA, 212 bp, Homo sapiens
ttggcacttaaaaataacttcagcactaagaaatgagtcttattatgaagtactctacacatttggctggaaaaaagtacgtccaagccttcatcaaactggaagctccctgagcgtgtggactgcctctcccaaaggcatggcattctccaacaacagagtagctctctgaacttcctcttgggtaaccctcagccacttgttctttaaaa

SEQ ID NO: 142319 - DNA, 400 bp, Homo sapiens
ccctaataaagtcccattattcaaattagaccactttatccttgaactatttatcagaaaacagcttgatcattcatgctataacaagaatatgagttaaagattgagttctttcattaatataaaatttgcaccatttagagggatctgttttccttaaaaattatgcttatttgctatagtttgttagattttctaataggtaaacccagtctctgcttcatatactatttttaaattatttgtaatgtagatgtcattgatgtagtagactgcatgccttcatgtcagtttctctgggaaagctatttccatgtatggcagatgaaacagaggtaactggtcaaatggttgtaaaggaaaatttgaagttttaattttatttaaacaaagaacactt

SEQ ID NO: 142320 - DNA, 435 bp, Homo sapiens
ggcaagatctcggctcaccacaacctctgcctcccgggttcaagcgattctcttgcctcagcctcccaagtagctggggttataggcatgcgccaccatgcccagcttattttgtatttttattagagacggggtttctccgtgttggtcaggctggtctcaaactccctacctcaggtgatccacccgcctcggcctcccaaagtgctgggattacaggcgtgagccaccatgcccggccagcttctgtttctttatgtataaacagtactgtcatgaagatgcaatgagatgaattttagctcagagcctgccacctggtgacttacccatgttaggtattgtggttacagccctgctgtcaaaccacttctccaactctctttctagcctcaattcatctgtcaaagcatttggccccaggattttgctgcg

SEQ ID NO: 142321 - DNA, 593 bp, Homo sapiens
aaaaagtccaggaccagacggattcccagcagaattctaccagatattcaaagaagaattggtaccaatcctttgacactactttacaaaatacaaaaagaaggaaccctccctaattctttctatgaagctagcatcaccctaataccaaaaccaggaaaggacgtaatcaaaaaagaaaactacagaccaatattcttgatgaacctacatgctaaaatccttaacaaaatgctagctaactgaatccaacaacatatcaaaaagataattcaccatgatcaagtgggttttataccagggatgcagggatggtttaacatatgcaagtcaataaatgtgatgcaccacacaaacagaattaaatacaaaaatcacgtgaccatctcaatagctgtagaaaaaacattcaacaaaatccagcatccctttaatattaaaactctctcccagctactcgggaggctgagacaggagaatctcttgaacccgggaggcagaggttgcagtgagctgagattgcgccattgcattccagcctgggtgacaaaagctagactttatctaaaaaaaaaaaaaaaaaaaaaaaaaaa

SEQ ID NO: 142322 - DNA, 249 bp, Homo sapiens
cagttcatgaccagcctgggcaacgtggtgcaatcacatctttacaaaaactatgaaaattagctgggcatggtagtgaagactgtaatcccagctactgaggtgggtgagtttggagaattgcttgaaccaaggaggtggaggttgcaatgagcagagattttgccactgcactccagcctgtgcagtggtgagagaaagagacagagagagaaagagagagagaaatcttctgacctcagagcctga

SEQ ID NO: 142323 - DNA, 674 bp, Homo sapiens
ggataataacagcttaggagagcttatctgaggaatgtaaggatggctaaacattagggaatcagaaacaaaaattgttagtaaactaaagaacacagcatagttagccagaaatgctaagaaaattcagctacaaaacttaccagcaatttagggttaaaacatcatatgaaatggcaaattaataaaatggtgccattaacggtgagttcaaacctaaaaggccaatatttgtcattgttttcattagtgttttttttgttcctacatactgtaaaattttgtgacaaattctgttccacctagtatttaacctgacacctaaaatgtttagtgtatacagttgcaaagacataattacttgccattgtgtaaatagtgatctttgaaactaaaactattccattctcaaatacatctgttggactctaaatacctaagggtggatcacgtgaggtcagaagttcaagaccagcctggacaacatggtgaaaccctgtctctactaaaaatacaacaattacccgggcatggtagcaggcacctgtaatcccagctattcaggaggctgaggcaggagaatcacttcaacccgggaggcggatgttgcagtgagccgagatcacaccatggcactccagcctgggctacagagactctgtgtccccccaacc

SEQ ID NO: 142324 - DNA, 245 bp, Homo sapiens
ggagacgaacagaacccaagcctatcgagaccatatgctccaccgcttacatttgtcttctctaaaggctgaccctttaacagttatgtaattcagttacttcacaaccatttaaatatagcaaaatgtccacaaagaaaaaaagttgcccacccacctaaataccttccatgctttgcccacagtggtaatagacgagggggtgggggtgggcaaacatgcctttcagtgaaagcatggagaga

SEQ ID NO: 142325 - DNA, 443 bp, Homo sapiens
caggacttccagtgctaaaacagagaaagcccggggcaacccaggtcaagctgtccgctctccctggccagtccctcgaggggctccagtctggaggtgagacttccatgggcatagagtcccagtcccgggtgagacctgctttgatgggggccatagaggtgcagcaaggaggccctgctgcaggccatgactcccccaggccacaccggacaagcaggtggatgaaggaaaatgggaaaggtgatcagggcaggagcaagcttgtgcaaagacccaacgatgcaagatcctggcacgcttcaggaatacagggagtttgcgggagagtctccttcctccttagaagtggctcagagaggccgggcacggtggctcacacctgtaatcccagcacattgggaggccaaggcgggcggatcacttgaggtcaggagttcgag

SEQ ID NO: 142326 - DNA, 243 bp, Homo sapiens
cacttctagggacctggccctgccttccagcctgccaggatcccaggagaccaagcctccacctctgcctccggacagctttactttggctgagcaaggaggatagcctaggcctagaggaagacatgagggcagcgaacctggggctgagctcagagctgcttgagcccttcaggccccattcagagtgggagagggggtgtcatgccttagagatgtggggactgacccccttatcccagc

SEQ ID NO: 142327 - DNA, 290 bp, Homo sapiens
ctcccagccgtcggcgggctccagatcagaagcggggaatagaacctctcccccctttcctgcctctttctggtgtggcttgagttgctctgctctctgggaaatgaggctgactgacacacaccctcccttcccccaatccttgaaatcttgggtgtttgaaggacaattttcttgctcccaactcatgggtccatttatctagccagcatccctagcatagccctccttgcccttgatgccaccttcaggctggggcaggtggagtggaggctgaggaacagactggt

SEQ ID NO: 142328 - DNA, 229 bp, Homo sapiens
agctgggattacaggaatgtgccaccatgcctggctaattttgtatttttggtagagacacggggtttctccatgttggtcaggctggtcttgaactcccgacctcagatgatccacccacctcggcctcctaaagtgctgggattacaggcatgagccaccatgcccggcaacttattattttttaaatcaagcacccaggtgattgtgatacaggttttcaaagcca

SEQ ID NO: 142329 - DNA, 426 bp, Homo sapiens
tccagatcagaatctcctaatacactgggattggaggtgggtgtgggagagtctttgcccaattccttacgaacatggcagtttttctgcttctcagattgggtccaaacctctctgcctgccactccgggctttctacttgttgagccagcagtgggaataaatattatgacacagttgctaagtatacaggcccttggctcaggtcaccagtttggcccctagctcaaactgtgtgaccttaagcaaatgactgaacctctctgtattttagtttgttcatctctatataaagaagcagtcatagtacttacttcatacaatcattaaaaacaaacacatacatgcttatcaggtttcctgacaccagtactcagtagtcttagtaactattacttattttatctcatctaggtgccatcaatt

SEQ ID NO: 142330 - DNA, 795 bp, Homo sapiens
caaaagctcaagtgtgtaacacattggtaaagatgcagaggagccaaacaattagaaaaattcatctgaaagctatatggagaattttttttctcttctatgagcttcattgagaagtatatatggagaattttgtatccaataaacatggttttcaaaacatgtggagcattacacaaagcaatgatagtcgggcacagtgtctcacatctataatcccaacagttttagaggctgaggcaggtagatcacctgaggtcaggggttcaagaccagcctggccaacatggaggaagccccatctctactaaaaatataaaaattagccaggcatggtacacgcctgaaatcccagctactcaggaggctgaggcaggagaatcacttgaacccggaagccagaggttgcagggagccaagatcgcaccactgcactccagcctgggcgacagagtgagactctgtctcaaaaaaaaagtaacgatatcacacaaaaaacctaaatgaatctgcaaaagcagaagtcatctaagtcaccatgcaccgtggtcagaacaagagtaaaaagacaaaacaaccgcaacaggggaaaccactggtttaagatcaccagcaatgagaataccaggtgtcaaaatctgcaatctttatccagagccttgggtctccccgttccaacaccaaataaatcgattaaaaaatgagccctcactagacggagctagcagcagcagcgttatgggttgaattgtgtccctccaaaattcatgttaaacacacagcccaggacctcag

SEQ ID NO: 142331 - DNA, 416 bp, Homo sapiens
gaacaagaaaagctgtggttatataccttgcccacaaaatgtagttttgtaataaattctctcttaagcactctccgtaagtgttttcatttcctcccactgacaaccagtccaagggagataaagaggcaccagcccggctgatttttggatttgtggtaggagacggggtttcaccaatgttggctggtctcgaactcctgacctcatgatccgcccacctcggcctcccaggagtgctgggattatagacgtgagccactgtgcccagctgcaacgtggcatcttcaagtgccaggtccaaaatggcgccttttaagttacccagaaagtacagttagtatgtcgctataaagtagcttcgcaaataatgcttccccatcctgagcaacattcccaggccttgggactgaacc

SEQ ID NO: 142332 - DNA, 326 bp, Homo sapiens
ttgctagctgtgtgggcctggacaagttcttcagcttctctgagtctccctcacctcattcatctgcctcacagcggtgtttccagcacaaagtatatgaaaggagtctgaaatcatacgtctctataagagattattaatactattattggttgaatcacaaatctattgtcactgaaaatctttccagtgcagacaaccagaagtaaaaatgaggaaaaaagggaggtgctacgagggaatgagaggcaggaggcctggaaagggggaattgggcccctcctttacaatctgatccgggtgtgggatcacctgcaaactgcctg

SEQ ID NO: 142333 - DNA, 354 bp, Homo sapiens
gccattacctcctgagttcagtaagaacttagacaaaaataaccagtagctgagaagcttcaaacaggtttattaaggttgtttctcaacaccatcatttgtataaataatcccccagatccctctgactttcacaagataatatttttcaactgaaacttattttcattattttctttaaacatatttttgtatacattgtctgctgggcaataaattaaaattcaaaatataaaatctgatttaaatgtcactcggaatgtagatacttccatcatgaataataaattgatttgcagatgataaatccccacagaaagggcatttgttttaaacagctgttcagtttcagag

SEQ ID NO: 142334 - DNA, 116 bp, Homo sapiens
ggagccagtgaccttctagggggctttgccacctgctgctcctgaaaactctcccacaattagaatgcacctggcaggccgggcgggctcggtagctgacgcctgtaatcccagca

SEQ ID NO: 142335 - DNA, 785 bp, Homo sapiens
ataatgagaggttagaccacagtccatgtgtattcctcccacaggaaatgttggccttctttcagagagccagtctagttaaaggataaactatatggcagtttcatgggtattatgtagaggactgaatgttgattattagggaactttcttggatcacctggtactttaaagagctggttttgtaacagagtctaccagaggagagtctgttataaatcagtcattaaggttagaagattttcttacaagaggaatgagcaagaaattgtcatcttagaactagttgagaccttagaagccatctagatcacataccttacttcacagatggacagaacaagctcagaaagctgcagctggggttcagggctttgacttgccagcccaattaatttctcagggaatacagattagaaggacagagaaattaatagttacggagacctaaagagaaaaaatagaagttgattaaatccaagtttttattgtatgcctgctgtgtcccaggttctgtgctaaaggtaccaagaataataaataaaatgtcaataaggctaattgttaccctatggaatgcctgaaactgaagctgacacatgcatattgaagggagcctataaagaatgtgtgggaaccaatgtattgaaacattaaaaaatagaaggcgaggtagcttcaggcctgatatcccagcactttgggaggctgaggtgggtggatcacctaaggtcaggagttcaagaccagcctggccaacatggtgaaaccccgtctctactaaa

SEQ ID NO: 142336 - DNA, 351 bp, Homo sapiens
gtggcagccgtggtgtgggtgaatttcatcatgctgacactcctccacacctgctccgtgcctggcagtcatggtccaggggctggatgcccagggtaaagtggggaagaaggtgataggcacccagccacatgctccgtgcccacagatccctggggccagccaagctgcaggtgccctccctcaggtgagagtccactcggccttgtgattcctacagaatagcccttctctccttctcctgtgtctctccaggggccagggaggagatgctaggggcagagagccaaggtggggtctcagcctgggagcgatggcactgctgtggtttcaatgtctgtgttcctccga

SEQ ID NO: 142337 - DNA, 444 bp, Homo sapiens
acaaatgagggccagagtagaggttgctagagagctgtgtatattgttaggtactgatttggatgacagtgattgctataagcatttacaatacttcgtagtttagccacagttgtcccagatagctgcccacagctttaaaacatttttagggtgtctgttgccaccctagtccgttgacactgcatggagattatttctgtgacagcagtcttcaccagtgttaaggaggctgggagttgactctgtttccataaccatctaattaaatcaagtgcccataatggaatttgaataactgcctaactttgatatttaaacagaaactttgaggaaaaacaagtctctttttgtaaatatattctacttgttaagaaaaaataaagtagatcatgatgttcatctgaaaataaaaaataaaagaaaaaaatggacaagatgtta

SEQ ID NO: 142338 - DNA, 277 bp, Homo sapiens
gagatcatttcaaagaaaacattctggaacagttgcctatgggcacggcagggtgacggtgctgcttctgggtttgacagtggcagcgtatagctttcagcgcttgtgaaatctacacccaagtgagatctgtgggagggcagacttaactgttacgacttttttcaactcctgttacttggtagtactattggcctgcctaaatggggcctaccgaagatcgtggaaaagtagtacatgggacattaatgtaaaggaaggagataggagaacatta

SEQ ID NO: 142339 - DNA, 240 bp, Homo sapiens
tctacacacacacacacacacgttgccacatccctgtggtcccagttactcaggaggctgaggtggggaggactgcttgagcccaggagatcgaggctgcagtgagctgtgtttgcattattgccctccagcctgggccacagaatgagaccctgtctctcaaaaacaaaacaaaaacatctacgtgaggtcaggtagccaactggagaccagggtctgaaagtgagagaagagtgctga

SEQ ID NO: 142340 - DNA, 415 bp, Homo sapiens
tatgatggagggagagaggggaaacacgttgaagaatgcaatggagtgattatgatgacggattacagaaaataagcagtagaagaaaggaagaatgcgtataaaggaaatgcttgggccccacagtagggtttaaagaatggctggaataaaaaaacagacaaaacatggtttaaagataggaggtggtagttaaagagtaatatgcttgcaattgagatttgacagtggttatgattactggtaatagctaagcaagagtaagtgattttgaaactaagaggcaggtactggattgattgacgatacagaaataattaagaatgataaaagtagttgaagtagagaaaaagacaacgagtcagatcctaaaatcactgatgaaaagagacttgtggatgagtgcaaaaggaca

SEQ ID NO: 142341 - DNA, 321 bp, Homo sapiens
tctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctg

SEQ ID NO: 142342 - DNA, 478 bp, Homo sapiens
tcaggaactgaatgaggtctttgctgcagagtaaaatgggaagggtcagagcaaacctaccattagaaattgatgtttggctttttttttcctccacgattaaaaaagtaggggaaaaaaacccacctcaacttcgatttgattcaaaatagtatttcctaaaacataagccattcttgtcaaatatgagttccttaacttaaaaatgcattcatttaaatccctgatgtattttctcgtgttcttcattcatgcttggggacagagtgagtgggatttatgagttactgtactcagcacaggagaaataaatttggtataaaatatgtagagtataatcttactatttttgtataatattagaatttatcctaatcttaccaacccatccttgaaggcattttccttcagttcataatcctcactaaccaatttttctccaatgggaacttataaacattagcaaagaccccataac

SEQ ID NO: 142343 - DNA, 738 bp, Homo sapiens
gatttgtgttctgtttaaatattaaattgtcaacattgagtatactataccttttgtccttatctccatctgacctttcctagcatataacttttaatatgagaaatgttatttctttataatttttttgttttaatccagtactagctgtataaaatggatttttgcataaaagcagttgatgttatatattcttctattctgccacttttaagatttatgcttcttatacaaactttttagtgaatcagttttgaaatgagcagtagtccatttttgaaaacagtgttggcatatatagacttaggatccctaatccaaaaatttgaaatctgaaatgctccaaaattcaaaactttttgagcaccaacatgatgctacagtgaaaatttcacatctgacctcgtgtcatgggctacagtgaaaacacaggcacacaacacacagcttattcatcctccacaagggaaaaaagaccctcccagccctcacagctgtagttaccttttctgtgtgcagaatgatgatagtgctaaaccaccacagattgtccacgtgggtggttgagatagcaacacctttgctttctgatggttcaatgtatatacaaactttgtttcatgggcaaaattatttaaaatgttgtataaaattactttcagcttatatgtataaggtatatatgaaatgtaaatgaatttcatgtttagacttggtctcattcccaagatatctcat

SEQ ID NO: 142344 - DNA, 2559 bp, Homo sapiens
  misc_feature (1448)..(1448): n is a, c, g, or t
gaaacgatgaatgtttgagatgatgaaaatgctaaataccctaatttgatcatttcacaatgtgtatatgtattgagacatctcactgtacccccaaaatatgtacagttattattatgtgtcgattaaaaatttaatttttttttgagatggagtctcactctgtcacccagggttagaatatcaaaatatctaatttatatctaatcatatgggttaggatatctaacccatatgattatgcaatttaggctctctagtgtgattccaggccttctggtttgcttatattgatccctaccctagctagagagaaagagccattctaatgaagatttttgcagttagatacttagttattggtttttccaaaaggaatccaatttacttttgctgtgagctattttgacaaatagtgagaactctgaaagttaatagtttgtatcttctttaggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacaggtacatacaggggctgctcaagtaggtctttggcgttagtcatgggaattcagatttatttgcttagctaactaaatggagccaatgcaaatagattacttcaacagtctgagctgctgaaacattcctgcttccatcataaatgcttaatcatgctcaaaactgtctttttaggcaagaaactgagcccactaaatagattcagttttcactcttttcccgcttgatggttttattcattcaccatttgcatctctttcagatagactgggtggtattgatgtaaacttttctctccttcctaaagggttgccactgatcttcagacaggacaatgccaagacagatgctgcaggccagtttgaggagcatgagctggcccgtagcctgagtcctctcttattctgctatgctgacaaagagcagccaaacctgtgagtacagttatttatgggaaggggaaataagctcccagggaagggaagaaattagtaaaggctataatatatccgtgtaagtagaaatatactgtagataacaatcctgacttggcaggggaatagaaccatgacctaatgggatttttggggatctaatttctatgttatttgatactgaaaataaaccatttggttggtttataatgaaagctagttttattttacatgcattgaagtagttttcctattcataactctgccaacgaagagaaagccacgagttctccttctctgctctgcagtttttcttcccctgtaaacttggagcacaggcacaggagctgtcatcagaatggacatangctggttctttggtgaagccgtcagcctcattaatccaatccaggatttgtatcacatttggaaattcatcccttttacctttgaagtaaaatgtgccattttatggtctcagagcactcattgcatgtttaaaagcagggacaaaaaacaactgtgaggattagatgacatgtgcttttaatgtatggtaggagcattaattcacttttgttcttggttttgacattttgctttttacaagagtcttttaatagagctctaatcaaagataaatgggtgtatccaataatgctaaaatgccataccgtgttatcggtagaatcgtgctgacagcttaacagaaagtcttctggggtaccacacttcagtgggtactgatgtgtttacaagggaaggttggagtgtagattaccgtttgaggcatggaaagaggattgatgagagttctggatattgtaggggatgcagccagcctcttggcatgtgcagccagcccagtctcattcttctcctgaaatgatttggacagttttagatttaggacttgacatgtgtcacacagtgtgttttatctgtgaattccacagttcccaaagcatttcacatagaccatctcattggattcttcccaccatcccaatggtttaggcagggcaggaaatattgttatattttaagatgaggaaacaggctcagagagattgctacctgcccaagtttacatcgcttgttagtggtagagctggaacacacattcaggaattatgttgtcgaaatccatgacaggacactggcccactaaacagtgctttgctattgtaatagtatcaggccggctgggtacggtggctcatgcctgtaatcccagcactttgggagaccgaggcgtatcccaaggtcaggggtttgagaccagcctggccaacgtggtgaaaccccttctctactaaaaatgcaaaaattagccgggtgtggtggcgctcgcctgtagtcccagctacttgggaggctgaggcaggagaatcacttgaacctgggaggcggaggttgcagtgatcctagactgtaccattgcactccagcctgggcgacagagcaagattccacctc

SEQ ID NO: 142345 - DNA, 128 bp, Homo sapiens
gaaatttccactgtatctgtaaaagtggcaggttctctagaaggaaattttgtgtcccaggtgtaagccaaaaagtatcatgtgaaactgttgtaagtattcagcttcataaatggaaacctaacata

SEQ ID NO: 142346 - DNA, 848 bp, Homo sapiens
agtaatctgaaatttccactgtatctgtaaaagtggcaggttctctagaaggaaattttgtgtcccaggtgtaagccaaaaagtatcatgtgaaactgttgtaagtattcagcttcataaatggaaacctaacatatatgtgactggacacctgtgtattttagttgctgttaaatggtacacactgtgtgaagaaactaggaattaaggggatgttgatcttgcctctgaacctttttaaggcctaaatgggaataaggagtaataatactttgagtacaattgctgttttcattacattcctagaaggttcaatatcctctgggtgatacagttattttctcagagaaactaagtaactgtgaaggttatttatttttgtcagaccaagagttttctctcttcatggttaactcataaaagtggttcttgttatttgtaggtattgatgtcaagaaaggccgaggtcgatacattgatacctgcatggtcatctttgccccccgttacctgttagataataaatcatctcacaagcttgcatttgcacagagggaatttgccaggggacaggtgagcagtttgcttttgaaggatgagagtgcctatttaatagcacgagttttaatgtcatcttctgtgaagactgtacgttctgtgatgcaagtaactgctctgtgcctttggtacccagatagctcctgttagagggtaaggctcagagtaggtactcagtaacacttattgtcatgaatcgacttgttgactaaagcctgtgatcctatgtgttttagggaacagccaatcccgaaggttacatttccacccttcctggttccagtgtggtg

SEQ ID NO: 142347 - DNA, 1869 bp, Homo sapiens
gagcaagtgagcccagtgtctgtggacaaagtcgggacttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctg

SEQ ID NO: 142348 - DNA, 838 bp, Homo sapiens
cctggatttatttatttttttgcatgtggttgtccagctgttctagcaccactagttggaaaggctatctttgctgctttaaattgtctctaaacctccatggaagatcagtggactgtatgtaggcctgcttctgggctccgtattcttttctatgcatctatatgtgtgtgttttctcttttcaccaacttcacactatttgggttactgtagcttaatgtaagtcctgaagttggtagtgccaaacctcagggagtttttctgaacttcatcatgagaacctggttgagatcattgtagtaacacttggaaatgtgtgagattcccccttagtctggtcttcaaggagtttttaatgttctagccaggctaccctcagcttctagtaatctgtcaataccatttaagtgctcctcccacttgctgtccccagtagcttctcttccctgtgagctgtgactccttgtgtgttagcctgtgtttctcatttttaaggtggcagttttccctgtgacctcaattctctgatccaccctagaaggattgactttcagtttgttcagcttttttctagctgtgaggacaagtgatgactgcctagctctttccatgttgaaatagaaacccaaaagtttgtttaaagaattacttgttataaaagtcccccattgttaatgtacaacccaatgatgtaagttgatttatcgaattgtgcagccatcagcagagttctacttcagcatattttgtcacttcccaaattcccttgaacctgtttgtagtcatttcctaatccctggtccccatgactgggtctgaataaaataaacatttgg

SEQ ID NO: 142349 - DNA, 425 bp, Homo sapiens
aatcgacggatctacactagccaggaagcgttggcagaaactgtacaaatctgggggtcactgtcgtggtgctgctgtgagttcttttgctgatggtagcttgacattcatgaaggatgcttatttagcctctgtcatgtcatctgattgtgcttgccccatagttagtgtactgtgaaaaagaggaagctttctgggagtgtcagagatgaatcccttgatctctctggcttcttgataatccactgtgatgtatgcagcctcccctgtccaatgctgtggaatccctatattattgaatggaagagagaatttgcacttgagggagcaaggagaggaggaagtttaccaagtttgattcaagcacattggttagtggaataaagcaagctgtgctgttatatagttgttggtctttcaaattg

SEQ ID NO: 142350 - DNA, 927 bp, Homo sapiens
ggcggggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgctgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctccgggtcctcaccaacacttagtgcttcctcctggctaagggtgaccc

SEQ ID NO: 142351 - DNA, 1317 bp, Homo sapiens
cgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142352 - DNA, 1272 bp, Homo sapiens
ggtcccagcagctctgggtcaccctgcaacgccccccacccctgtgtctatgtcagctctcctgggcacggcactccgagcccctgtccgcttgtctcccatccactgggtgcctggcccctccttgtcccctctaagcccccccgtccagctctgctctcactccccgtccccgtccctccgtgccacggtgggggcatgcgggtactatccgcctctgccgtttctcatttcagactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142353 - DNA, 1213 bp, Homo sapiens
ggcacgaggctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142354 - DNA, 1187 bp, Homo sapiens
ggcacgaggctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142355 - DNA, 1103 bp, Homo sapiens
cgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcaccgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142356 - DNA, 1080 bp, Homo sapiens
ggcacgaggctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccggtgagtgagcagaatcgggttactgggggaccagagctctgcgcgtgccaggctcctcacaatgcccacctctgtggcacccccaatgctggcaccacccccttcctggggccccttttcttccctggcatcagctcacctctgccccgtggcccctcccccactctaatgccagtccagttactgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctccgggtcctcaccaacacttagtgcttcctcctggctaagggtgaccc

SEQ ID NO: 142357 - DNA, 1319 bp, Homo sapiens
ggcacgaggctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142358 - DNA, 586 bp, Homo sapiens
ggcggggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatgccaggaaagcacccacctgccgcctgtccccagacgtgtacagccacctcacctccacttggaagaccagccccagcagggctgccaggtcctctccagtggtgtcccagcgcagggcaaaggtggcaaggctgtctcaggtgatgtcctcaccgccccctctgtaggagcatggcgctggagcctgccctgtatttggccatctgtggaacaagccagctcccctggctgccaggggatggtgacatggtgcccccaggcctgtctccacaatggggagggtatccgaaagacccaaagatggtttgggacccccacatcctgctttggggcagccaagcagttctggaccctcggctctcgaggaaggga

SEQ ID NO: 142359 - DNA, 779 bp, Homo sapiens
ggcacgaggctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgcgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaag

SEQ ID NO: 142360 - DNA, 1050 bp, Homo sapiens
gagaagcccaagcagcgggcctgctgttgggattgggagggccaggaggtgtcctgtgtcagggccacagcccgggagcacgtggcggtcagagaggagcggaggcagtggtccagagggtggaggtgagccccagcctccctgacccccaggcgctcccctggctccagccctaaggtgctctcccagccgtccgacctggatctccaagacgtagaggaagtggagatcggcagagacaccttctggcccggtgagtgagcagaatcgggttactgggggaccagagctctgcgcgtgccaggctcctcacaatgcccacctctgtggcacccccaatgctggcaccacccccttcctggggccccttttcttccctggcatcagctcacctctgccccgtggcccctcccccactctaatgccagtccagttactgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctccgggtcctcaccaacacttagtgcttcctcctggctaagggtgaccc

SEQ ID NO: 142361 - DNA, 339 bp, Homo sapiens
cctactccctctgcgctgctcctgcgcgctccctagaatcttctagaagcgtggctgttcgtgctgttgcctgcctccctgcgcatacattctcatattcttaactaggaaccagctccctggatggggcaaccccagaaatgggcgacttcaaggaggcgggagataacatcccctccagggggcgacgtccaagagcatattgtgtggctgcgtgcactgagtagagctcaacgcccgggacctaaaaaaaaaaaaaaaaaagggcgtggagccggagggtcggtcccagctcggggcatgacgtcacaacctgcgccgccgcgcaaggaaggcccg

SEQ ID NO: 142362 - DNA, 854 bp, Homo sapiens
actgccgggcacagggccgcctttgcctgcctgccctgcagcagcaggcccgggcggctgcgagagggcgcagggggcggaggcgcggcaggggcgggctctgccgcccgccccaccacccgctccccgcccggctgcggggccagtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaactttacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagattttggcaacaacataacactgcaccttccaacagcatcaccaaatgccccaaaacttggacccatggagctggcatcattattactgtgcctgtttgcctcctgtccatagctgcgatgctgacagtatgggcatgccagggtcgacagtgctcctacaggaagaacaagagaccaaatgtggaggaaccatctctgagtgcatctggtaatgtggaaaa

SEQ ID NO: 142363 - DNA, 890 bp, Homo sapiens
actgccgggcacagggccgcctttgcctgcctgccctgcagcagcaggcccgggcggctgcgagagggcgcagggggcggaggcgcggcaggggcgggctctgccgcccgccccaccacccgctccccgcccggctgcggggccagtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaactttacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagattttggcaacaacataacactgcaccttccaacagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaa

SEQ ID NO: 142364 - DNA, 293 bp, Homo sapiens
cctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctat

SEQ ID NO: 142365 - DNA, 551 bp, Homo sapiens
ttccagaggcagccacccccctcccatctctgtttggggagccacatccaggagatttgctgcagcagcacgaaccggctgacaacacaattcttcctgtttccagggaaagcctttattttgctttgttctgcacttgaagggagcaggcacaaggctgccagaagagctcagctactttaggctgtgctgtttggaacgagggatgttaagcagaaaggcccaggctggtgggggactgggaggctgccttccagcccatccctgctgcttgaccttggatgcgtcattggtggtggaacataggttcaactatctttaaaatcaaggctgggccggcgcggtggctcacgcctggaatcctaggactttgggaggcggaggcgggcggatcacctgaggttgggagttcaagtccagcttggccaacatggtgaaaccctgcctctgcggaaaatacaaaaattagctgggcgtggtggtgcgtgcctgtagtcccagctattcgggaggtgaaagcaggagaaccacgtgaatcagggaggcagagg

SEQ ID NO: 142366 - DNA, 426 bp, Homo sapiens
cctgagagtaagataagagtcatggatgggactctcacagacgagaaaatgtctgaaaagagtcttcaaagttcatattttcacctatgttgggcccatgtggataatccaagataatcttcctattttgaggtcagctgattagcagccctggtttcatctgcaaccttaattcctctttaattcctcacgtaacataacatattcacaggctctggagatgccatcttttcatcttttggagaccattattgtgcctcctgcaagaagagagtccagatgcagacccagctatctagaatctcaactcaaggacagagcagacattgtaggtccatgggaaaggactgcccattccatgaatggtgccaagaccatttattatccttacagaagaaagaaattggtttccaacctcactctata

SEQ ID NO: 142367 - DNA, 363 bp, Homo sapiens
cctctgaatggtaaatgaatgaaggcagaagaggggagaagagctttttctgacctcacactaaaaagtaacaggagtcaagaaggaaacaggcagaagcctgaagggataggaacaatgtgaaaagtaaagtaggtctgtgagctccttccccaaatccctgcatggccagttagcccagaaatgcaccagggcagagctccacaaagggagagaagcgtccagcagccatggcgcttatgaccatcataaaagggacagcagttctggagatggaactctacctggctgatttttagatcatatagtcagatacatatttgttgatctaactcagcattggttcatactcaacccttccct

SEQ ID NO: 142368 - DNA, 220 bp, Homo sapiens
aatcaccttaatttaaggaattacgctcaatctttctgggcgaagagcttgtgactttatcatgtggctcagtgtatcgctaggttttatttactgtaagtcttgcagagaatctggcacagttgggcaggggatttgaggtgttgtaagcaaggactgatagaagggtgtgtagttggttcatacagagtttagtaggatgtttcactttcacgaggct

SEQ ID NO: 142369 - DNA, 211 bp, Homo sapiens
actgtgcatgtgagggatctagcctacatctaatacttgatgatctagggtggaacagtttcatcctgaaaccatcctccacccctggtacatggaaaaattgtcttccatgaaatgggtccctggtgccaaaaaagttggggactgcaggagtactgtattaattatagtattaaaatacaaaataatttttgtgtatattgataatggc

SEQ ID NO: 142370 - DNA, 1028 bp, Homo sapiens
agtgctaggattacaggcgtgagccactgcacctggcctggagtactcttagttatacagtcattcccggatacatgaagattcagcttcatacagtcattttgaaagcaaatttataacagtttggaattgtatgagcttgttttgaacacagtttgtgcttccattccctgccctatacatgcctgcatttaaaagcattgcagattagaaataaacaacaatagcacagtgattataaaaaaggagaaactcaacataagttacttcaattcgatgtgatctcttggagttatttttatgctttaaatttacagttgagaaagctatggactctgaggtgtaatgtgtaatattttgcttgcctctggaaattattctctgagccttgtggaatttgtttttggaaactttttttttatccggtgtgatgtctttttctcagaacttggacaacttgtattcattctttctccatctcaacctccattgaatggtgaaacaggcttgcagacaaaagctgtgcctagaccagactggaacggtccctttatgaaccttgggcccaccagttcagacacacactcttgacaacgttaatctccactctgaaggtaccttgtactccacacgatacctgtgcgaccgctgattccgctcaacacattttctctgatgtgtgcgggtatctctcgtgcaaatacctttacctggtagtagacagaatgaccttaatcgataacacgacattcgtcacttgcactcatcttggacagcgtccgtgaataccaacttaacactcttcttgaacaatgcggtaacaacttggtacgcccttacagtcgcacaaccacaactgcatctcgttacgcgaagacactatgtgaggcagcgcgaaacgtgacgggggatgagagcaaagtacacacagacaagtgagtatacaatgaacaaatatatttacaatggcaggccatgcgcaaatgcgtgcgtaaccacagctatgattacttgctcttcttattcct

SEQ ID NO: 142371 - DNA, 293 bp, Homo sapiens
accacaggcagaagttgcaaacttgcctgaagggcaagcagacatatttaatttggcccatttaggtttttgtttgtaattaggagccaacacttaaaattctgagatttcagaggggaaaaaaattgtatttctgatttctctcagaaaacagcaaccacccttggcctgcattcttgcacagcagtgatttttcagtgctaaggaacagctgcgcctgtggatagattagattggatattgtggtctccgccatgttacttggggcctagcccacttccttctcttccagt

SEQ ID NO: 142372 - DNA, 517 bp, Homo sapiens
taaaattaatcctgtttgtttttgtcttcctccactaaaatttaagtttgctgaggtagacagttttgtttctggaaccactatccctccagcggctagaacagtggaacatgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgagttctatctaacagataacacagttgagtacattaaaagggaccttgaacacaaaatccatgttttcgtggattagtatttttgcagcttaaatggtgaacgataggattgttagatgcaaataactctggaaattaaagacctttagttgtaactctccctaaaatgtttgtgagagcttgtaaaatgttgttcactttattctattataaaagggcattataataaatatgaagttttg

SEQ ID NO: 142373 - DNA, 480 bp, Homo sapiens
ggaatgacagaaaactgaaaagttaatgattattatgtccattttataacaaaaatatatgcatttagagaagccatccaacttgccctagttgtaagctagttaacggcagaagaaacacaagatctcagattttctttaagtcaagacatcacaatatggtcagaagaaaagttgtcaagacagaggcttatgttcaaatcttaacaactttgtatttgtgtgaccctgggcacacaaattgtatttcctcaatcgatttcctctcaattatgaaattatatttcataaaacaagaagttgtacaactatcataataagagaaatagaaattacatgtacagcacttaactctgcacagaaagctttcaataaacagcaattagtattattcttgttcactgtattagacctaattttaaaacatggtaattactttagtcttccaaatgcataataatttggcagccatttaaacaa

SEQ ID NO: 142374 - DNA, 437 bp, Homo sapiens
cctttgttcacttgtttgtatgttgaccttccctccactgttgtcctgtgaccctgccaaatccccctctgcgagaaacacccaagaatgatcaatgaaaaaaataaaaataaaaaaaataaaaaaaaggaagttaaatattagtgattacaaatatgatagagatgcaaaagatagtaagtcagaattttatgccaatatatttgaaaatacagacaagaataaacaaactttttaacataaactaccaaatgtgactcaggaaaaaacaaagattttaataatcctataaatattaaaacatccaaataagtaatttaaaaatctgagacagaaaacactaggccccaatggtcttaccagcaaggcttaccaaaccttcaaggaacagataattcccttttacataaactctcaagagacaaatgaggaaatac

SEQ ID NO: 142375 - DNA, 782 bp, Homo sapiens
ccaccctccccaggctcccgttctcatccctttctctcaggggccagtcctccccagcgctgctttgtccctaagacttgtcacaggatagaaatccattttgcttggatttttcacagcaccaggcctcaaaaccattgagggcagctggggccatcccacacccaggttagaaatcactttcctgggtaaggagggaatggatggcccagctccttcccagccccatagcaggggatgcactcggcccatgaagcttcctgcagagaccaccatgcagagaccaccattcctcggggctgtccgtgggagaccttgtctgttcattccttgccatcattgagaacccacgaggagcctggctttgtgcctctcacgtgggtgcagactggaaccgcatcccaactctgcccccagaagctccctgttttgaggggtggatgggctgaggtgctccccaacaattacagagggggccaggcataccacaggggcatcctcacttgcttctgcccctcagccctgacctccctatcagactgcacacctgtcactcagcctatggccagttaacgagatgcagaaccaaaggatggactcagcctcccctccctcttcctaggagcaggtagttccttggccaagggtataggggcctcagagatggttcctggggccccagatgagggtccgcagcagcagaggcccagaaagtgaccagggcccccgccaggcatgcttcagcccagccaagctcctcactgcgggttgggaaagcgcct

SEQ ID NO: 142376 - DNA, 283 bp, Homo sapiens
gaatctcataactgatgagaactgaaggatggaaggaggctgttgacagctgttgacagcagggagacggggatgaggccaggctctgggaaagaggaaatgtggcttcagatgacagggaaaattcagagacaatggataaagacccaaaactccagaaagttctatcgagactcagcagaggggcatcctgtggctgagacagggcagaaagcttcctcggagaaggtgagaccaggcagggcaccaagaataacttttccacttaggatgggagacaggg

SEQ ID NO: 142377 - DNA, 279 bp, Homo sapiens
cttgaatccatatgttacggtgctcagttcagagctctttaccacattcaacaactgctcttattacacaattacattttaatcttcttgggaggcatgtatggtaattaaaagaatgggctcactgggcgcggtggctcacacctgtaatcccagcactttgagaggcctaggcgggtggatcacgaggtcaggagtttgagaccatcctgaccaacatggtgaaaccccgtctctactaaaaatagaaaagttagccaggtatggtggtgcgtgcct

SEQ ID NO: 142378 - DNA, 563 bp, Homo sapiens
gcaccccagcctggggagctagaacaagttgggatgcccctgtatctgtgaagagtatttgtgagtctcaagggaacagtgccacaagggaaaactctcttatcaaggtttcctccctaccccacccagagatttaaggaactcctctgttcaaatgcttttgtttctgtccccttcagattcttccagatcacactcttcccggtgtgaagttcaagaaataatttttctcggtgtttgtttttccatgcaggccctggctttgattttgcttttggatgctttccgttttctctaaataggagggttccaagtctagtgtgtgctgtctgcctgttatttcctgctgagaacacttggtaatgaagtgagttcctagtactctaaaacatgtttgtggctcaaaagcccatacctgctcatacctctgaagtcaggccagacaagagcagaggccccagctattcatgctgtgggcattttctcccagagctggactttgatgtctgcagagaccttctcttgacatttaaaaaccatcacaatgttgactgactagatgg

SEQ ID NO: 142379 - DNA, 486 bp, Homo sapiens
agtgcgagattaggaacgttcctcattatctcttcatgagatgatctattctgtataattgaatggctcgagtcgcgttactagacatgttaaatctcttgatatgaagcttcgccctcttggaatctctagaagtcattctatccttcgtgattaccttcataatcagccttgtgtcgagaactctaaccccaggcaagggggcaactaaatcccgaaagacaactaagtcacactagtgtacttcctattcatactttcttgcatagctagacgtagattggccggagatcctctatagtctagactagcatttcatacaagcttgagactgacagtcgttcatcactctgaagtcaggccagacaagagcagaggccccagctattcatgctgtgggcattttctcccagagctggactttgatgtctgcagagaccttctcttgacatttaaaaaccatcacaatgttgactgactagatgg

SEQ ID NO: 142380 - DNA, 494 bp, Homo sapiens
tactattttgatatacttattttatatattcaagttgaaaatcaaatttataaaatgtgaatgacagtcataatcttctgcaacccagataaaagttatagtttgctttagtatattcttaacaaaaaataatgtatgttactatgacacagttgccaaatctgaaaagaattaaatttatgtgaaattaaaaaaatacaatcgtatctgaaaccatagaggattgtttttgtttcaattttgcatgtttatttagattagatcactcaaaagtatttactttcatgcccttagactttatcataccttcatatttctaatgctgttttctaattatttttcagcttactgcaaaattcttaaaagttatcttctcaaagatagtttttactctgcatttaatgaatgttaccttatatattatgcagagaatgaaagataaattatactcagttatttcattaataaatgtcatcaagtaacaagaaagctgt

SEQ ID NO: 142381 - DNA, 393 bp, Homo sapiens
ctccgtggtccctgtcactaaggcttgaaagctgtatattgattttattatccctttgtcccttgggggcccatgccctgtaaagttgacgagtgcgggcagttctcctgctggtcctcctttgcactcactttcacagttctaaatcatgctatgagagcgtctttcttgaatttttctaactatatttcttggttctagattttttttccctctgttccaaatcattttccacacagctgctagaattttctccctaagatatatttgcttaaagacaataccctttttgcatgcagaacaagttaattcttctcatcctcagcatcagatccccttcctgtcttcatataattaattaccttccagtaaccttatcctgctccgtgatcc

SEQ ID NO: 142382 - DNA, 516 bp, Homo sapiens
gcattttgggaggctgaggtgagaggatcgtttcaggccaggagtttaagaccagcctgagcaacatggcaagaccacatctctataaaaaatacaaaaaaattagccaggtggggtggtatgcacctttagtcccagctacttgggaagctgaggcaggaggattgcttgagctcaagagtttgagactgcagggtgccatgatcaagccagtgtactctaccctaggcaacagagtgagatcccatctcagaaagaaaagagagaaaaggaaggaggaaagaagaaaagaaagaagaaatttagggaaagaaggaagaaatttggggaataacttttagtgctgtattaactgagagaatgtatgcagagcagtgctgagagcgtaagcattcaatgtatggagttgtcagtgtccttaagccagacaggtaaactgaggccaagctgtgaagaatcacctcttgttccacaacaggaaggctaaagctccaggacacactaggcctttgcttc

SEQ ID NO: 142383 - DNA, 129 bp, Homo sapiens
agtctcaattgtcttgagagcccattcgtttcaatgcaatcaatatttatatgccactttctgtgtgcagagggttgtgctagacacccaaaggcagggagtggttaaagaagaaagaataaaacactg

SEQ ID NO: 142384 - DNA, 323 bp, Homo sapiens
catgtcatcccaagctctgctctttccaggattagccagagagcctggaaaaatgcatcagaacttcaaagcgtaatgggtggggccccaggggactctgtggcagagacacagagacacagtgccatggaggtgatttacttatgatggggtgaatggcccaagggtacaagagacctaaagagaagtctctagttatatgtcgccaagctcccagcattttaatccgtgacttggataatgacgtggaagacaagaccaggtctgcagggaacataattgggaggggtagggtcagcaacagaagctggtgtctaagagat

SEQ ID NO: 142385 - DNA, 576 bp, Homo sapiens
cataaaagcagctaaaaagtctctgtccacaatgactggtgatgagtgagttcatggtaatacagttgcttcagaccactgttgagtgttaaccctgtgagtccaggagaaggctctcctctgggattgcttccagtcctcatgttctgctctaactttatttgatcttgaatctgtttattttaactattgtggccgccaagattattatattttaatatagaaatgatccataaagatgcatttttatggcatttaaataatgctctgcagtggttgaatgtctcaggaataccacagagtgtctgtgtgtatgtgtgtgttagagtgtgtgttagggtgtgtgttttagacaggttgtatgtgtgtgaatcagggtgtatgtgtgttagggtgtgtgcgtgtgatggggtgtgtgttttagacagggtgtgttagggtgcgtgtgtgtgttttagacacaatgtgtatgtgttagggtgtgtgtgtgttttagacagggtgtgtgtgtgagagacagggtgtgtgtgttagggtgtgtgtgttttagatagggtgtgtgtgagacagggtgtg

SEQ ID NO: 142386 - DNA, 622 bp, Homo sapiens
acaccagcctgtagatgagttagaaatgggactttgtatcttttaatgtgagacctcctcttgatcttttttattttttacaatattctgacgattctgacatgtttattttaccagatgaattttacagttaatagattcttcccccaaaaatatattgagaatttggttgggattctcttaaattgatatgactgtgaggactacagaattgcattgctttccagaaacatgttgccttgtttctgaaaaactttatatatccttcaagagagttttacttaaatcctatataatttgtaataaatatgttcctaggtaatacagacatacagggaacacgttgatactgcttattggagcttttaatatgttacctatgtggtcatttttgctatataggagaagaatttatttgcatcgattattttaaattggcaatttattgaaatctattaattttagagatattcatttgatccttttgagtttttccaggtgagaaatcctatcaattatgttataattatatgttttccttttcaaaatttataacataatttctgactgcatgggttaaacattttcataacagtgctaaataataaaggtggcagtggca

SEQ ID NO: 142387 - DNA, 678 bp, Homo sapiens
agatttaaaaattactcatttgaatgtgggtggttatgtagatctgtaagtatatttatcattgagtatatagtaagatttaacacattatttctgacaaccagaaagctaaaaaatgtatcggttttgctgaaaatctttaatagtcaagtttctgtgttaaaaattttagtagtttttgttgatataaggatatataaatacgcaaatggaaaaacttaatgtacatagtgtctctttcaccattattgacttttttttttttttttggtggtggtaataaatggaaatagtttagaaaaatatgagccgatgactacccaaaaataaaatttggtcatcccccagtctctaccaactgccaagtttatccctactgttaacaagacaatcagaatacatcaatatataggatttctgttatattttaggcctttattgagactatctagtataatgaaatacttcaaggtgcttaaatctgtggtacctagaatgatgagaaataaaaggtaacactattagtgtaaaggttatgctgcccatcttctgtcatcttgggtttattgatagattatgtgaataatgatgggctactcttcctcgacctctgtagcaggtgtcatgtattttttagatgaaaggtcatggaaaacccatcccctaccacataccaga

SEQ ID NO: 142388 - DNA, 553 bp, Homo sapiens
cagtctttgaaaatgtcatagagcagagtctctcggcctgcttctcgaatgaataaaagatgggcttctagaacccaaggtgatcttggcagtgcttggtgcagctcacatgaacctgtgaggccagcctggctgcctgccagaaatgaatgcctctcagtccctccctgaccccaaaccaaggtgaactccacttgaagcaatattgggagcccaatactggcaggaggggaacacagccagagtcactgtgccccctgccatgtccagcacccaagtgcatatcaggctgcaccttccctgctcagtcccacctgaattgaacacacagaccggcctggggcagcccaagtccaggcttccccctacttcccatggcttggtaagatggcagggtgaattaaacactatgagttacccggggtagagatactttttctccaatggtctttgaaaatgtcatagagcatcctaaagtctcacctggagggatcctgctagtctgctcaatgccgaacattcctgaacaactgtgtctttagcctctgcttga

SEQ ID NO: 142389 - DNA, 254 bp, Homo sapiens
aaactcctgacctcaggtaatccacctgccttgtcctctcaaagtgatgggattacaggcataagccaccgcgcccagcctaacctttttttttcatttatatttttcagcaccccacttaaaattttttttaaattctgattaagtatatataacattaaatgtaccatcttaaccatttttcagcacacagttcagtagtgttaaatgcattcatactgttgtgccaacaaacctctgggaccttttcatct

SEQ ID NO: 142390 - DNA, 383 bp, Homo sapiens
tctcagaacactatgcccaagtgcgtgcagtcacatacaaaggtaaccagctgtccttaagtacagtcgtcttgagcctttttaaattatgattgatatgtggttcatggtccacatattaatgaatgaaggcatggcaggtctgaagggtcgtgggcatcacgctggagtgtctgaggcatctggcatgcggatggaagcacctgctggccctgttggtgatgagtgccccttactgccatttctgcagtttgctgccaatatttgtggtgaaaggaaatggtaaatttcaggtagagggtggtgaaaacaaagatgatgttttctccctcattcaaggtcatggaccctgtgaatttggtttatgaccccagtggttaaga

SEQ ID NO: 142391 - DNA, 239 bp, Homo sapiens
ggtctgagggggtgagtgtggggctgtgtccctgtggatgggagtagagagtgagtctgaggggtgagtgtggggctgtgtccctgtggatgggtggggaggagtgagtctgaggagagagtgtggggctgtgtccccgtggataggagtggagagtgagtctgaggggtgagtgtggggctgtgtccccgtggatgggtgtggagagtgagtctgaggggtgagtgtggggctgtgtc

SEQ ID NO: 142392 - DNA, 415 bp, Homo sapiens
tttacctgtttgtgttcttggaaaggttcccagttgggtagatgacttcttagccattgcccctctcctgagcagaggatgctgagcttcctagcttcctgcagtaataattgcagtgcctcagagttgcacagcattctacagtttaccaggtgccttgaaagcatgcgttatgtcattttagccttgcaataaccctgtggtgtgggacttttcctagtgctaaggcatgggcccacacccaggttttgtatcctgggttctgtcaccggcctttctagacatgtttcttccatttctttttcctttcccctcagctaatcctcatgcctttgcttgcttctctcccgagtgggttctggtttcttcaagagctgtgaagagggggtcaggggaaggagtggggtgaagagag

SEQ ID NO: 142393 - DNA, 746 bp, Homo sapiens
atgaattgatccctttataattctataatgactttctttctcttcttatagtttttgacttaaattctattttgtctgatatacgtacagttgacccttgaacaacatggagctggggcgacaactcaccatgcagtcaaaactccacatttaacttttgactccctaaaaatgtaatagcctactgttgaatggaagccttattgattacataaagtagattaacacaaatatagaatggtatatgtgttatatgcaatactcctacaataaagtaagctagagaaaagaaaatgttattaggaaaatatgccaggcatggtggctcatgcctgtaatagcagctgttatagcagccaaaacggactaagacaactgtattgctgagacacagtgaaaggtcattcaagatcagggggtgacatcttaagtcctagaagtcaacaagtctaaagtgggtctcactgggctaaaaccaacatgttgaagactgtgttgcttttatggaggctctaggaggcattctctttcatggcctttcccagcttctagaggctgcccagattagctcatgagcccatcctactttttttttttgatacagagtctcactctgttgcctgggctggagtgcagtggcaccatctcagctcactgcaaactccacctcccagattcaagcgattcttctgcctcagcatcctgagtagctgggattacaggcatgcaccaccacactcggctaa

SEQ ID NO: 142394 - DNA, 223 bp, Homo sapiens
atattagattttcactagttgatggatgaatgaatgaataaattaatacatacaagaacaaaggatggatgacaaggtgagaaacggaaagagctataaaaagaaatgaggcttaggaaaaaaaaaggaagaaagaaagtggtgactcagctcaagagccatagaaacagcatgtaagagccacctgtgccttcacctgaccctgatttggggtaaactttcc

SEQ ID NO: 142395 - DNA, 672 bp, Homo sapiens
ctttcctcctgccctcaccccctccttaacctctggtaatcactaatctagagatttcctttttgggagtttttaaatgacaaattgtttccttaatagttacagggctctttcatattgagtgtcttgtggtttgtcttttttgaggaattagtctatgttgccaaatttatttgggtagaattctgcataatattctcttatccttttgatacttgtagtgatatcccatttcattacctccgatattggtaatttgtgccttctctctctctctcttttttttttggtcagtcttgctagacgtttgtcgattttattgatctgttcaaagaaccagctctgtttcattgatctttccctttatgttttcaatttcatttacttctataattatttccttgcttctgcttggtttgcctatatattgctctttttttttactagattcttgaagttggagcttagattattgatttgagacttttcctctttacactgtatgtatttcttactacacatttccctcacactgctttagctatattcaacaatttttgatacatgtatgattttattccgttcattatttttttaattcccttgagactttctttttgacccatgcattatttagaagtgtattgttccatttccaagttttcagagagt

SEQ ID NO: 142396 - DNA, 180 bp, Homo sapiens
tgtctgcaattgtgtttgactattttctgttggacaagaagtgtctttggaaatatgcaacccgtgatcaaaatagaagtgaagacagcatttggttgaatgatgacaccatttgtctagacatataggttacatagtcttctaaatatagcttctaaacatgaattattttcatataaa

SEQ ID NO: 142397 - DNA, 417 bp, Homo sapiens
ttcgtacgtccctccacagggctggcccagaaagcgtatggccggcctatctcccggatgcagcctgtcagagggagcccaaccaccccgaacacatagcaaaagaaacccggggaaggagccaatgatcagaagaggctcactcaaagccaaggacggggccctggtgagatgattttattccccgcccctccctctactcccaagaacgtgcctgcgaaaacaaggaaataacaaaaaaaccacagggctaagtaagagcctatctaccagccactactcctaagcgccatctattggactgaagcccaaactacaacactaaacattattctgctaatagatgccggaaaccaagagcaagaattcacccacaaataaagacactgtacagagccttggccctctgaaagcgcc

SEQ ID NO: 142398 - DNA, 347 bp, Homo sapiens
tattgacagaagtccccttttgtcagtaatagccgccgtctactggatgcccactatgagcaggccattctctaatcttccacatagtcatgaagatgggcattttcccattttgcagatgagaaaactaaggtgcaaagacaggttaagtggcaaagcctggatctgaatcagatctggctggctctgctgcactatggcagttcagcaagtgagtctctgggaaccttagagatgggaagatgggacatgtacacatagaactgtggcgcatggtgtcatgtggcaggcatcccaagggtggcaaagtggcataggagctcagagggaaacaccatttctgactg

SEQ ID NO: 142399 - DNA, 395 bp, Homo sapiens
cattttctttattgtcttggctattaacattcagctccctttacttatgcaaatttctgcagtcagcttgaatttcttccctgaaaatgggtttttattttctaccatacggttaggtttcaaattttccaaacttttattatctgcttcccttttcaatgtaagatgcaatttcagaccatttctttgtgaatgtatatgagctatgctgttagaagcagccaggctacatcttgaaccctttgctccttagaaatttcttccaccagagaccctaaatcagggatgtccaatcatttggcttccctggaccacaatggaaaaagaacaattgtcttgggccacacataaaatacaatgacactagtgatagctgatgaactaaaaaatattgc

SEQ ID NO: 142400 - DNA, 764 bp, Homo sapiens
cctttatatgtgttgtttcatattagcatacaaataaacatctattctttaaaagcaaacaatatacattaaagtgataagactaaaaatatctttgaggtcaggtgtgatggctcggctcacacctgtaatcccagcactttgggaggccatggaaggtggatcacctgaggtcaggaattcaagaccagcctggccaacatggtgaaatcctcatctgtactaaaaatacaaaaattattcaggtgtcgtagtgggtgccagctacttgggaggttgaagcaggagaatcgcttgaacctgggaggcagaggttgcagtgagccgtgaccacactactgcactccagcctgggcagcagagagagagagactctgtctcaaaaaaaaaaaaaggacaagaaaagaataaaagaaaattttgagtagctcccatgacaaggtcaagggagcaattacaaagctaaacaatggaagggcttttgatgggtgtggttttgcagcagaagggctgccccctatggtgaggcatgatgctggattttccagaggtcagagatttggatttctccaccaaattgtagaagctttaggtaaacagacttgttctaaaagaacatgatgagcatgaaaaatgtttctatgaagatattaccatagcttgagaaagaaatagaaaaggtctagtatttcttatattctcaaaaagcaggtaaaagaaggcctaatgttgacgcttacccctgggcaaactcaggcatgaac

SEQ ID NO: 142401 - DNA, 553 bp, Homo sapiens
acccagcctcgttagtgtccctggcacctcaggacccggctatgaaaagcaggctgcttcgcccttaaatgacggaagtggggaggtgggcgaaaagggggccgcagcgttgtttagactgcagaaatcaactactatcgttaaagtttagggatcatcacaaaccaaatctccaaaaggtagcctagaaagcagtccgcgtatgagcatcattttaaatcacagtcttgagctggctggaccccgcggctgctcaaactccacacacggttcgcttggctaccgcgcccgtgaacttggaggcttggaagaggcacagtcaggcggcagaccgcgaattttccctctttccaacccaaaagtttgctcaatgaacctctggcctaaagacaatgctccggggaacggttcgcgtgctgggtgtttcgcttcgagaacggcggtcccagcttcccgtgaggtggaggtcacgctcagctcccgggaggcggcggcgcgcctgcgtcccagggaacagcaagccggggctctgcgccccacacccggcggccgc

SEQ ID NO: 142402 - DNA, 347 bp, Homo sapiens
gactatataaaaatgctgaaaattcaacttagggaaagtaaatggtgaatctaaggatgctgatactcgtatgataacctggagttctgtaactacgctaaaaaagcaggaatctaaagctgtcacattttctttacaaccaacaacaacaaaaaaatgtgtacccgtctgtctgttttaaccaccacttctccaacttgaagaaaaaagggagaactagcaagaaatatttatctacgattcgtgcatacacctgaccaaagtaactggtgaacttcctcatttgtgattttccgcataatggaacaccttatctgatggctgttttttttctcattcttatgggt

SEQ ID NO: 142403 - DNA, 499 bp, Homo sapiens
tggccggtccttcttcgcccaggctgctgtgtgtgaacttcctgcagcctatgtggccctctctccatttccagcgccatggccccgcttttggccccagtcctctagcttcccatctccgtccttgtctagtctcatctccccagtctgtttgattgtttgtttgttgctgaggcaggagaatcacttgaacccgggaggcggaggttgcagtgagtcgagattgcaccactgcactccagcctggagacagagtgagaccctgtctcagaaaaaaaaaaaaaattagccgggcatggtggcgggaacctgtaatcccagatactcaggaggctgaggcaggagaattgcttgaacccgggaggtggaggttacagtgagctgagattgcgccattgcactccagcgtggcgacagatcgagactctgtctcaaaagaagcagtggcgtcgtctgtggtttctgtgcgccctgtctgctgtgtgtgaacttcctgccc

SEQ ID NO: 142404 - DNA, 451 bp, Homo sapiens
ttaagtagaaaaaaaaaaattaccctagtcccacagattgaactttttctgagatttccttccaacctttttttctacttgcagtttttcctcacatagctgtggtcattctctatgaagaattttgaatttcgcttcttcccattaacacataagcatgttctgtattatgtcaaatctttcataaacattttaaactaccacatagatagatagatgtgatatagatgtatttaaccacatacctattgtttggacatttaggttgtctcactattataaatagcacagtgatgaatacctttatgggcaaagtgttttctgtatgtaatacagaatcccaggatatggattcctgagtggaaaggagtgagcacgtttaaggtttttaacacttacccaaagctttgactttttcagagcggctgaggtgtgagtctgtatccagaaa

SEQ ID NO: 142405 - DNA, 272 bp, Homo sapiens
gaaataagcttgagaatgcaaagagaatactatatagcattctttttgagattgtccttgcatattcgcacatgaaaagttctgctagaaggagagccactcagtatattttgatcagtgtgttaaaaatgtatttgcccaccaagcctactttcagaaggtctagtaacaatggcatcctgtgggagattctttgggaagcatcgattaaacagacctggaaggtttgggtcgatgtggaagcggaagcattgtgtcctctgcccactccc

SEQ ID NO: 142406 - DNA, 620 bp, Homo sapiens
agaggctgactctacaggatctttctaaatggctgtttccatcagcatagttgtaaggataaaataattgtagaacactttgaatggtacctgtgtatatacagagtactaaatcatattacgtaaaatggtgtggtacagagtataagtgctggaggaattcagaaatggggaaggtaagttgagggatgtgtggtcaggagaggcttacttggtggggcttgaaatgggtttgaagatttgagtcaggctctaagagaacaatagtagatgtgtgtccagacaaggggacaatgttgcataaggacgcagaagaaattgttatgtcctagactctgtaagggaacttgactagggtaaatgggaaactagattgaggtatgtgattttggggatgggaggttgagggatatttgataaattgggcactaaagattagtttttatacatgggggcaccaggatactcatttgggccactagggatttctgagctgtgaaatgaccaaagtaacttgaagttcaagcagatgagtcaagtgtggatattcagggtgggctgaagtgaggagctgtggcacgggtcggaaagccagccaggaagccgtactgatagttcac

SEQ ID NO: 142407 - DNA, 208 bp, Homo sapiens
tgctgggattacaggcgtgagccaccgcgcccggtcccctctggcattttcattccacacctccttctcccgagattacaaggaagttaaattgccaaacttcctggttcatgcaaagttaagactgtccattaaatagacgccagagaaaataaagtctagttttgaagatttggtatcagcatggctcaaagtacttctctgtctc

SEQ ID NO: 142408 - DNA, 312 bp, Homo sapiens
ctgtatacgtgctgctgtctgccaggaaaaatccctgcttcctcccacttgtttgtctttcagatctcacctaaggggttattccaagaaaagttccctaacccttgtctcccagtctcctcaagtctgtgaaggatgtttcttttttatcctcctaagtctgcctatgacttacccaattatatttttaatatattgcacagttacttgaatgcactggatttttgaatgtcttccccttataagatttccttaagaagaggaacttttgtatgaccacggtagcagtgtttagcatacaacaggcaactg

SEQ ID NO: 142409 - DNA, 228 bp, Homo sapiens
aatacctaaaaatatttgctcttatttagggagcccttgccacatgcccaagctgggcagatcgctttgtacgtgttgtcttgtgtgagcctcacaaggaccccatcaggtcagtcctgttgttctcatcttacagatgaaaaattggaactcagtgaggtataataacctattcaaagtctcaaagccagtgaggaatagaacaagggttaatgcaagtcagtctgg

SEQ ID NO: 142410 - DNA, 592 bp, Homo sapiens
acaaccggtacatacattgtctgatgacagggattttgcactccaagaaatgactatactttttgccctgaccttcagcctggaagactccttcagaaatataaataggccacagaagttaactccctctgccttgagattgaattcattctgctctctgaatacgtgtatcctgatctcagtgcacatgacattttagatttcagatcaacacttgcttcaattttccaattcagaatggtagaacttcaaaatttcatattgagccccgattattcacatacccaattcccataatataaggtacttactttccaaaagatcataagcttatttcaaaattagaccatttctttatctgtagcctagtaactgtaatttgtggagtacttaccatatagcaggagtattccatatgactttctatatatgaaaaataagaaaccaacataggaggttttttttttccatgcttattggttaaaaaacaaaaacaaaaactgaggcatatgtcaattgcacaaaccattcaaataatgactgctctgggattctagtccactctgtgtcatcaccactatggaactttgca

SEQ ID NO: 142411 - DNA, 782 bp, Homo sapiens
cacccacatcctgctgattggtccattttacagagagcatattggtccgttttgacagggtgctgattggtgcatttacaatccctgagctagacacagagtgctgattggtgcatttacaagcctctagctagacaaaaattttccaagtccccactagattagctagacacgcgtttacaaacctttagctagacacagtgctgattggtgcgtttacaatcctttagctagacacaagttctccaagtccccgctagattagctagacacagagcactgattggtgcgtttacaaaccttgagctagacacagagtgctgattggtgcatttacaatcctctagctagacataaaagttttccaagtccccaccaggttagttagatacagagtgctgattggtgcatccacaaaccccgagctagacagagagtgctgcttggtgcatatacaatcctccagctagacaaaagttctccaagaccccacccaactcaggagcccagctgacttcccctagtggatcccgcactggggctgtgggtggagctgcctgctagtcctgtgcctcacacctgcacacctcagcccttgggcggtcgatgggacgggcagccgcctgtcggggagtctcgggctgcatgcgagcccatggcggtcgggggtggcttgggcatggcaggccgcaggtcccaagccctgcctcatggggaggcggctgaggcccggtgagaattcaagtgcggcgtgggcaggctgtcagtgctgggggacccgg

SEQ ID NO: 142412 - DNA, 477 bp, Homo sapiens
tttatagtttattcctagatgtctcagtccagatgtggggagtcattttcatcataagcaaagcagcttagtaaattcttgacattccatatctatctgattttactgggtaaagggacagagagttacctcaatatcatgtttgtccgtaaagaggagaaagggttttattactcttttactcacagtaatgttggcatttaaaaaattgttgcccatctgatggatgtatagtgtatctcaaagtggtcctgatgtattactctttgctttttattattttcttccttctgtgtttttcaaacttaattttctgttcattttctaacttactggaggattggccattgattattagccgccctttcatttaaagctatcaatgtttctaagtatggcttttggtatattccacgaatttgatatgccatattttattatttagttcaaaatattttctaagtgttttgtgatttt

SEQ ID NO: 142413 - DNA, 326 bp, Homo sapiens
accatcatctcgtttattattgtacacaaaaatatatatattgggtcaggtgcagtggctcacacctgtaaccttagcattttgggaggccaaggcaagaggactgcttaagtctaggagttcaagaccagtctgggcacaaacaaacaaaaaagccagacatggtggtgggcaactgtcgctgcagctcctcaggactcgggaggctgaggcaggaggatcgcttgagcttgggaggtcaagactgcaataagccatgatcatggcactgcactccagcctgggtaacagagccagaccttgcctccaaaaaaagggtacacaga

SEQ ID NO: 142414 - DNA, 713 bp, Homo sapiens
ttggggagacccctgaggataaaaatagtccttatgatttgaatagcaggcaggttgccaattgaagagactttggtagaagtgagccataaggagggagccagagttgttagagggaaggagcaagaaaccaggagaagcttttgggaatgtgatgatgttaggtttccagataaatattatataacgtattaatataaatattgtatcacaaaaataagctcattatcatgaatctgttgatttatattttgtgatttctaagtcacgtattggtatttgcccctgaaaatggtaaggtatcctaaattaagttattctaatgcataatcacaaatgagactatgtgaaatgtgcagaagtataggagctaatgcaagctctgtgatggcagggaccattttctttgttcactctttaagtcttagcacttagcataagcctgacaataaaagatgtcgaataagtatttgctaatagaattaaagtatctacaatctaaggtatttattttataactatctcttcagcagtgttgtccaatagaaatacaatgtgagccacaaatataatttaaaattttctagtgccacattaaagaagtaaaaggaaacaggcaaaattagttttcataatgcatttaagccaatagatctgaaagattatcatgagtgactttacgtacttttattcatattggacagcgtagctct

SEQ ID NO: 142415 - DNA, 180 bp, Homo sapiens
tacatttatctgagtctactctcttctgaaacctcactaaaacgacagggaattttgtaaagagtttacactttccaggacatgggatcacagggccggagggcaggcagggaagcagccaggcgtgcactggtgaagcctcaccagctcaggtcagggtgtccacaggtgcctgtggag

SEQ ID NO: 142416 - DNA, 509 bp, Homo sapiens
atattgcgtctgagtcactgaaggaaaagaatgtggggtctgtttgctgggactggacacctccataatcacatgctccatgaaatgcaggcaggagatctcgctttctacctctgggatgggagtgtgcagtttcagaatgagactagcccacacaactgactatttgggaaagagaaatgaaatcagatgcagcaatttaatatccactaagatgatatcttaatcacaaacactcttctggtttttagaaatgtgaatgttatttacactaggttaaaaaacctgaatatccaacagcatgacaccgactaaagaaatactggcgcactctggaaccttgcacaccacttattggcatgggaacaatgggaacacgcctatgcaaagatgtgcatggaaattagaagaatgcaacactgtagaacagatgtgactaggtgcatgatcaagagcacacaagaccaagcctgcctctgcacacacaagacagcgcctgagtctgcacc

SEQ ID NO: 142417 - DNA, 501 bp, Homo sapiens
cacgcatagagcagaactttctggaaaataacttaaacaactgcttgagagtttaagagaaggaagggaacaaaaagtttaaacagattttattacaacaaaatacagtataaaaccccaatccagagccaggcatggtggcgcatgcctgtaatcccagcatttgggaggctgatgcaggagaatcgcttgaacccaagaggtggaggttgcggtgagccaagattgcgccactgcactccagcctgggcaacagagggagactccatcgccccccctcaacaacaaaaaaagtttcccatacactggcctgccccaaaacccactaacaattttagcaaaacagtccaggccaaagaggaagcatttcatgtccaataagaaacccagccattccgcatggccggttcctgagtggctctggtgatactctccagccacctgctgacattgagaatctcagacctcgggactgctgttgcggtaccgtgtgtctgacac

SEQ ID NO: 142418 - DNA, 305 bp, Homo sapiens
aggatgaggacaatcagaaaggcctgttcattttgcatcctaagcatctctcaaatcccttcgcgccatccccagtcccctcattcaggctgggatattgcaacatcctccagactctatgtacccaattgttaattatcgactttctaaaggagatttgatcctgtccagcacgacatagagcatgcaagcgttcctcatggcctgatagcttgtgattctctatgtgtatgtctgatggctcctgttatcaagaaaatcatgtgtgagatccctccgttcatgatcctccttggcgccatttg

SEQ ID NO: 142419 - DNA, 241 bp, Homo sapiens
ccagcactttgggaggctgagggaggaggattgattgagcccaggagtttgagaccaacctatgcaacatagtgagataccacctctagaaaaatgaaaagaaattaaaaaaaatagaaggaaaaagtaggttcagggcattcaagtggttcaagttcaacttattataaaaaatatacaaaattagcctggcgaggggatgcacgcctgtaatcctagttactcaggaggctgaggcagg

SEQ ID NO: 142420 - DNA, 1019 bp, Homo sapiens
cacagtgttcatgtgtcatggagccatttttgaatcctgtgagagacttcagtgctgatgatcggatgaccagaccatcaaaccatgctggaggtgattaattaattaccattctgcctctgccccgttttgttcaatacttcagagaaaaaaaaatacaaagatggtgttctccatctgaacttatctgaatcaggacaggaaagacccaggacacagaccctttccccagagaggagagaatacatctctacatactgctgcccaatcatcaagcccagtagttgccaaaaacaaaccaaccacctgatttccctgggcctggagtgtttcagaatcctctgccccacttgttctgccgtgtattaactgcagagctgtggcaaattgcaaggcactcattggcgatacacaggtggacatgagcttgttaacagaatgcagtaattgacataccgtgattcattatgcacagcacgaaggactctagtagaagcccactttatggccaagagctgctggcaccaccaaccttgagaatttgttcctggctctgttctgtctccccagctagagagcaccatccctttaggggccagaagcagtctgtggcttcagtcttatctgcccctacctccaggcaaggagtaaggatacttccctggtcccaggctgcatgacgttggagggagattatttgttcattcattcactcaacaagcatttaaaaaaatctggccagtaatgcagtggagaacaagacagatagttcctgcccttccagaacttaatcacctggtgactatcagaactgcaaatttctaagcacccaattcccagttctatagacctggaagtgggccctctctggaccttagtttctttatcatcaaatgagtagaaaagagagaattgtattggtcaatctcttttagctctaagatttcagactctgtggttatggattataaacatgagtcacagtatcagtcttagtcatttgtatccaatgccaaagg

SEQ ID NO: 142421 - DNA, 270 bp, Homo sapiens
tgtctattgtgtgccacttcctcctctgccaatagtcccataatcgaagcacgtgtcactgaggggttgggcagaagagagaggggcttctctgcagaactcagaagctggtgcccttgagcagagctctggaggacaggtgcatagttgttctccaggtacccaggagctgcctgtggaggagcattccacattctgtgcaggaataggggttagcatttacagagtcatgaagagtaagagagctacagggggctgggtactgctaga

SEQ ID NO: 142422 - DNA, 222 bp, Homo sapiens
aactacggtggtggtgggaactataatgagttcggaaattatagtgaacaacagcaatcaaactatgaacccatgaaagggggcacttttggtggaagaagctcaggcattccccatggtggtgaaagtggtggatatggtagcagaaggttctaaaaacagcagaaaagggctacagttcttagcaggagagagaacgaggagttgtcaggaaagctgtag

SEQ ID NO: 142423 - DNA, 257 bp, Homo sapiens
cagagagcaccccagcaggggagcagtcttcagtcgctgcttcctctaaacagggcgtcgagtgagaagcagcctcctgaacacatgcaccaacatgaatgtgtctgtaaactcctaattgagagtgataagccgccaccagactctgaagggcaggcgtctttgtaggtcacaggttgccgagaaagctaagctcagtgccgctgattgacacttggagcagttacattgttctgtggccttcgtgggttactgtg

SEQ ID NO: 142424 - DNA, 736 bp, Homo sapiens
atggtgcgtgcctgtaatcccagctactcaggaggctgaggcaggagaatcacttgaacctgggagatggaggttgcagtgagccaagatggcgccactgcactccagtctggacgacagggtgagactctgtctcaaaaaaagaaaaaaaaatttttttttatatcctctgtagagttatgcaatttctcaacagattatttttgtggctcacttatgtcttagacattttaagatcttttccctcaggacaggactttctttaaatatcttattgatgtatttacttttaagggagaatgactaacatgaaaaattttacatttctccatctaattcgtattttgtttgttacacactacaatgtaagttttttgacaaggttttatatgtatgttttcatttcatctgtcatgtcaggcctaaactcagtgtacagaattctcaatcttaaactttatgaaagctcatacagctattcaatctatatacttattttcagatatagttacttcggttaattttttaaccaagatatttcaatcataaacaatcattttatgtttagtggtttatctttttctttcaatattaaatattcaggttgtatacttcagtattgtgaagtgtgtttgagtcatggccatgatatgaagatcagtgtactatcaaagaaacttaaaaagacagcataggatgggctttagatccagtctgttcctatcacttgtgagac

SEQ ID NO: 142425 - DNA, 270 bp, Homo sapiens
gatggggaagctcctaataccagctgtctctctgccgccatcccccaacaccctcaggaaggggcacctttctgggcctgcctaaaggagggagcatgggtgtgagggctgcccaggcaggtgggagtacggagccttgtggggcagggtggaggcgtccaggaccttcctaggaggttttgcccaactccccctaagtgatgacaggtctcaggagggggccgcccccacatatgggagggagaagcttattttcccagcttggggtgg

SEQ ID NO: 142426 - DNA, 419 bp, Homo sapiens
agggaaggacagggagtagataggcactgcatacctcttatcgctaaggcgttccatagcccttggctcactagcttctctgactaccttgggaaacaggcatagtcactctacttgatagataagaatgctgaggctccgaaaaaggaggagacgtgttcgaggtcacactgcaagtgagcagcagagccaagatctgaaaccaggcaagctgtccttctaagcacaccttctatttctatggaaaggctgcatgggaaccaggacccagggagcagccctcttcagagagaaagttctatgctaacttttagggcctgctattaggtagattctggcctgctcggttaaatttactcttgttgggggtaagtgggaagatgactacaaggaaggaacacagcaagaatcccagcctc

SEQ ID NO: 142427 - DNA, 492 bp, Homo sapiens
aaggctcccatatttacacctccaaactcttccctgaactccaggcccacatattcaactgcccacttgacatgtccagctgatgtctaccaggcatctcaaggttaacaaatggaaacccactcctcctgcagtgaccccatcccagttaatggcaactacatgcaccccagtcgttaagccaaaaacctgctgtgattccttgattcttcctcacccctcacatatccagtctgtctgccaatcctggagattagactccacctactggcccatgggagacaattatagtaatagtacttaaggaaatggaaaaaaaaaaaaaaaaaggaacttaaggaaatgaataatacggtcagcaaaaatttagaggtgaggccagacacggtggctcacacctgtaatctcagcacttttggaggcaggtggattgctggagtccaagagttcgcaaccagcctggccaacagggaaaattcctttttttacaaa

SEQ ID NO: 142428 - DNA, 652 bp, Homo sapiens
gaggctctagacagagagccccagagccaccagaggaaaaggaactcgagagaaagatggaggagcaaacagagggaggggaagggggcaggaggtgcagctcccccaagagggggggcaggaggtgcagctcccccaagaggggtggcagccctcttgggaagatgaggacagagccccagggaggcctggggttggcaaagggagcctgcagtttctttgtgggtgcgggggcctcaagggctacgagtctgagctgtgcgtgtgtttggacaagtccccagagtgtgtgtcttcctggggttcctagactgcgagtggcagtggcccggcggcggaggccgtttggatccctgtgtgagctgtagggggcgccctgggcgtcgggcccaggtcaagtgcgagataggaacggggtgcgggggccgatgagagctccccgcgggaatgtccgctgtggacgccctcggaggccccatctaactccagggcggagagcgtggccgggcccagttcacgggctgctcgagccctgacgaggcagctgggggctgtctggcgtccacgctcacgttctgggccggcggaccccgtaccggccaggccgtggcggccacgggggcccggaagcgccgccgccagctggccccgc

SEQ ID NO: 142429 - DNA, 463 bp, Homo sapiens
ccttgaaaagagtagttcactggacataggaagttagcactaacgtttggggcaaggagagcttgttgtagtgtggaacaatgaattaagaatcgtaaagcctgatgtcgggttctagctgtagcataaatgtgcttgccctgatcacttgtctcttaatctctggtccttaatttagaatatgtgagttggaggatctccaatatctcttccaggaccaaaaagtaaaggattctgatgagtccccgtggttgcaaaacataagagtaaatatacttaaatatataaagttaatagtagatagatatacttggattttttaattcagttgccttactcaatatcttacctttttcatttgataaatattgagcatctactatgtggcaggcaccaatctacatatttggatgtttaataggccgtgtaagtacaagacaactttcgtgttcttttttttttt

SEQ ID NO: 142430 - DNA, 229 bp, Homo sapiens
caaggaggtaaggcccctcccaggtcccagaacctccttcgctgaacatcccttccagcacatccatggcattcctgagcctgtgaagatcagacaggctccggtttcaggtagcaatccctccctatcccagtgctttatgctttgggtgagcctgaaaagtccttgcctttttcatctcctccaggaagcccatgagcctccagaggcaaaaaggtatggagtaggt

SEQ ID NO: 142431 - DNA, 271 bp, Homo sapiens
aatgaacgtataaagcagattggaccatctcgggaatcccaccagatcggttttttctcagaatcttccacacagcatttagccttaggaatatctaagaaggataactttcatggtgctagaaatcgtaatctgtccttgatggaaatggcaatgaactttttgcagattggaccatctcgggaatcccaaagatcggaaactattttctttctcagaatcttccacacagcattgagccttaggaatttctaagaaggatctggaatga

SEQ ID NO: 142432 - DNA, 717 bp, Homo sapiens
agaaataatgtgaagctatatataggaaatgtttttaaggaaatgtttttaagaaggtatgggcaaagaagcctgaacaaagtggtggtttaaaatgtatttccgtcctcattttataatctgtttaatgaggtcaactatgtcaggccctaaattcaggaggtttcaatatgactttatatgggaggatttttactgtggtaggtttaattgccagcccattctccattctttcctatatcattgctccttttcatgtagttgtacaattcttacaaaggaatctacttccctgactctcgactttgaactaagtgacttggtttgtgcaattgacacaaccaagggcttacagcattaggcttgtttctttattcactgctaggtacctgaagaagaatcaagttgctgagcttaataagtggattactgagtctgtccaactgaggtcagaagagctgccctctctgattaacagatgcttgagaggaaatgtttatttttaatgtcactgagattgtgttaattgtttataatatagcaacagttgactgatacagatgcattaagtacagtttgtgccttccagtgaataatgttgaagtggtacaattatttatacaatactatttgattatgacactaaggcaagtatttaaaaagtactttctgagcacacatgtggaaatgcaaactcagactgtctccagcattgta

SEQ ID NO: 142433 - DNA, 410 bp, Homo sapiens
gtgtgtgtgtgcgggcacgtgcatttgagcccaggagttggaggctgcggtcagctatgatcgcaccactgcactccagcctgggcgacagagcaagaccctggctcaaaaataaaaaataaaaagaaaagaaaatggcaggacagagaggtgaaaagacaagtggaaataggatccagatcactgcctgagggctgtgcagtggtacagaatcttctcattgagaaggtgaccttgagtaaagacccagaggagagggagggagccaaggacctttgggctgacaaccatccctccctcttcaacagccacagactgactccttcacttccttcagctatagctcaaaggtcacctcctagagaggccctccctggccaacctggctcaacgatggccccatcccccgc

SEQ ID NO: 142434 - DNA, 356 bp, Homo sapiens
aatacagtaaagacatacaaaatttgttgacagagttgccttcccttatattcctcttcacaggaattataaaatcccaaactatagcattctctgcagctttgaaaaagactattatattgtttttattatacatagaaacttcacttttttttcatatactcaaattacaccgtttgtaatattggtactagaaactacaacaacttcttattaatctgttttgtgtggcatgtagcattaccatatctgcttcctctacactttagtggatagtattaataggccactctcatttctgaagctgttactcctcatgccttagtatctccttttactgtagcagaatatgacac

SEQ ID NO: 142435 - DNA, 273 bp, Homo sapiens
taaatgtcactttgtagagcctttttctgataacccaccctagtgagacacactgtctaccctcattcactctagtcctgttactctatttttttttaattgcatttcttaccacttggcatatggcttactcattcattcagatattaaatgcctaccctgtgctagggtgtagggacaaaaacagaatctcagctctaatggagctttcattctaagtgagatgatgagtagatgcccaagtgaacttaacctaggatgtttgctttacca

SEQ ID NO: 142436 - DNA, 407 bp, Homo sapiens
gaactttctacccctttacagcacgccgaccacagccagctcagccttttctgatatatttacaactacaaaagataccgttaaaaaagaaaaatacctgggtgcagtggcttacgcctgtaatcccagcacttggggaggccgaggcgggtggatcgcctgaggtcaggagttcaagaccagcctggctgacattgtgaaaccctttctctactaaaaatacaaaaagtaggccaggcgcgatagctcacgcctataatcccagcactttcggaggccgaggcaggcagatcacctgaggccaggagttcgagaccagcctggccaacatggtgaaacccttccctactaaaaatacaaaaattagccaggtgtggtggcacacacatatactcccagctattcag

SEQ ID NO: 142437 - DNA, 116 bp, Homo sapiens
agtttcacaattaactacttcctgattttaagatgatggctggtacaaaataaacccattccattttattataccatttcctttttgagagaagtcaagcatcaatgaagatctgt

SEQ ID NO: 142438 - DNA, 287 bp, Homo sapiens
tcaagacacagcctattgctgggattctgcctgataaaggggagatatggagctgactaggcaagaattgtcttcccttagaaggtgtggaaggaaagagcataaataatcacacctagacgataaaaaaaaattagccaatctaatcctcatattaaccctgagattataaagatccttcaccaaattgtagtcatgaggaaacaggctcagagggaaaatgagttgcccaaggtcacgcggccaaatccaacatttgaatacaggccctctggttctaaaacttg

SEQ ID NO: 142439 - DNA, 752 bp, Homo sapiens
acagctgttgtttatttaaacaataacttaaatgatttgataggtagaatatcttagctggtgagttcattgcatttttttttttaaagaatagaatggcaaataatgagttagtggtcataggaaagttaaacttcacttatcctataggctgagggactgaatcctagatagctggacttcagtctagtaagtatataactaggtaagtatataacaatgtaaataaatatatataactaaatattactctatatatactgtataaatagctatataattatatataactttatatataaagctacatgtttgcctctcagacttagaatgtcaaccattttacataaaatattttgaaacaaatctttcatcttaatcagatcaaaccaagtataatttgatcttttctagatgatttaggatcaacattataaacatttattattgtactacactagagcaatgtgaggcctacctgccagaagctatgaaaagtttgcattctgacctttccacaagagggccacaggggagtgcacccttgcctttatctgctttcaatattccttattaccctgttccttaccgcaacttttttcttaacttcttcatttgcttatttctcattgggctcatcagactaagtcaatgcttaaggaacttaattttattaaacccacagattcctcagggtgcggtggctcacacctgtaatcccagcattttgggaggccaaagtgggcagatca

SEQ ID NO: 142440 - DNA, 572 bp, Homo sapiens
caaaggctggaaaagtagatcagtcagctcccacagggccttgactgagtgtgacattaggcatggagggccactgaaggttttaattcagaggaataagataagacctgtgtttccgaaggattaatttagcagcaatatagagaccatccgcaaggaaattggttacaaggttattacagaggtctggttgagagacattgagggagacagttggggaggaggggaaaggtacgcattattatggaaataggatgagtacaatttagcaattaagtcagaggtacaggacaaaggggaatttgcaaagacccttttaaagatttgattgaatggtggggaatatggttgtaccatcagcaaacagcagttacagggtggggaagaaagaatgggtttagaagaaaaagggatgatttgagtataaattgtattacaggctggggcgtggtggctcatgccagtaaccccagcactttgggaggctgagaagggtgtggatcctttgagctcaggagttcaaggccagcttaggcaacatagtgaaactctggtctctacaaaaaataaaa

SEQ ID NO: 142441 - DNA, 618 bp, Homo sapiens
ctggcctggtggtatgggtcctattgatgttggggaattccttctgccacaatcatttcacttatttcttcctatactgtttcattatagctaactccttcagtctttaattctttaagttgctaatcctttgtgactattttctataccaggtaatgactacagccatttctgtcttatagttaaagggtctacaaaagaatcaacttctgcactcctgcagaaatcaaaacccatggtatttgtgcaagaagtatgatagaccaataaatgaagtgcctttgggtgaacgtctctgagatcaacatgtgcaaatacctcatagctctatttgatttgcttgttcaccagtacttttggagcagaatgtcaggagtatgtgaggaagtaaagaagacacatgagatcccagaccatcaaggagcttgcagtgaaaacttgcaatgccagtagagtgcgatctattagtgggttctgatggggagagtaggagctttacaggaacacatagaaggcagctaatccacactgatggggtggggaaagggcttaaggaggtctcccaaggaagagacgtctaaattgacagctgaaggctagtctgttgatgttagctgg

SEQ ID NO: 142442 - DNA, 261 bp, Homo sapiens
ataattcctagaacaggtatactgaacacttggcgaagaattcacaatggaaattagaacttttttgaaataaaaatacaagatatcaaaatgcatagatgtcactaaagtcacaaaagtagtacttaggggaaaattatagcactaaacacctttattaggtaacagtctcaaagcaatgacatcaacttttcaactagaagaaaaaagaagagcagtaaatccaaaaggaaataatgatcagagcagaaatcaaatgaa

SEQ ID NO: 142443 - DNA, 456 bp, Homo sapiens
cctgagtagctgggattacaggcgcccaccaccacacgtggctaatttttgtaattttagcagagatgggatttcaccatgttggccaggctggtcttgaacttttgacttcaagtgatccgccctcctcggcctcccaaagtgctgggattacaggtgtgagccacccctcccagccgacattggctttttaaaatcctgttttggttttttattgtgagcatgctgcagtgagcaatatggtgatcactagtgctgtttggcattactaccttggtttatgctaaggtgcagcagtttctctccactgctcttgcattgtcagtgcagaagggagcaaagttgaaaggacatcacattttaatgtggtgcaaagaattttgaccttgcagacccccttggagcaaggctctggaggcctctctgtctcccctagttctgtggaccacagttgga

SEQ ID NO: 142444 - DNA, 140 bp, Homo sapiens
aaccctttccctgacccctggattatagaacattccagacaacattttcctagcataagactttagctttctgagtcaggaactcaattttctttagaccctaaaaatattgtcttaaatttttctaccattagatttct

SEQ ID NO: 142445 - DNA, 127 bp, Homo sapiens
ctcgaattcaagcttctaacgatgtatggggacatgaataatacgtagtttattagtctatacccagtgtacctctctgtgtgtctctgttgattctaatgcttgtttaaatcagtggataaaaggg

SEQ ID NO: 142446 - DNA, 676 bp, Homo sapiens
tgccctggctggtattgaactcctgggctcaagtgatcctcccgccctagcctccaaaagtgctgggattacaggcatgcgccatggtgcctggacaggagtttatttttgaccctgttaagtttgagatgcctgctacacattcaagtggagatgttgaataggcattcaattggtcatgagtttggggctcatggagaagtttatcttattattattatttctttaaatggagtttcactgtgttgcccaggctggcgtgcagtggtatgatcttggctcactgcaacctccaccttctggttcaagcaattctcgtgcctcagcctcccgagtagctgggattacaggcacgcgccaccacacccagctaatacttgtattttagtagagatggagtttcatcatgttggccaatgtggtcaggaagtttatgtcaatttgggcatcatcagtgatacatgcagttgagctatattggacacatggccaattgacctcacagtccgcagggcttgtccccatgtaactgctcttctatccctatgcaaattcattttgtagatgctaacgtttagcagctcattgttgctgttgaaagttcttggaacactttcgtagtctgaatgctagaaaggatgggtcctaggaatgtcctctaggttgtggcagatcc

SEQ ID NO: 142447 - DNA, 524 bp, Homo sapiens
cagcaagcatgaccgtcaacttccgcaattaaaaaaaccaaactctcactattgaggaagaaatacataagaaatggagtcaacaaaaactctctgagggcaagtttcagttgagagggtcccactgttcagcacatgaagagtctaacaacctttgcttcaacttaactgggtacattggaatttataaaaaggaacaattaccagagtgacccaacagatggcccattaaactctgggattcgtacaatgtgtctggtgacctatttcaaggaactggttagaaacctcccaattggccaacttgtgattaaaaatacgagatgtttgcagctgaccttcaaatctaactctttctggccaatctaggcagaaataataagagaataaataaaacatcagaaataatcaaaagagatcctgggacttggaacggctgtcagcagaattacttggttcacatatgggacagctccttctctgtgagggcaagcatcatggctagggagaacaagaaatctcgg

SEQ ID NO: 142448 - DNA, 337 bp, Homo sapiens
gtggagagtgttggggtcaccaaaacaaacaaatcatggcttctgctttcagtctagggagaggcaggtccacaaaatatggtgcctaaacacaaccataagcaaattgacccaatggacccgtgtctcgttatagggaacattcaacaagaggtggctgagtgaagggggtcatgagttggtagaaaagagaccctctaaaagagaattagctttgtgactagtaagaaaaaaaaatagagaaagacaaggatacccatggaggaaaatggtgtccaataaactctttgtattccatgaagaatatgtgcatatgaagcatgtccttttattctcg

SEQ ID NO: 142449 - DNA, 378 bp, Homo sapiens
tcctgcctcagctcccaaaactagctgggactacaggcacatcaccacacccggctaatttttgtattttttttgtagagactgggtttcaccatgttgcccaggctggtctctaactcctgagctcaagcaatccgcccaccccagccttccaaagtgcgtgaaccaccgtgccctgcctagcacctgtgagatttaacaagatcagggaaaacatcttattgcttcttcccctgcccttgtgcaggcctcactccctcacaaaggattccctctgttgcctccaaaacttcctcccagcttggcccttcctgccccaggaactgcttcctccagtccaccttgatcctggggcagatcctggtgacctctagaaag

SEQ ID NO: 142450 - DNA, 675 bp, Homo sapiens
aacactacttgtggatattcacttgggaaatgtcagagctccagattataaaattcttgcaaaagcttgcaattggctcagaatgggacatgggactttgtaattaggtctatcccagaattacaacctttgcccatactaagctggaaacaatagaaagtatttaaatgttggacattttaattacagcgtaggagagaaaaaacacacagtggataaagatgttgtggtatattggctataatattcttagcaaagtgggaagttatgacttcaaaaaactctcaacagattcctcactttgatgggaggagactgcaggtatgggagcagtagagacttgaattactccgacattattgcagaacattcctcaagtctttcctgaataattggaccccttataggtctatcactttgccaccatgagataatattgagtttgcaagaatgcttttgcagaggtcgctgtgctcctggaagacagtatttataaaaatagtcactttgtatggtggtatctgtttgggacagtgtgagcccctcactactctcagctttagatatggaaaactcaaagacagacacaaaggaaaatacttctgttttcagttattgagaaaatgatactttgtttaaaaaccactattgattaaatttagtgatattagagac

SEQ ID NO: 142451 - DNA, 531 bp, Homo sapiens
accaatggaacagaatagtgagcccagaaacaaaccctcacacatacatagccaaatgatctctgacaaggctgtcaaaaccacacaatggaaaaaggacagtcttcagtttttattcaaacatatagtttcaaaataaacatttaagtaaaattctaggaactgcagattatcttgaaaggacatatagagataataaactaatttatttgttttttcaacaattcaggctttttatttttacctatcttaaagtgatttaattataatactacatccaacattcggtttcttttgtactgtaatatctccatctttggcacatctaaagcttatttacatttcagttttaataaatttagccaagagtagtgccaaagaattacaataactaatctctgcccagagctattggggtctgctgcaagcactgtcaggaatgaagaaaaagaatgggccaggcgtggtggctcacgcttgtaatcccagcactttgggaggccgaggtgggcagactgcctgagctcaaga

SEQ ID NO: 142452 - DNA, 370 bp, Homo sapiens
gcggattagaggtccctctactcgcgggtgctgtagtacaagatggctgagaaatacagcagtacttatgggaatgtgtgatgcatttggcatttcctatagaagtgcttaatcctccaaacaaccggatgaagtaggtattattgtgcccacttaacagacagataaactgaggctctaagagcttacattattattactattattttgaaatggaatcttgctctctcatgcaggctggagtcaggggcgcgatctcggctcactgcaaactccgcctcccgggttcacgccattctcctgcctcacctccaagtagcatgggactacagcacccgcgagtagaggtaccgagctcgatctaaggacc

SEQ ID NO: 142453 - DNA, 355 bp, Homo sapiens
acctttgcaggaatagaagccaggagcaataggaatggtctacccccacacctctgacaggaaaccaaatttggccagagtgcccctctagctcagggaaggcaattccctcttcagcagattcctataggggagcattgatgctgtcacaggtcagccaatggggcttatctgggtctactctccatttccaccttcaattagtttagttggaaaaataacgtacccacgtacttggagaatctgaggaggatggaagattttttcttgatatttgcaacccagtcacgccttgggcagatgtacaaaatttcctttgcattttattgacctcagaggagcagagaatggtcct

SEQ ID NO: 142454 - DNA, 276 bp, Homo sapiens
tcaaaatagctaccacgcatgagcttgtcaccctgcaccaactcatcctgtgcagttaccactactgttaactctgacctaggatttgtagttcattcgggatgtcatgcatgcttcagatctcaggccctagtgacctcacctataaatttggtgtgggcagtgataggcctggatgaccctcagtggcccttctagcacaaaaatttctcaagtcagaagaacaaaaccctgtacttctactctccctgggacagtggcaccaaatatgccata

SEQ ID NO: 142455 - DNA, 563 bp, Homo sapiens
ctcaataagacaagtaaaaacgcacagttgtacagtgcttgctgtgtattagggactattctaagtgcttcactcgtattaactcattgaatcctcatgagaaccctgtactattatcatagtttgcaggtgaggaaatcgaggcacagagtaagttggtaacttgaccaagtcacacagtgacataaagaagcaaggttctaagcccagaccatctggctccgtgggctgtgcttagcctctgcactatagtgcctgattttgtttgctttggtgatgtgtctggctaaaacagcttcatttccttgaaaggaggtagacccatttggtatccccccttttgcccatagttcatctctttctgcctggaacgtgagtgtggtgctagaaggagggcatcactttctgtcgtgattactattttgcacccatgagttgacaattgggaagaagaaagctgcatggcttggcctaaagaaggaaggtgcctgggtcccagccccagattccctactccagattccttgtgaaatgaataataaaatccctcatttttaatgcta

SEQ ID NO: 142456 - DNA, 461 bp, Homo sapiens
caccacccctgagtcaagctaaaccaatccaaaccactgcactggtgttggcagtggcagttgaaggctgggggagtcccaggttcttaaagttgtaagttttcaggatgctggtgaaggcagagggaatgttggaggtaagtaggagcttaagacatgtctattcattcattcattcagtgctaaacacctgttgtacagcaggtcgtattctcagcagggttgtattggtaaacgtgatagtgctgtgcacagatagttactgggacactggagaaatacaggggaaagggttgtccaggaatgggcagggtgtcttctataacgtgtgggtacagaggaggctctctaacggagtgatacttaatagagtgatgaccctttccagaagagggaacgtggtgtgtgaagacttggacgccagagaccagaccgtgttgtatctgaagaagtaaaacaag

SEQ ID NO: 142457 - DNA, 339 bp, Homo sapiens
ccagctcaggaccctgttcctcttcttgtaaaaccactagaactcattatcctgttagtccatgaatagattaatcctttcatgagggcagagccctcacactctagtcacctcttcatagccccacctctcagtaatagggattaagtttcaacatgagtttcagaggagacaaatacctaacccatagcactccctgtgtctctttaagaacaacaaaagcttccaaaatcagagtcttcagcatcttggcatgaatgtctagcagccattccacatgcagcctgactggagccccactcctgattcctcttgcaagctcttcccaccatctcctca

SEQ ID NO: 142458 - DNA, 528 bp, Homo sapiens
ttaattacccccaaatcggccaggcacgatggctcacgcctgtaatcctaaaaatataaaaataaaaatgacccaaatcacaaaaatacgagaaagcataattacgaaacgtaatgcttccaaattatgaaaatcttcggcctggcgtggcggaccacaaggtcaggcgttggagaccagcctggccaacatggtgaaatcccgtctctactaaaaatacaaaaataagccaggcgcggtggtacacgcctgtagtcccagctactcgggaggctgcggcaggagaattgcttgagcccagcaggcggaggttgcagtggtgcgatcaaataaaaagaaaaattgagaaaattcttaaaggcaaatgaggatccagaataaaactgtgtgcaattatattgagaacgacaatgtgcctactatgaggcagtaagataaacagtgggggtggcggtgcaccttcagaggctcgctgggtcgggcggcagcctgcgggtcccgaggtctccatggcccacttctggccca

SEQ ID NO: 142459 - DNA, 259 bp, Homo sapiens
ggggagttatttgcatgtgtgatagagaatgagtaggcttgctatttaaagagcccttactaatcaagagtgaaaaaggtgaagaaaatgggcaaatgaggatccagaataaaactgtgtgcaattatattgagaacgacaatgtgcctactatgaggcagtaagataaacagtgggggtggcggtgcaccttcagaggctcgctgggtcgggcggcagcctgcgggtcccgaggtctccatggcccacttctggccca

SEQ ID NO: 142460 - DNA, 1391 bp, Homo sapiens
ggccgccctgccgcgcgcacatgtaggcgttccgagcggcggcggaggtgagcgcacggacgagcgggagggacccttctccggcctgatgcgacccgattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagagggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcaaggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctccttaaaaat

SEQ ID NO: 142461 - DNA, 392 bp, Homo sapiens
ccttctgtctgtcggttactgtggtgcccatgaaaatgtgccactcagacctgctgcggagcggatttgactgacagccccagctgctgtttctctccgtccacccgtgctttgcctccacaggctgctttccaccagcgatggagcgtggggacagtactgctgcaagtggatcgtgggactcctccagtaggtgactgtggctcgagaactccccagtggcctgggcaagcctttctcagaactgctctgaagtctgaggcccatcctccccactcctccacagatgtcacacctgtactgtggtctgaaggatctccctgccttctatcccctccttctttgtccttcacaggcggttcccccaatatggctcttactcatgcaaaaaa

SEQ ID NO: 142462 - DNA, 678 bp, Homo sapiens
ggccgccctgccgcgcgcacatgtaggcgttccgagcggcggcggagattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgaaagggaacatcacagaaaggtgaagaaatttgccctaaatcataaaactttgtaagtggcagaacaaggatttgaagctggcagtctggttccaggtatcgttcttaaaacactaaatttatactgtcctatttagcctgaaagtttcatggtgcagacttatactgtggactccatagcccttttcctcatgctgggttagaagtagctttttcaggctcactatttttattaggaaaaaatagtcactgagcagaacttccgaggagacccctccagctaactgaagagaaagggacaaccagcctaccatgtttagtgcagcagggggaacagg

SEQ ID NO: 142463 - DNA, 637 bp, Homo sapiens
ggccgccctgccgcgcgcacatgtaggcgttccgagcggcggcggaggaaagggaacatcacagaaaggtgaagaaatttgccctaaatcataaaactttgtaagtggcagaacaaggatttgaagctggcagtctggttccagagatggggttttactatgttacccaggctggtcttgaacttctgttctcaagagatccacacacctcagcctcccaaagtgctgggattacaggcgtgagtcacttcacctggcccatactgccttgagagcccctggagcagagaagcagctaacctgtgcctggattcctgacccacagaaacaagaagacaataaatccatgttgtagtaaaaaaaaaaagaaaaaacaaaaaacaaaaacaaaaaaaaaaaaacaaaaaacaacaaaacacacacacaaaaaaaaaagaaaaagacaaaacacaaaacacaccgagaggaggcgggcaggcggagcacgcggccaaagacaggcaagagaaaacaagaggaggaggaggagacggggcgaagaagagaggaagaagcgaggcagagcgcaagagggagagccgggaggagaagcgcgagggagtaaccaccggggggagcagagatcatcatcaggagg

SEQ ID NO: 142464 - DNA, 1732 bp, Homo sapiens
ggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagagggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcaaggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctccttaaaaat

SEQ ID NO: 142465 - DNA, 1465 bp, Homo sapiens
ggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgaaagggaacatcacagaaaggtgaagaaatttgccctaaatcataaaactttgtaagtggcagaacaaggatttgaagctggcagtctggttccaggtatcgttcttaaaacactaaatttatactgtcctatttagcctgaaagtttcatggtgcagacttatactgtggactccatagcccttttcctcatgctgggttagaagtagctttttcaggctcactatttttattaggaaaaaatagtcactgacaaacagccagctaacagctggggcccttgggccacaaggcactgaatcctaccaagaaccgtgtgagcctggaatagaatccttccctactcaagctttcagatgagactgcatgtattaatccattctcatgctgctatgaagaaatacccaaaactgtgtgatttataaagaaaagaggtttaattaactcacagttccacatggctggggaggcctcaggaaacttacaatcatggcagaaagcaccttttcacagggcaacaggagagagaatgagtgtcagcagggaaaatggaagtagaaaatcatcagatctcttgagaactcactcgctatcatgagaacagcatggggaaaccatccccatgattcagttacctcctaccaggtccctcccgtgatacatagggattatgggattacaattcaagatgagatgtgggtggggacacaaagccaaatcatagcaccccagc

SEQ ID NO: 142466 - DNA, 799 bp, Homo sapiens
taagagaaatgccttcttcttgagaagaatttggaattgtcaaagaaaaacaattgaaaatgttgcacagaaatcctgtgcctttccaggaatgtcttctagataccggggccattgtctcaaccactgtttaccatctggctttttaacgtcaacaagtgaagacctgtgcacacaggagacagcatggtctgaccctcatagtgttttctttttctctagatgcaggtggacccagccacactggcaaagcgtacgtattctgggatcatctctttgtttaggtgtgaaatcttagtgttgtaaaggtagtgctgcttcacctgcttttgctcaagggccactctggtttgagctttctgccagaaatgagatttgggaattttggtttaaaaactactaagagtcacttcacctggcccatactgccttgagagcccctggagcagagaagcagctaacctgtgcctggattcctgacccacagaaacaagaagacaataaatccatgttgtagtaaaaaaaaaaagaaaaaacaaaaaacaaaaacaaaaaaaaaaaaacaaaaaacaacaaaacacacacacaaaaaaaaaagaaaaagacaaaacacaaaacacaccgagaggaggcgggcaggcggagcacgcggccaaagacaggcaagagaaaacaagaggaggaggaggagacggggcgaagaagagaggaagaagcgaggcagagcgcaagagggagagccgggaggagaagcgcgagggagtaaccaccggggggagcagagatcatcatcaggagg

SEQ ID NO: 142467 - DNA, 1219 bp, Homo sapiens
ggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgaaagggaacatcacagaaaggtgaagaaatttgccctaaatcataaaactttgtaagtggcagaacaaggatttgaagctggcagtctggttccagagatggggttttactatgttacccaggctggtcttgaacttctgttctcaagagatccacacacctcagcctcccaaagtgctgggattacaggcgtgagtcacttcacctggcccatactggctgctttccaccagcgatggagcgtggggacagtactgctgcaagtggatcgtgggactcctccagtaggtgactgtggctcgagaactccccagtggcctgggcaagcctttctcagaactgctctgaagtctgaggcccatcctccccactcctccacagatgtcacacctgtactgtggtctgaaggatctccctgccttctatcccctccttctttgtccttcacaggcggttcccccaatatggctcttactcatgcaaaaaa

SEQ ID NO: 142468 - DNA, 959 bp, Homo sapiens
  misc_feature (779)..(779): n is a, c, g, or t
  misc_feature (783)..(783): n is a, c, g, or t
ggccgccctgccgcgcgcacatgtaggcgttccgagcggcggcggagattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgaggctcccntgancatgcgggggtggatggcctcaaaaagcgacgggaacggcgccaaacatggagaacggaacgggaacaacgggacggcacacgggcagaacttccaacaccggacggcgagggggagacgcggcaacgacacaaaggacaccaaagggcgcggagcaacgaaaagggaacaaggag

SEQ ID NO: 142469 - DNA, 1340 bp, Homo sapiens
ggccgccctgccgcgcgcacatgtaggcgttccgagcggcggcggagattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagagggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcaaggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctccttaaaaat

SEQ ID NO: 142470 - DNA, 1010 bp, Homo sapiens
  misc_feature (830)..(830): n is a, c, g, or t
  misc_feature (834)..(834): n is a, c, g, or t
ggccgccctgccgcgcgcacatgtaggcgttccgagcggcggcggaggtgagcgcacggacgagcgggagggacccttctccggcctgatgcgacccgattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgaggctcccntgancatgcgggggtggatggcctcaaaaagcgacgggaacggcgccaaacatggagaacggaacgggaacaacgggacggcacacgggcagaacttccaacaccggacggcgagggggagacgcggcaacgacacaaaggacaccaaagggcgcggagcaacgaaaagggaacaaggag

SEQ ID NO: 142471 - DNA, 1253 bp, Homo sapiens
ggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccagtctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccagcctgaaagggaacatcacagaaaggtgaagaaatttgccctaaatcataaaactttgtaagtggcagaacaaggatttgaagctggcagtctggttccagagatggggttttactatgttacccaggctggtcttgaacttctgttctcaagagatccacacacctcagcctcccaaagtgctgggattacaggcgtgagtcacttcacctggcccatactggtaattttaaaatactaaagcattaagtgttagtaaggttgtagtaaaattgatacaagcatatgcccttggtgacatttgtgttaggcagcttttaagatgaccctaatgatccctggtcctaatatttttggccctggttcataatccactccccttgctcctcttggttctaaacaatagaatacagatatacattgagggtatatcacctcagtgattagattacaacagattatgacttctgtcttgctaagaggcccttgtcttcttggcttcacatgttttatcttgaagcacgtt

SEQ ID NO: 142472 - DNA, 533 bp, Homo sapiens
ttcatttaggccaattatactaaactgttttaccccaaacattaaaccaatcccaaaaaagtcacataaagtgtgaagaaactgttgcttacaaatgaattgttactttttttttttgcatcccttcatttatagcaaagcaaatttatcaactgcactttatagtttaaattccttgttttgtgggcttgagttctgtttacaaaatgatgaacaggaatagaggctcatgaagtcctaaaaattagaatctaaaatgtaactataacacgcatatttggttaacttctaaattaccaagaaaaggtggagaaaaaagactgagttcactattggaaacaagtatttcagtttttaataaataatgcaataactctgaattcagcaggaatagacccttcaagaaacactgctacaatatcctgctatagtaagccaattacacctttctctaatattttgcaatgtaaaaatttactcacaaataatcagtcattaaaccatcatcaatctgcctaaataaggtaccagac

SEQ ID NO: 142473 - DNA, 396 bp, Homo sapiens
attatattacccatttaccataggtgtgagtggcagtctgaatggagaagttccatagttctgattgcagatcctatgcaggagagatagtaaggaaaataatctttgtctcctggattaagctgaggctggcaaagagaggaatgtcccaagccttctaccaaccagcagaatgcattatgttgtgctggatgctggtctgcttgccaaacatgtggaactggccccgtatatgtgtatcaacccaaaccaggagatacttaaatttatgaacacggggtatatgagtaaagtcaatttgccaatcttgtgtcagagtaaatccaagagcctgatgcgtaggaaagcaaggagtcctgagagaaccttaggggttggtgacaagcagtcagagca

SEQ ID NO: 142474 - DNA, 482 bp, Homo sapiens
cgatacctcagatggtagagaacagtgaacttgtatgctaaagatctgagggctgtgaatattttagttcatccacttgacttttgatgttaattttaatttcgtcagattgtacatttattttgatacaatactttaaaaaattttacttataaatgagctagagaagctccgtcatgctttgagtttgtgttattgaacacaaaggagacctaagaggcaatatacctctaggtagatagagcaggtctgtcctcgtaccaaattgacaactcagaatatctgcagatgatgggacactggtgtcaactgtgtaaatggtaacacaccgttattttgctgtagtgactcaaagcagtaatagtatatgatatcctggatcagtgcttctcacatttttctgctgagatacccctgatggtagagaacagtgaacttgtatgctaaaggtctgaggcagagggtagagtagttggctgata

SEQ ID NO: 142475 - DNA, 1009 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagcatccctggatgtgaatgaggaccctccttaaacaggaatggagaggttgagctggtcatttccaaccttagcttcaaggcagaactggaattagtttcaaaataaaccttgatcctaggcacttagttctagaagatcctacaagcacgtctgctgtaactctatgtatgttttctgtaaaatcacatacctataaaataaaaagaaaaaaatcacacatctataatattataagagagcttatgggaaaaatagaattgggccaatgcaactgcaactttttgaccaaaatatgacaaaaaacaattattggtgcttgggaagatgctttggactacctagacaggcagctcagggtgatgtgatgctgcaaatgtacaaagagccgtcttcttttttttttttttttttttaagacggagtcttgttctgtggccaggctggagtgcaatggcgcgatctcggctcactgcatcctccgcctcccgggttcaagtcattctcgtgcctcagcctcctgagtagctgggactacaggcacacgccaccatgccctgc

SEQ ID NO: 142476 - DNA, 4109 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142477 - DNA, 632 bp, Homo sapiens
gagaactagtctcgagactagttctctctctctggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142478 - DNA, 4590 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142479 - DNA, 4725 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcaggcaggggtctggatttggtctgcaggctgtagttttccaactcctgctctagaccagtgaggagaagaacacagaagcagaagagttccaagagctgctgtaaagagttgcccttatcttacaagagtcattgagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142480 - DNA, 4894 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgaaaaaaaaaacaaaaaaaaaaaactcggagggctctctattgccggggtgcgcgggaaacaagagaggcgtcatgcgaattggcgcccttggcgtcatacgctggttcccttggacccaggttttcctttcgtacacaggtgcgtagaatcgtggcggagctcccccctaatagagaggaggtgcgtatataaattggcgaataggcccgggtttaacccgggctttagtgactcgccgcaaaaatccaatagatctacaaacacagaacacacaaaaaaggagctcaacccaatcagacacaga

SEQ ID NO: 142481 - DNA, 3697 bp, Homo sapiens
ttaccggggagcgcgctctcggcaggctgttttctgtcgccaagggtcccggaccgagtacacagtgatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142482 - DNA, 2893 bp, Homo sapiens
ggcagggatatgcttccccccttcaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142483 - DNA, 4908 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgagggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatccctt

SEQ ID NO: 142484 - DNA, 4536 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142485 - DNA, 2270 bp, Homo sapiens
gtagctagtacgagggctggtttaatcggccgaggctgtgcgcgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142486 - DNA, 2189 bp, Homo sapiens
aacagaagatgtacggacggcaggcacgcggtttgtaatttcattacggtggacctgtcgctttcagcctgtaaattacatggcccctaggctgacaatgtaaagcccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142487 - DNA, 2380 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142488 - DNA, 1441 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacggtgagggcatcggcgggggcgggcggtccgcagcgcccttgactcctgggatggcagagctaggggcgcgggccgaaatcgggcctggcggccgggggtcctctcttccatagtggccaagttcgccatccgtcggcgggcagcggccttgctgtttgtaaagcttagcgtggcacaggcccgaatggacccttagagtacctgctcccggcaagaataggtgagaggtgcgagacctcgagggagtggggaaaacgagtaaaagtccaactcctgccaggatgagtggccaagggctagagcttctagggacaagcatgccctcaccagtgtgagaaatagcccaaagtaactcctgggacatcaggatctcaaatagagacag

SEQ ID NO: 142489 - DNA, 4080 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142490 - DNA, 835 bp, Homo sapiens
gtcttcagaaggccgcgcttgtggggtctcagtgttcctgatgtagggggctggtgagggttactcagggagtggggaagcactgaggaagtggcatttgtgtgctgcttacttgccacctcctccaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggtcagtcgggcccacacctgctctcctgagcccctcccacccccactgagtttctgtcacctcc

SEQ ID NO: 142491 - DNA, 3803 bp, Homo sapiens
tgactcagcgttgtacttctcaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142492 - DNA, 4479 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142493 - DNA, 3536 bp, Homo sapiens
caactctgaacctagcacattgctgctgtgaggtctgctgctgtgaggtccaccactgtttattttccatgtaatttgcaacaactctagtctggagtggcaagacttctgatttctctcttctcttccccagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142494 - DNA, 2917 bp, Homo sapiens
tcattttttaaaacgtttattttggtaagttaacattttcctagttcataatttctccctccatcaccatgtcagccaaaatccaaaatctcttagagattacttggcacaacttatgcgttggagctcctgagcttgtctgggctggtttttggggagccccagagcatagactgagtcttgcatgtccccctgcagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142495 - DNA, 4687 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtggtgggtgcctgcaggcctcccgcccaccccgctctgcagctgctcctccggggcctgggctcaccacagttccccaccatcttttccattccctcagatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142496 - DNA, 4563 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142497 - DNA, 3925 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggtcagtcgggcccacacctgctctcctgagcccctcccacccccactgagtttctgtcacctcc

SEQ ID NO: 142498 - DNA, 2543 bp, Homo sapiens
ctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 142499 - DNA, 689 bp, Homo sapiens
cttctgcaaagcatctaattgtctccttatggatgggatggtaaaacacaggctagatgatagtactgctaggtttgcagctagagagcaattgaagccagctgattaacgtcatggttatcttgatgcgggtctctggtggaataccatggagctctgacatgtaaccttccatttaaaattttaattaggaatttgaatgaagacacatgggatggatatttaccaagtacacagatggcccaaagttgggagggataataagagcaatagatgagtcaatcaacattcagaacactgctgatcatctgaaacgctgcatggaatccagaatgattggatttaatgaagctaaaggtgaagacattaagctctcacaatatcaacccgagtaagaaaggagattgtgggctgggttcaatggctcacgcctgtgatcccagcactttgggaggccgagatgggcggatcacgaggtcagggatggagaccatcctgactagcgcggtgaaaccctgtctctactggaaatacaaaagatcagccgggcgtggtggcgggcgcctgtggtcccagctaccagggaggctgaggcaggggaatggcatgagcccggggggcggagcttgcagtgggccgagattgcgccactgcactccagcctcggagacagagcaacactctgcctc

SEQ ID NO: 142500 - DNA, 1030 bp, Homo sapiens
cgtctcgctgcaacgtgcgttcccattggcgggcgcaggggctgctggcgtctcgtgaccgtctccatagcgccggcgcgcggagaagcggaggtaggctgtcggcagtcggcttggcgctgacttgtaggaccccgggaccgggcgcctgggccaacttgggaccgctgggagtgcagaggggccccagcgcccgagccttccgggaatggacgtgcgcgcccttggggccggcgcatcatccaccgcccactagcgttggcccgccctggggagaggagaaaatgccagaggccgacacttgactgatggcgctgcggacctcgctggtcttggggacaaggcggcagatttcctttagaaaaacttccctctcgcgtctccctggccccgcggcgaccgaagagttggggttcggctttcttctcctgggatttaagtgttatttgaaacagctccctgcgcggcccttttctcctaaactttgacagaaacttccctttgtccctaccaatcctcagtgagttctttacaggggtccgagacaggttgtagatatgatgcggcttatcggctttaccccgatcctagcggagttaggacttgctgatgtaattggccagcacctgcctaacaatgaaggtttagttatgctacaagtaatgcacctctaaaaaaacgtaaaacaggctttacgttttacctgctatctccacaggtttactagctgcttaatacaatatgcttgtatatcaaggtgagcaaatttcagcaaatgtcattgtaaatagtcccaacttaaatggaattgaactctggaactcaatgtgcatagaagtccctgagactgacgccattctagatctaccactagatggtttgcgatgtacggaattaaaggcagtcacttctacctgaattgtgatgaaagtagtttacctgaacatgctgggaaagtgtgctaccctgttttgtattagaaaccagtttccaagtaaattgaaaagcaaattttcagacttgacattaa

SEQ ID NO: 142501 - DNA, 351 bp, Homo sapiens
ggaggggacaaaagggatatgttctgagaaatgcatccataggtgattctgtcattgtgcaaacatcacagagtgaacttacacaatctagatggtacaacctactccatgcctaggctgtagggtatggcctattgctcctagtccacacacctgtgcagcatatgactgtcgtgccagatactatctaccaggaggtggctggatatccccttccaaaggaagttaggctcgcctaggagcaagaggaggtggtatgatggagacggcccctccatgctccatttgtgccttaaaagcacaaagacatgattggtcacaggctgagtccctcctatgctctcatcacat

SEQ ID NO: 142502 - DNA, 853 bp, Homo sapiens
gagagaatagactataaatgtttcttaacagacctaaggtctgtgttgttgtaaattccggagaggtataatgagacatgtcagattcccacttctcatcatggcctgaaccagtctttcaggttaaattttaaagccctggcttaagaggaggtccattcagatcggtgaagggtattagaattttatttttagtttacaggaggcattgccatcataccttcctaaaacatggtttctcttggttctctgaatgcataaatattttttgctttgaaatttttgttaattgcaacatctggactctctttcaagtggtcttgttacctgtctttaaaaattctgtgtttgtgtaaaagttacctgtctctttgtgttttgtgattgtttgttaaaaattttggacaatatttttgtaataaatgtagcaaatttgaaaaataatcccctcaccaacaaaacttaaaaggattttcttaaagagcgcgcagtggaggaggctaaacaaagcatggccacgtggttacaggtcatgcttcaaaggaggtaaaacaagatggagacctgcagcaaagtttgctactgaccatccagaaagacacgcaaagtacaccagattggctacagcttaacaccaacctcacaaatcctttttcataattaaaactttacaaagactattagcaatgatccttattattcctgggctagtaaaacatcttttaaaaagaaaaaaagcatcccttaaaagttaactcctgacctggtagagaaaagagaaaaaaggggggggcaaaaaatcccgggggccaagtcggttccggttttgtaaggggcctagggggcttaaagg

SEQ ID NO: 142503 - DNA, 182 bp, Homo sapiens
gatgtttccgaggctcccagttaatcagatctgtcagcccagtgtccacagggtgcctgagagcccagcccatccacactgggtgccccagaccttccacggggtctggtggggacctgccagggctgtcaatggccccagtggagaggcccactgagcatcctgagaagttcctgtgcttg

SEQ ID NO: 142504 - DNA, 180 bp, Homo sapiens
cttccccaagctagagaggaatctggtttgcccagaagtaccagattaggagctttccaggctcctcaaagcctgtgccccactaccctgtccttggctctctctgctcagttcttccctcttcaccggcccttcacgagacactgtggagataacaccagtttttgagtcagacctgtt

SEQ ID NO: 142505 - DNA, 231 bp, Homo sapiens
cacggaaaggacaggaatcttgccctcacctggctcccgagccaggggccggggcaccctgtgaggacactcagagggagggagtgtgcaaagcctgcagggcctgggaggatgcgtgctggggctgcctctcccaaatcctgctggggcgcaggctctcagggtggcttctgatgacaaatccaggcagtaataaggggcccagggcatcacatcccatagcgtcatgag

SEQ ID NO: 142506 - DNA, 362 bp, Homo sapiens
acatattccgtggtgtatctgtatggcagtttcttcatccctgaagctgtgtacggacagcttggaagctgtcactcctgtcctcacaacgacaacaaaaaacaccttgaacaaactgaaaattacaacttttcttagatccatcagagacttgaggttaacagggaaaaccgttatcccccaaattggagaggcagtgagtcccagcctaacaggatcggaggctggccactggagccagaaccacggtgggaagacttacatgtaaacaacaaatcgctggaggctccatgcacataaacttgagaattaagaattaagggagcccagtcttagggggccctacactttctgaacctcca

SEQ ID NO: 142507 - DNA, 729 bp, Homo sapiens
caggaagagggtattgccttgaaatgccgagcaactttccacagattattaacaagccgagtgctgtccactggctacactttcagcaactgggagaataagcccttcattcctgaaggatcagttgggcggtgcatctactatactgattaggtcagaatcttttggtgtggggcctgggaatcagtattttataaagtgcaccagggtattgtaacatccaacatagagaactattgctctgaataaccacaataaaagcaaaaaagaagagagcaataagaaagaccgtgtatttcaggctcatatgcagctgagctgcactgaaaccaggcatggtagcccagcagattttgtggtagccaaaggcctgtgcaaggatatgtctgtgtagtgcccctgcccaggtcccccaccctgaagtgctgggagacgttcctgtgaccatacagctgggcagcaacagagttagatgaatggtcttcctgcccctaggtagctttttcattgtgagtgactcagaaagctggagtcagatcagtagtcctcatgtgtaccctgtaagccaggaacccctgtcaaggcttcagagatcaagagttttccagagctatgacacccaaacctacgctactgttttccacatgtggtttctgtccacagagagtacatgtttctccaaaattcttgccattgagaaaggagttttaagtcacagagcacccaaat

SEQ ID NO: 142508 - DNA, 401 bp, Homo sapiens
gatttggtgtctcttgcaggatgataagttttatctttttaaagttttttcccttaagttacgaaccattctgaagagtgacaaatgttaaagggggtataaaacggcagcacttccacaaaagaaataaggtgctttaagccaggcacagtggctcacacctataatctcagcactttgggaggccgaggcgggtggatcacgaggtcaggagatcaagaccatcctggctaacatggtgaaaccccttctctactaaaaatacaaaaaattacaggcatgagccactgcacccaacccgtgctttgtgttatgataagataacaaatgtgctcaaatgtggggaaggaattcctggtcactgaaggacttttagagatctttttcttacttggcatctt

SEQ ID NO: 142509 - DNA, 156 bp, Homo sapiens
ggggcagggctggatagggggaagaacccaatacaggggcgggaaaaggtttttcagactcctgaattaaaatttcactttgcactgccaaagccaaagcatgggctagcagccttcactatttcatagattacataaacttgtagtctgatgctg

SEQ ID NO: 142510 - DNA, 272 bp, Homo sapiens
gtagctctaggaaggaaaaaggttgactatcttttgtatggtcaatctataaatatttctgtagaaaacagaagcattaaacattttctgcataggctcttgggctcccagcctcgggcctaactcagttcaaacacctactgtgtttctattttgtgtcaggtgctatagtaacctgacaaagggagagctaatctgccgaaggatgaggtcactgtggttttcagaggctcaggtatgatgggggaataagggcgaaattcaaatacaag

SEQ ID NO: 142511 - DNA, 468 bp, Homo sapiens
ttcatgtctcaaacaagctttacatgtgcaccactgtaaagactacaatttgtcaacttcaaattcaccttgaacccacacagacagtaacctcacatggttattatttagcacttgaggtctacagatttatgtcaaatcaactgccatctgaaggttattgtgggccaagtaacagcattgaacatctcaaactaaaatgaagactatcaggaatacaaacaaccccaggtctccatggattgattatctctgggcataacctgatcataactatccattcttatttcatggtggaccaccaagtccttgtgttccacaggcagtccctctcctttgtacaaaggtataaaagctggagacagttccccttgtccctctcatctggccagcatccgtgcgagaatattccttccacctatctatcctcggtgtacgtacacacacacatgcacatacatacacaca

SEQ ID NO: 142512 - DNA, 159 bp, Homo sapiens
ctctgtcaaaataacgcaaactattttctccagtggcaaaacttttagcccaaagagctagaactagctaccaagagttaaaagacttgctctccaatcctggtccctctgttaactcactgtatagccacagacaaatgactgtttccctcaacaata

SEQ ID NO: 142513 - DNA, 476 bp, Homo sapiens
cttctctgtttcatactcttagcctacacttctgtttgccaatatagcattgctaaataaattattcacatgtaatctttattgcaggcttttgctttcagatcttaggcttatcttgatcagcctaagacaatttgtgcagaaaggaaattctcagaagctgaatttgaaactgaaccactattccactattaaatggccaggaggcattaaagaccccgttggtgatggttcatgggattcttatagatcacaataataagacttttgtcaaatgggttgaggtgcagattcaaagtgaaacgtggggttatgcagtagttgtggcacttctaaagtatagaagaaaaggtaataacatgaattgtgaattcaaatgactttgtcaactgctttggaagccttgagaaaagagaaagtgagaactagagatccttccttatctttcaaagttacaggaaagaatgtgatgaaaa

SEQ ID NO: 142514 - DNA, 368 bp, Homo sapiens
tatgacctgatcattagaaaaatgtcaattatggatgatctatgctttaataaagacttaagcataactccaaacttaaatatagaggaaataatgatgtcatattttattgatgatctatgctttaataaagacttaagcataactccaaacttaaatatagaggaaaaaatgatgtaatcttgggctgaaataatttagggtgagaatttatttcagaatgatatgttgtgttttagtttatattaactgagattcaatgagagattacattagtcagaactgaaaatgaaattgctagttaaaatatggtatatttgatatcaataactatgactgtgatctaacaaaagaaaataaatcattta

SEQ ID NO: 142515 - DNA, 383 bp, Homo sapiens
ccaggacagatcagcatgagagctttgaccagctccgtctctgacttgggtaggttcagccctccttaggcaacctggtggtcctcccagtccagggaggtcatcatattaatgtagacgctggatcagcatagctcactacagctcagaactcccgagctcaagcaatcctcccgcctcagcctcctgagtagctgggaccacaggtgtgcaccaccacaccgggctactttttgtatttgtagagacagggtcctttttgttgcccgggctagtcttgaactcctaacctcaagcaatcctcctgcctcagcctcccaaactgctgggactacaggtgggtaacactatgcccagccacttgcaattattaatggcattgt

SEQ ID NO: 142516 - DNA, 471 bp, Homo sapiens
aagaaaccttcccaggaccccttttcctctctatctgcctacaataataactcctgcaacgtaagtgtaaaagctaaacctctagaagtctttgcagcctggggctaaataaagatttcttagactggatgcagaaaacgtgatccataaaagaaaaaacttgatattagacttcatcgaaatttaatgatacgaagttacagttagacaggaaaataagttttggtgttctgttacacagtagagtaagtatagcaaataacaatgtagagcatatttcaagattgctagaagagaaaatgttaagtattgtcaccacaaagaaatgataaatgtttaacatgatatggcattaactctgatttgatcattatactatgtattcatgcattgaaacatcacattgtactctatacatatatacagttattatgggccaattataaattaaattttttcttaatttaaact

SEQ ID NO: 142517 - DNA, 712 bp, Homo sapiens
cggacgcgtgggtcgacccacgcgtccgagaagacagtgatgggctcaggggctattcaggcatcagatgacccaaagaaagtggcagcatcttgcccaggtgagcagagttcaggaactcagaaatgagaaccttctacacataagttcagggagtcagatgagagagctgttagaactaagcagtgtagcaggaaccaaagaaaaagtccaggtctgaagactgggacacaaaagaatataggaaaccataccccaggagcccttggttagtttcaggacacgggactgtgagttcaggaaggcagctaatgtccaactccgctgaagagggagctggatggagaattgatctgaggaaacaggaattggttggaaggagaaatcagctggaggatctaggggtggtgaaaaccaggaaaagctcccagacctaacattagtttgcatcaccaagaggcatttttaatgttggccctgttttgtggtgtccctccttacattctatccccagtttcctggattaatttctttctttagcatcttcatttctggaaatagacaaaagtccccttggagtccctcagttccagtgtctaagtctttctgcccataattgctactactacagatgctgatcttttcatcttttccattctctttatcttttggcttttgcacatttgagcgtttcatcacactgttcagtggg

SEQ ID NO: 142518 - DNA, 327 bp, Homo sapiens
tatagagatggggtttcgccatgttggccaggcttgtctcgacctcctgggttcaagcagtccacctgcctcggcttcccgaagtgctggattacaggcatgagccactgtacctggtctgtatttacttttgagaggaatttaatagaaatgacttaggaatgcaaatgggataatggtttactgcttatggaatggccttaggaggacatttgtggagagttcttacacccggcagggattagactggattagaatttcacatcaaaatagtctggcaaacaaagtctagctttttctgtgtggagtcctggagtgagtgggtgc

SEQ ID NO: 142519 - DNA, 733 bp, Homo sapiens
gaaagctaccacagggaaataagactacagaaagtgggaagattctaaagcaaaaaaataaaagtactgtacccaccaggaaactaaataaaatacaggaaaaagttgctttgggccaacacaggaaagagcaaattaaagcagatgtggctgagtgataaaacgggcaggcaggaagtcaacgtaagcaaagctagaagatgcgcaaacacagggagagaaaacagaagcagaggcgcgcagcttggagagctgcaggaaacagacctaaagaagagtaaagcagaattaagaatatattctttagtgcctacagctttacaaggacctagatataaagatattcagccggctgtagtagtgtgatcccagcactttgggaggcagaggttgcaataagtcgagatcacactattgcgctccagcccgggtgatggagtgagactctgtctcaaaataaataaattaataggtgagccactgtgcctggcccaagtaattgcttctgtaaagggagagaggggacgggaaacatcagggaggtacgccagttgcaaatgcataatgctaaggctcttatgctggtcttgatgtgtacacagtggttatgaagagttgacaatttgacacaggcctagagatgaaaaacatttgtatcctcttgaagctctggaccagagtgttcagtagtcgcgatggcaggatggaaccattaccatggatattactacgt

SEQ ID NO: 142520 - DNA, 916 bp, Homo sapiens
agcaggcttgagtccccgatataatgtcattcccaacgaatgcacctccaagagcagcatcaaagtttccataatcacttcgacctctgtggttggataaagcacatatccatctctgacattgacagggttctgcttaacttcacagtcagttgccatatgccgtatgttattgctgactgcacactcttaaatctggagcccaaacctgtcgtgaataccctacatccaattcgttatcagtgagtgattacctgtaggctgtttgatattgtacatccagaatagttgctttgggccaacacaggaaagagcaaattaaagcagatgtggctgagtgataaaacgggcaggcaggaagtcaacgtaagcaaagctagaagatgcgcaaacacagggagagaaaacagaagcagaggcgcgcagcttggagagctgcaggaaacagacctaaagaagagtaaagcagaattaagaatatattctttagtgcctacagctttacaaggacctagatataaagatattcagccggctgtagtagtgtgatcccagcactttgggaggcagaggttgcaataagtcgagatcacactattgcgctccagcccgggtgatggagtgagactctgtctcaaaataaataaattaataggtgagccactgtgcctggcccaagtaattgcttctgtaaagggagagaggggacgggaaacatcagggaggtacgccagttgcaaatgcataatgctaaggctcttatgctggtcttgatgtgtacacagtggttatgaagagttgacaatttgacacaggcctagagatgaaaaacatttgtatcctcttgaagctctggaccagagtgttcagtagtcgcgatggcaggatggaaccattaccatggatattactacgt

SEQ ID NO: 142521 - DNA, 373 bp, Homo sapiens
agtgataaaacgggcaggcaggaagtcaacgtaagcaaagctagaagatgcgcaaacacagggagagaaaacagaagcagaggcgcgcagcttggagagctgcaggaaacagacctaaagaagagtaaagcagaattaagaatatattctttagtgcctacagctttacaaggacctagatataaagatattcagccggctgtagtagtgtgatcccagcactttgggaggcaaggcaggaagatcacctgagttcaggagttcgagaccagcctggccaacaaggtgaaaccctgtcactactaaaaatgcaacaaatgacaaagtaagagttctatctgcagaaacggaaaaatgtccaaaaccagttaag

SEQ ID NO: 142522 - DNA, 795 bp, Homo sapiens
gacctgcagtttgggtgcagtgatgagaattagggtgggaacctgtgtcctggtcaccatcagtgatatctgctgagcatctgctgagccaggtactgtgtatgtgtcatagtggccccagggagcaaactgctgtggccagtttgcccagacccacttcagaggatccagctggggctgctggaggcctggctgcaggtcacacctctgcactccaatttacccctcaggacgggctgtgaagggggttgagaggaatctctggaccaccctcgaagtgcacctcagccagcagtcctggtgtcttgccctcttgtgtgtggtccaacccagctagagtcttaggctgtgaacttcggatgtctgataaaagacagaggtcaggatttatgctgtatctggaaagatggggagctttagagtccaacacgcaggtgtgatttcctcaaatcctgaggccctggggaagtctcttctctctgtccaggctgcaggcctcactcgttgaaccagagggcctctaaggtcatgctgaactgcatggaggcaaattcaaaaccataataggactcaagtctggggctcaggcaagtaatggactcctgagagggggccttggcgtttcccccgttacccagcaagttccacggaggaccagggacattttaaaccattgggcctatggcatcgtgtccttttgggaacatctgctgtgaggcaggtcacatgaaggtggcctctgagggagacagggagcaaagatgagggaggatgcagcataggtggggcctggat

SEQ ID NO: 142523 - DNA, 329 bp, Homo sapiens
gatgaacctgaactcttgcaagcggtctgaccttgcacacattccttaaactctgctctctagttgcttaatcttgacagatggagaaatggggaaaatgcctgcttcctggggttgtagaattaaagtatttaaagtacttattgtcctgcatggtatgtagtaggcatttggtaaatgttagattagtacttttatttttgttgtttttattgttaacacaagatgtttggtgtcacaagggtttggtctttgtgccgaaggcctgaagagtatttgcaggttttaaatacaggagcatgtgataagacctgtgtgtgtgtgtgtgt

SEQ ID NO: 142524 - DNA, 369 bp, Homo sapiens
attacacccagggactccttttctgtgatctctgaggtccctgctgctctgaagaagctcagactcccagcgagcaggagaggggtccaagatttcatcagtgtaggctcacacatacatcagtacaggtgaggaacctgagctccagaaggggacagtgactgtccacaggcccatgatgaggaagcaagcagtcccagctggaaagccaggttccctgttcctccacagaacacacttaacaccaggccacacgcaccagggtgcttctccttagggacaaaaccttgccagtggaggcagaactaggtgatgctcttccctttaggtccttttcagctgcttcctccctttttctttgcggaactc

SEQ ID NO: 142525 - DNA, 473 bp, Homo sapiens
caattccagggcaaaaggaacacagcacaatagacactcggatattcttacaggaattcagaaagaagagaaacaactaatatagcagtcctttattttgcaacaaaatagtcacatttttttaaatggctgttttaattctttcaaccactggtttgtacctgcttcaagaaatgcacagatcaccttttccatttatgtaccactatcttccacctcttcccaagcaagttccaagacagtctgcatgtcacctctctagtacagtcccttcctcatggctcccaatctcacattctcagcaaggcctggccctgcaggaaaaccaaaggaagagacagacccaactagagggggtgcaggactcagcctctgcgggctttcacagggttcaaggagctgtgatggaaggcagcctcatcccactgtgacgctcccagtatcagctggagagatggccaccaagcccctgg

SEQ ID NO: 142526 - DNA, 914 bp, Homo sapiens
  misc_feature (470)..(470): n is a, c, g, or t
  misc_feature (588)..(588): n is a, c, g, or t
  misc_feature (601)..(601): n is a, c, g, or t
  misc_feature (609)..(609): n is a, c, g, or t
  misc_feature (642)..(642): n is a, c, g, or t
  misc_feature (667)..(667): n is a, c, g, or t
  misc_feature (670)..(671): n is a, c, g, or t
  misc_feature (689)..(689): n is a, c, g, or t
  misc_feature (694)..(694): n is a, c, g, or t
  misc_feature (714)..(714): n is a, c, g, or t
  misc_feature (735)..(735): n is a, c, g, or t
acaggcaggtccctccataggtacgagtcacagtgccgtgcccggctctggcacccgtcctgagctccgtgggtgatgccttccaagcatttagccatgaggtggcggctctcagagcggtcccaaaactggctccagggctgcccgagtggcaggcagaagtaggtgggggcttatttgggtgcaggcagagtggcgtaaagaactgccctcacatgctgtttttgttgtccgctgggcggtggctgtgcagcccacctgaccagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctgntactcctggttaatcaacagcttcgtcaacggggtctatgcctttggtttcctcttcatgctgccccagctctttgtgaactacaagttgaagtcagtggcacatctgcctggaaggncttcactacaagnttcaaagncttcattgatgacgtcttgccttcatcatcacnatgcccacgtctcaccggctgggcngcnntccggacgacgtggggtnactgnctaccggtaccagcggggcntatcctggggataaagcaagngacgagttgggaacccacaaggaaggccacggggccaaagagagggcgcagggtgcgcgacaagcgcaggatgaaagactaggacgtggggaaccagaggggaggacgaacgaggaagagcaccacagaaagaggggaaagcccggaagtgaaaggcagaggggcgagggggaggggca

SEQ ID NO: 142527 - DNA, 1047 bp, Homo sapiens
aattgggggcgggggtcccgcggggcctctccgtcccgtgggcaccgtgcccaccttactttctaacctgcacctcaagcttgcagccgggggtggaaagatgacatgggtgggtgccagcaccaaaccgggcagaacacagcgtcagtcacccgcccttgccagctgggaggatgcccagaggccttacaaggccgccagggagggggagatctgaaccacctagtgccaatgggcatgatcctcccttaaactcgtggcaaaccagccctcttcctagagcacaccctttgaaacaaatgaggcgggtgagaaagcaagtgggcaagtttcttaggtgtcagaggagccattataatttattggcaggtccatttaactgatggttgccggccatgttggggattgtgaaccctaaaattactgctgttgataaatgccctcccacattaaactgatttatagttaaccctgtactgcaagtcttttacatattcaacaggtatccccttgtctctacttctaaaaaaagttaaaggtaccttgcaaattatgacatccctatggagagatattttaagataagatcaaacaggaacagggtcttttggataagatgttgacccttacagaatagataaattggcctggcacttaacctttagatcctaaagctagatcttactccctttgacgttccaacaattcctttgagtataagccttttactgatggcttctggacatttattatgatggctactggatattattcaaccagtggcaactggccattacatggagtttggtataggtgatgggtacttttttcctctttggtgtccccagtgggtcaggacacacaagtttgaaagagctagatgccaaggattgatacttggccgtaatcctcgttactcactatggtgagaaaagccttgttttctctgagaggcagcaaccaggctggcctggctttgagctctggctacactacttcctttctgtgagttccatctagtcttgtcacctctctgagtctctgttc

SEQ ID NO: 142528 - DNA, 191 bp, Homo sapiens
tcacagaccaccaccatgaggaagtagaagggtagggaaaggctggtgccattatactctaaagctccttccctgcccagagaaacaaacatcaggaatatggaagaggcaccccctctccaaaggcctgcaggtaggcatagtataatgttgagtcctgaaaagaaaagttaaaaatatttaaaggaggc

SEQ ID NO: 142529 - DNA, 704 bp, Homo sapiens
aactgctacctgcagagatctgagaaggctgcctggaagagtaggcacaatttgggcaggccagagtatcgtacctttaaggcaggagcagacgaaataggagagccctaataaaggaagagaactgttagctttgctggtgtgttggtggcctctagcggttatggcagagattacaggcttcctggacttgataacttagctgggctgctgtgggtcggccatgggagctactgagtataacggtttgcttccctgaagcagaacaaaagagcccaaggagaggctaggggtggcagctggctgaaagaggctcggaatagtgtggacagagcaccttgcactggagaaatcaattgacctttcgtggttttttgttgttgtcaatgcctctgttgcccaggctggagtgaagtggtgcaatctcggttcactgcaacctccacctcgcaggtttaaatgatcttcccacctcagcctctggagtagctgggactacaggcatgcaccaccacacccagctaattgttgtattttttctagagacagggttttgccatgttgctcacacttgtctcgaactcctggactcaagtgatctgctcacctcagcctgccaaagtgctgggattacaggcttgcaccaccacgcctggcctcagttgaccttattaaaggatggagcagctggacatggtggcaca

SEQ ID NO: 142530 - DNA, 278 bp, Homo sapiens
gcaagtgcaacgtgtcagggttacacgaggaattctctttacctctgatcaaaataaagtcatcagctcttcaagtttaaccttaaaaacacaggtctgggctgggcgcagtgactcatgcctgtaatcctagcactttgggaggccgaggcgggcatataacctgaggccaggaattcgagaccagcctggccaacatggtgaactccatctccactaaaaatacaaaattaggtgggtgtggtggcagagggaattcagacactttgcatccagag

SEQ ID NO: 142531 - DNA, 479 bp, Homo sapiens
cccccaagtagctgggattacagccacgcgccaaagtgccaggctaatttttgtatttttagtagagacgaggtttcaccatgttggcaggaaaatcgcttgaacctgggaagcaaagttgcagtgagccgagatcgtgccatcgcactccagcctgggtgacagagcaagactccatctcgaaaaataataataataataattttacactggcacagaccactttaccaaaaaaagcatcttatattaactgtactctctgacctagttacctaatgtacagacacacagtacatcttatattacttggcacaccaacaagttagctatacaaatcacaattccaacccaaacttgaagctagtaaatatatttagtatttgaacttgagttgtgttcaaatgttcattaaattggcctatgcaatcttaacaatgttctaacacatatttaaaatgctcatttctcctccattattt

SEQ ID NO: 142532 - DNA, 361 bp, Homo sapiens
atatagaacatttccatcattgaaaattctgttgaatagtgctgctttcttttttaccttagatattccaatgtaccctctccttcttggaaggactgttccaccaacttgtcaccaggctaacacctaaacatctgtcaaatctcagagtaaatgtcattacagcaaggtcttcccaatccaaattagacccctttgttatctatattagaagctacttcctttgatagtacacatcataatttgtaattacgtattgtatatatttgaagcttaccttttctactgtacacttggaaaaggcagagactaggttattttgttcattactgaacacacaataaatactactgaggccagg

SEQ ID NO: 142533 - DNA, 363 bp, Homo sapiens
gcttcaaggaaagagccatgccaagagagggagtctgcttcatctttactatacggtcggtaactcggaaatgaccagcctgtcttacagctctagtggaggtcaaaggagagagagtgaataatattcatgtacacacatgaagtatacatgaagtgtacctgtcaacaaaattcatatgtacaatgaagaattacactaaaagcaatgcttttctccagcacttataactacctcttctcccttcttctcttccatgggtcctttcttccattattatttcatctatccatctgtttttacgcccatccttccatctgtcttgctatccatatctccattcattcattccgtactccccag

SEQ ID NO: 142534 - DNA, 802 bp, Homo sapiens
gtattttaagctaatttttattttgttcatctgttcacccagtacaacctttctgctgtgaggacagaattctggctctgtgacaggcgtcttttttggagaccctccttcaagagccctgctgcctataaatcataggtaagccttgctttcccaagattttttttgccttccttcaaaaagtgcttatgtcattcctctgattctgtaccttcatggttatcagagacagggagaatccccttcacgtttttgaaacttctgtattactgatcctttaaaaatttaggttatagtacattgtactatctgacattaatggcagctgttcatttttatttgttcccctttagaacatctgaaatagttgatggtcctgattgaaccactcagcatatagagaagtagcaaactcgaatctttaaatctcatgacaatttggaaatcagctttttctttattctttttttaaaaaaacttaacctaattttccccccattttgttaaaagactcagtcttgtctccacttaggttaaataacaagatgttaaccattgtgagtattttcaacattatttcctcaatgccatataatttttattataatcactaaagttttcaagatattttgaaagagacttaaaatgggggtcagtacttcacttatttttgagacagagtcgtacgtcttactctgttgcccaggctggagtacagtggtgagatcatggctcactgcagccttgaactccagggttcaagtgatcctgccaccaagtggctagcaatttttaaattttt

SEQ ID NO: 142535 - DNA, 344 bp, Homo sapiens
tgggtcttggctggtcctaagagggaacggggagcacagctggggtcacagcctcagccgggactcctgccctccagcccctcagcatcctccctgcgtgtgctctcctgggggctgctcagggcaggtggcgagtaggggagctgtgggaccagagagagggggtggacgtgcccagggcctgccctcttggcctgccgtggagacccacccaggcatacctgggggctgaccctcccctgcagagagcagggtgaaccccagccctgccctcgcctaagagccaggttcgaggggagtgtaatttataatgaaccccactcctccccccaacacccaccaca

SEQ ID NO: 142536 - DNA, 450 bp, Homo sapiens
cccacactccacactggccttgcaaccatgcccctcccactgtctctctctgaccaggcttcaccctggctcatgaatgttcggcttactctccaccccatcaaggacgtcctccagcattgaaggccctccacaatctgtcctccatctaactttgccctccttgttctacctggccaagttctggggtctgatggaacccctgtgaaggggttgagaaggggaaagataaaggatggggtgagggagagagtgttagcacagcctctgatctcaaatggaaaagtgctttgaaaagtgtaaggactttgccaaaggaagttctgattgctcttcctgtaagtgtctgtgcacccatgtacctgtgggaatgacacccatgggacaaggcttctttcagggtgtgtgtgtgggcacatctgtgtgtcggaatgggtgtgtgtgtgcacc

SEQ ID NO: 142537 - DNA, 187 bp, Homo sapiens
gattccagtaatgtttcgctcaactttccctggagccttcgcccgcagtctcctcaaggccctgccagctttcacgcacggtctcactgagggtgtcaggcgcctcccacacatgttaggttctgctacggcagtgcctcacttccaggtaccaaatcctgttccaggcatctgttgctgcatagca

SEQ ID NO: 142538 - DNA, 606 bp, Homo sapiens
ccgagtagctgggactacaggcgcccatcaccatgcccggctaattttttgtattttttagtagagatagggtttcaccgtgttagccaggatggccttgatctcttgacctcgtgatccacccgcctcggcctcccaaagtgctgggattacaggcgtgagccaccacgcccggctcttttctggactcttaacaatcagtagccactgttgataagtctgcaaatatgagaggtaaacactatagagggagagaatgaacagcctggtacaatgagatattttcttaagaaagaacttcccaggctgactggactttggattgatcctccactaggcttcacagaaatccctaagactttgcattacagtattacatttcttttacatttcctagaataaaggtggtaagagaatagatcaatgaatttttaagactgtaagagagctaaagaagtcaagagtgttctcttgaagagggtctgggcgtaggaggctgtgtgctttgggtgaatatctttgctcaggtacttcctaacagaaaagcagtgtgaatgcataacaggtaaactgaggccaggtttatccacatgagactactcatag

SEQ ID NO: 142539 - DNA, 238 bp, Homo sapiens
ctctgtctcccaagctgaaagtgctactttcagtttgttaaagtaaatgttaaagtacttactttaacattccaaaaaattattcttataccaaaaacatttttagagattgaagaacagtataaaaccttttcctgttcactgacattagtgtttatttttctgacttttaaaattatgtcactgatccaaatattctttgtgaatgctagagaaagtatttcattctctttttgtg

SEQ ID NO: 142540 - DNA, 387 bp, Homo sapiens
ataaactgtatcagagcagaaaccttcaccctcttaatttaaccgccatattcccggtacctacaacagcgtctggcacatagaaggcatttttaaacatccttgctgagtgaaccaatatcccagaaacctctcacagctagttcatcttacaggagaaacagtattaaagagttaattaaatggccaggcgcggtggctcacgcctgtaatcccagcacattgggaggccgaggcgggcggatcactcgaggtcaggagatcgacaccagcctggccaacatggtgaaaccccctctctactgaaaatacaaacattagccaggcgtgatggtggaagcctgtaatcccagctactcaggaggctgaggtgggacaatcgcttga

SEQ ID NO: 142541 - DNA, 379 bp, Homo sapiens
acagtgtgtcttctgcacacaaaggaggcatggctaatctcacattgtttatgaccactgctctggagtgaagggagatgttgcatagtgcagagaaaagcaaaaatgatctgggaatgaccagagctgggttctggtgccacagctgtttctcagagcttgagtttctggtcccatagaaagagggtgtatagttatcagaattttccaaacctcaatttattcacacactattttcataagtttcatcagagcttcaaatatatattttttcaattggctttttttttttttttcaaaattcgcatgcgtttatcctcttatctgcccccacttctttcctacctacggtgggactgtgcctacggggggtacggtg

SEQ ID NO: 142542 - DNA, 625 bp, Homo sapiens
atacacataacattatcacacagatttttctgacatacgatcttggtgtaattgaagacatactagttatattatgtcacgataatgtcaacttgatttgaatatggtctagccttctaaatcatattttttttattgtggtaagtacacttaacgtgaaatcttccctcttaatacatttttaagtgcacaatacagtattgataactataggtacaatattgtacggcagatctctagagctgattcagggtaaagtatcagttatgcattctctactttaaatagcccaccttcctctgaggtggctacaaaagaaaaataaatagcatcttttccaatgtcccatcataaattattgtggattgatgatttatttttagacatttatcctgcactgtgtgtataatttagggggagaacaagcaaaaaaggaattttcttaaccaaaacaacaataatgatcatacaaacaaaagacacaaaatgaattctggagacagacagatttaaatccagggtcacaatttacttgttgtgtgaccttgggcaagctactcctaagtcttagtttagaagataatcatatctatttcacaggattaaataagatagtatacagaaa

SEQ ID NO: 142543 - DNA, 161 bp, Homo sapiens
gtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataact

SEQ ID NO: 142544 - DNA, 424 bp, Homo sapiens
tgggtattgaagggcaacttaacactagctgggcagagcaacaggagaaggctggacctggtaggacaaccttagtatgcagttctggagtcttgagagatcctgactcttacactaaccacaagtcacttgaggtggcaacagtatagcagagttagcaagtacaggcttcgtgttcatttcacacatatttgaatatttgtctttgtgtctttgggcaagttattgaacctctctaagcctcaaatccaaaagcgataataataggaccagctagtgttaagttgcccttcaatacccagttcagaagccctttccttcaggaagccctcctgggctgcacgtaccctcccaccaggccaaaggcctccctgcccctacacaccccactggtctggatcggcggccccggctctgcactagt

SEQ ID NO: 142545 - DNA, 106 bp, Homo sapiens
ttcactggccaagcccctggatgtctctcagtgagggaggagcatcttagatctacagggacaaggagacttcttgggctggaccacttcttgtggagaattataa

SEQ ID NO: 142546 - DNA, 576 bp, Homo sapiens
gtcagcagctaagtgaaaaagtcacccgatcaaaccttgagatgactacagccccaggtggcaccttgattgcagctttggaagagaccctgagctagaggatactcaacagcaaggccccctggattcaaaacccactgaaaccataagataatctgtttttgttgttttaagccattaagttttggagtgacttgtgacacagcaagaggtagtgaatatactgtgtgatgtagtcaaggacatagctccagaaaaatctctcccctttctcttgcaacatcaaaccaaatagcctgtagtcccaattatttgggaggctgagaaaggaggatcacttgagcccaggagttctgggctgtagtgcactatgcccattggatgcctgcaataagttcagcatcaatatgttgacctcctggtagatagggaccaccaggttgcctaaggaggggtgaactggcacaggttggaaatggagcaagtcaaaactcctgcactgatgagtagtacgattgcacctgtaaatagccaaagcaatgtagcctggacaacatagcaagaccccatctcttt

SEQ ID NO: 142547 - DNA, 243 bp, Homo sapiens
cgctaaaatggtaaagaaaccccgagtgggatgaacataaaactcaggatcgattactctgtggagagggagaggacaggtgacagcacagcctgctcctggggacagaggaaggtggtcagaggagggcagagaaggaaggagccgcttggacagacctggcaatgagtgggggacacagcagggtgagagctgggctctgcaccccaatccccagctgccccaagccccacctgcgcctgc

SEQ ID NO: 142548 - DNA, 440 bp, Homo sapiens
tccgtccatgatactctctttgctaggctgttgattttaggtgattcaaggaacacctactatttcaggcttttttaaacatcctggtaaataacctaaccacttgagtggtcactgaaaaatgttccaacgaaggttatcacgggaccttagttaaatcaacatatttttcagttcttgcttaacttgctttatctacaacagttacaatgtggcagtgtactaccaatagttgttcaatgaatgttacatgtccacaaaatggatggcactaaatcatctacacaagggaatattttgtccttcaaagtttaactttggccatgattttaaaagccacactggagcagtaaaacaatttgggctgattaaagtacaaagtaaaaagggttcttaaacatttaaagaaagcaggctgctttgtaaaaagcctcttcctc

SEQ ID NO: 142549 - DNA, 374 bp, Homo sapiens
ggctctggactatggaggaacgctgctttcccttccgggccaatttgctacttcagtgggctgtgtttgcgctgggctcttctgtttcaaagtattagagcactcgatgtgcacaacttggaaaacatctgaatttctgcacgaaattaattttgcccaagagtcgggacacatcgacacatccacttttgggggggcttggtgcactcctgggacagtgtggggtgaaagggtccctttcaggagtgaattccctgaccctggacactcagctctcctcctggttggcagagtgaagagtgtcatgatttccaggacccctccccgcttcagctttcagttcatcgctcactctggcttgaaaacagtactga

SEQ ID NO: 142550 - DNA, 250 bp, Homo sapiens
gaaatgagctaaagatgtttactagttttttaattgggaaattcatgttcagttaaggtaaatgttttctccagaataaagattgtgattttttacttaaggattctgtgtctcaacccagatttctttcaagccatgaattatatatatagttgtcccttgtggggaattggttccaggaccttcctcagataccaaaatccatggatgctcaagtccctgatataaaatctgtagtatttgcacatag

SEQ ID NO: 142551 - DNA, 205 bp, Homo sapiens
ggatttgctggtgcagtacaactaggcttaatagctcgaattcgaggctcgaattcgactcgaattcgaggccagggaggctagaacagccttgaggaaggatgagaagggtgtggaaaagatgctggagagggaaaattttcgtttttatactaagaacaatggaaacataaaaatgaaaggatcaaaatcgctgaacactaaa

SEQ ID NO: 142552 - DNA, 209 bp, Homo sapiens
tgcttcctctttctgacctcacagcttctgagccacttttttcatctatttccaactcatttttgcctccttccttggaacccaagcaacaagctgacattatttccttgtctctaggcatccttttaaagatcatgtttccccatgatactgtcaagttgtgttttgttttttatggttttatcctttcactgccatcttcctctgct

SEQ ID NO: 142553 - DNA, 296 bp, Homo sapiens
acgctcagtagggtacgggacgcgcgcggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcacaggcccatattgggcagtggcctcagtcaggcccgctggccgccctgccacac

SEQ ID NO: 142554 - DNA, 333 bp, Homo sapiens
gtttaactcttgatgagggaaatatgtttccaaggttcttcagagaactcttcatcacctcctgttccaatgtttgttagttaattaactaataaaacactttatgtcatacgatcgtagtccctttcattagagggtctgaaagcaagctgttgcttaatcaagggcccagtcacagttgagttcagggatgctgaactcagtgatgcttcccagcccaagcaggaacaaagcaaatctgcccaataatttggaacatacagggaagtttgtgtattcccttgaaaacaggattgccatcactgacctagactcctgctgacagggcaggag

SEQ ID NO: 142555 - DNA, 417 bp, Homo sapiens
ccctgcccttcccctcttgggatggtgcaccatggtgtttacggcacccctacaaggcagctctgtcttctcactttgaaacctcagcttacagggccacagctgtcacttgccatttgggcttcccccaggtgaaagggaaggccagggtgatcaagttgactagcggctttgattcccctggactggaatgtgctcagtaagccacagaaacaggagctgtcagagcagaggcttaggagacgagcaggcgagttctcgtgggtgatccatcatgcaggacttgcgctcgtgatgaatgcggagatagtactgaacctgaatccgatcaactgtgttattcacagtattgacaacttccttcctggcctctgacctgccagtgatgagcctgtgttgtctgacttatattcttgg

SEQ ID NO: 142556 - DNA, 436 bp, Homo sapiens
tatatgtatatacaccatggaatactactcagtcataaaaagaaatgcaataatggcatttgcagcaacctgagtggaattggagaccattattctaagtgaagtaactcaggaatggaaaaccaaacatcgcatgttctcactcctaagtgggagctaagctatgaggatgcaaagacatgagaatgatacagtgggccgggcacatgctgggattacaggcatgagccaccacacccggccacaatttggtaagttttaacatctgtatatacccataaaaccatcaccaggatatgatgagcatatccatccaaccaacaaagagttcttgtgctctcttcttccttctccccaagtaagatttgaactccaatgctactgattagttcaacttttttcagaattttgtataaatcatcatacagggccaggc

SEQ ID NO: 142557 - DNA, 485 bp, Homo sapiens
tacaggggtgagccactgcgcccggcccccagtgctactttctgtaccaccttttggatttgtattagcccatcctcagaatcttgggtaccttttgcattttcttccaagttcccttggtggaaaaacaaaaacaatctctgtaccatatttcagagccacattctatagaaaatcatattttcaaaagatggcagcgacaatatctctcacccttaatgttcttttccaatatgactttaccacaccccttattaagaacaggagcctatttcttcttctcttggatttggattggcccaagcaacatgctaactagtagaatgaatcagaagggatgttctgggacttatgagactagttcacaagaggacttgctcttggatcagtccttttcagacttgccatgccccaaccaatgctgttggaagctcatgccaaatggagaggccacatacatgttctgtgcttgacaaccccagctg

SEQ ID NO: 142558 - DNA, 710 bp, Homo sapiens
gattcatccatatgtttgtgtgtagcggtagtacatcctttttcattgctatatagtattccattgtttgtttataccacattttattgattctgttgctggtggacatttgtactgtttccagttgctatggacatttttgtacatatctcctgaggtctatgtacattggaactgctgcatcttagaatgtgtgctccttgggccgggccgtggtggttcacacctgtaatcccagcactttgggagaccgaagtgggtggatcatgaggtcaagagatcaagaccatcctggctaacacagtgaaaccccgtctcaactaaaaatacaaaaaattagccgggtgtggtggcgcactcggtggcgcaatcccagctgctctggaggctgaggcaggagaatcactgaacctgggaggcagaggatgcagtgagttgagatcgcaccactgcattccagcctgggcgacagagtgagactccatctcaaaaaaaaaaaaaaaaaaaagtgtgctccttcaactttacgagataatgcggaactattttccaagtggctgcactgatttaccctcccaccagcagagatgagtttcatttgctccatgtgctcagatatgttcactttagcattttgatcgtgtagagtgtgatagccgatggttttagattgcatttctgtgattactaatgaagttgagtacagactt

SEQ ID NO: 142559 - DNA, 428 bp, Homo sapiens
tctctgcctgtgtctcctttgtaagcttcatctgaggttttcctacttaagccatggcctggaaatcctggcataacttcttcccacaaatcatggcacagagaccttgccaccaggaacaggcaaagtgatttgatattcaaagacccttggagcaaggaggcatattgctaggagatgaaaaataggttggaggtttaggcagcgacgttcaaaaggtagacactcacaccataaggcctacctttattaactagcttaaggtgggtatctattttgggatccaacagaaggtgggaaggctgggtttcctccttgttgaagccaccctactcttcatgcctgagtcctaatggggtaaagccaccaggtatttgtttggattctgttcctggctcagaaaatgacacagaactttcttccagtac

SEQ ID NO: 142560 - DNA, 165 bp, Homo sapiens
aaaaccaaaccaatggaataaaactaatattttaaaagataatctaagaaaatgttccagaagtaaaaggaagacataaatttgtattttgaaagagttcatgcacttagaaaagttgacccagaatggttaatttgaatatagactaggaaaactattagaatt

SEQ ID NO: 142561 - DNA, 164 bp, Homo sapiens
tctatgaagagatgactgattctaacacctacttcacaagggtgttacaagcaataattcagacatttcaagttaattagaaaatgaaagtatcggcaatgattattctaaaaaagctcaacagtacttaacttattactgttattattatttctgagataggg

SEQ ID NO: 142562 - DNA, 202 bp, Homo sapiens
agcagtatctttagcctctcttcctcccactgttgactctctctgtgtgttggtatagcacagggagctctgggctgacatgattccagtttaggaagtccagaggaaagataacactttccaaccccatataatagatgccagggggctccgcacagtggtttaggcttaacaatcccagcactttgggaggccaaggtgg

SEQ ID NO: 142563 - DNA, 734 bp, Homo sapiens
gggccaggcactttgacctcatgaagttggccttgtctcccaattcgtgcattttcggagcaatgtcacttccttactctgagatctctctggtactactttttgtcatttctctctgcttcttcttaaactcagttttttgaacccggaatcaacaacatcaaaaattcctagattttactgtatttttttgctgtgggaaattgtctgacactcagtcaaaacacaggtatttactcaggacctgctggctgctggtcagcactggatgagaggttctgcaggattacacatgaacagcacatcacagttcctaacatgaatgaacatataagctatttggaaagaaaagatgatagagaacaacagaagatgttctgtaatggatggataaaacgtatcactggctccagtacaggtagaccccagagatgaagtttgaggctagaagtggcaaaagaccattgtaggcaagatccagggttggggtttggcattgtgtgcatagtgggggcaaaaaaggcagtcctgtgtggttgaccctgtggccaaggctgagagagatgatttgtatgatcaagagaggctgatggactatgtgaagtgtatatcttatctcaatcacccaacactttatattgaaagtgaggatatcacacaagtaaattttgtttgtgtttatataacttggcacttatgttttcaatatcatgttgtaaaataaatgtctttaa

SEQ ID NO: 142564 - DNA, 396 bp, Homo sapiens
acagaacagtcactcagttcctaaagtcagtgccagtcatgcctgggtaaaaagccttacctacgctcttccctgtaccttccacaatctacctcaatgcctggaatgactggggctgtcggcaccaccccctcactgtaggagttcctatggtagggtcattccagatgggggctgtgggagtgacccctcacactcatagaagttcgggaagcaaagttagaccttcagccccccactgacagcatcccagctacagagagtgcagccgccctccttaccttgaaaccctccctcccttttcgcttctgaaaacctgagtcctggccccggctgggcaagctggctcaagcctgtaatcccagcaggaagcccaggcaggcagatcacctgagc

SEQ ID NO: 142565 - DNA, 383 bp, Homo sapiens
ggtgccctggtatgtgtcccaaaagaatgggacaggggacaccacggtccagaaatctgctttctgaaaccccagccctggccctctggcctcagagtgtgtatagttagttctctctctctttttttttttttttttttggaaagggagttcggctcttgtggcccaggttagagtgcaatggggcgatctgggctcacggaaacctctgcctcccaggtgcaaacgatttctcctgtttcaacctcccgaatagcgggaataacgggattgcgccaccacactgggcaaatttggaatctccagtggaggcagggttcctccgtgaagctacagggttggtctcgaactcccgacctcgggtgatctgccagttgtgtcac

SEQ ID NO: 142566 - DNA, 424 bp, Homo sapiens
tttataatattcagtttaatgaagttgctgcactttcgagcactgtgatcaggggtttcagtatggaaaaatctcatcctgtccctgaaggatgattttggcaatatgtatcaaaagccagacaaacacaccctttgacctagcaatcctacttcaagatgtttatcattggaaaagaaacagcaatctgtgctaacatacctattgaagacaatcattacaaaactatatccgggaaattgaaagcaaccctaaggtttcgagaagtggtattaatttaagatgccgagcgcggtggctcacacctgtaatcccagcattttgggaggccaaggcaggcagatcacctgaggtcaggagttcaagaccagcatggccaacatggtgaaaccccatctctactaaaaatacaaaaattagctcg

SEQ ID NO: 142567 - DNA, 340 bp, Homo sapiens
agaagaaagcagcggttagaaccgtattattctctttgatgtaataaagtcagctattagatatgagaaagggatttcagaagcctggattaaggtggcatctttggaactttgattatcaaggaggaaatgagtggcaattactgactttattacatcaaagagaataatacggttctgaccgctgctttcttgatttcctgaggaattacaagtagcagagaggaaaaaaattactcttctacctaccagaaaagaacttacaagatgtgaattcctgcttagtagccatgtaccctggagtaaatgacaacctcatgtataagatggctaataaact

SEQ ID NO: 142568 - DNA, 283 bp, Homo sapiens
caggctgatggtagggaactgctctgctagagaggctttggcaattactcagagatgtttacaaggatttatttcttagagtggtttgatttccagaaaaattgcctttaaaaaaagctggataaaacaggttccacattacacttgtatgagttgtcctgaatggcataaattatttttcctgaggctattagctcagagtctgagcaacacactggtgtttttacaggagtctaatgcatagagattacggctgactctccattttatataattcctgacc

SEQ ID NO: 142569 - DNA, 268 bp, Homo sapiens
aaaattaggacaaatgtaaatgcagtagatgaaagcagtcatctgttgaagtgatcaggatgttgcctttaaatgatggtctgaaccaatcatgatgggacagttattgacctaaagacaagtaacatttagccagttttattgagtcttgtttgaagaaaaatcaggaacttaaaagcaagaaatctgtagtatttatctgatgttaacagagacagaaagagagagagagaattcaatcttgccaatgatccaatggtttattggg

SEQ ID NO: 142570 - DNA, 397 bp, Homo sapiens
gaccacagggtcactcagaccttctcctgatgctgaagctgagtccgtgttatcagaacattgattccagagggaaccgctgttcccagttgacccattgcagctcagctcagcttttgcccttttcttggttgttcctctccagcccctcctaagattttcgggatggggtggcagattcgaggagcaggaggggcctggacatggtgggcagagtcaggagcagctccatgccccagggtcagccgattccctccgagcctcaggtgccttgctgtgaaatagggagaccataggtgcctgggcatggatcggcctcgggggccaggtcagccgtgaatgtccaggcgaagctgtgtttggccagggcatggaagggtgtggtcatgtgaggggc

SEQ ID NO: 142571 - DNA, 306 bp, Homo sapiens
ttattcttagaccatagcttgggtctttgatctagtccagagtaagagaattttagtatatgaaggacctggaaattataaccaatggtataataatagtcattcttagaattgaaggaactttagtttgtaaagcatttttcatgcatcatctcattttgatattttcagaatcaagtagagattatcgtaatcttatacagatgaggaaactgactctgaaagtttaataatttacctacatctggcctttcaacaaccaagtttagtgctattatactacttctaattattttgagaaaagag

SEQ ID NO: 142572 - DNA, 305 bp, Homo sapiens
ccagagatgaatcacagtgaaaagtgggcaccacctccagataattaagcttgagctccaacttattgcaggtgagtaagtgatcagaaaggaagatgaagctggtgaattatggccctgctttcttctactgcaagcagccttctagaagccttaaatctgcttttcttagagtctttaaagctactatttaatactccagagagacaacaaaactagattaggtttgactctcaaggatatgaccttacttgtctggggaaataagcataagacggtaggttcacagctttcctgttctttaa

SEQ ID NO: 142573 - DNA, 345 bp, Homo sapiens
aagtaagtgagcatggaagccgtctttaccatggtggcgtcttctattttcagtaaatttgaactttattttatcagtatttcatggtaagagtgacaaatatcaaagcttaggatgtccacttctaacaggagaccctccccattataagcgggaatacaaaatcttcactttcaggttgtgaaaaaggatgaggcgtcctgagtagttatagcctagattccaagtgcctgagtattctggggaaccccaagtcttgattgtggcatcgataaacaccggtgtttatcgatgccaccaatgccccatcgtggagagcggcggggcattggtggtatgggtacc

SEQ ID NO: 142574 - DNA, 245 bp, Homo sapiens
atgcacctgtaattctaggtgctattaagttagttagccatgtaaaaaaaaacccatagagatgggagaccaaggataatttgtgattcataacctgtaacaacgcatgtcaagcgtgttcacgtttttttagttgatcttgatttatcattattagagtcctttagatgtctttataagttattcttgatgcaaaaacattcattataacataatagcaaaaaagaagccatttagttatacag

SEQ ID NO: 142575 - DNA, 235 bp, Homo sapiens
ggcgaatatagactctcccaactcacgtgcgttattctgtctccatctctcccacaaggttaccaagcaccttagacacccccctaacaaagaacacacacacacacacaagaaagtgagcaggatttactcagagttggggtttcacctactggtttactcagaagctacacaaaagaataaggcagttatgtgtattagcaaatgtgttgctgaaataagggaccacgtggat

SEQ ID NO: 142576 - DNA, 368 bp, Homo sapiens
gatgtctattagtgtttttaatccacagataatgtatatgatatatgtctaccaagagatatgaaattgcatttctagtatttagacattaagcagtgcaattgccaggaatcagctggcaggattgtctgtcgtgaactggccttgcatagaatagagagaggagaagcacggagggtatgtcgtttgttttagactcattagtcctattagtttgttaagccagttgcatgtattagtttaatttaaaaaaataacttcatttgggaggccaaggtgggtggattacctgaggtcaggagtttgagaccagcctgaccaacacggtgaaaccccgtctctactaataatacaaaaaaaatagccag

SEQ ID NO: 142577 - DNA, 115 bp, Homo sapiens
ggcatagggagagtagagagaagggctgagccagcagaaaaaagccttttgagcttacagaaaaaagttctgatcaaatttaaggtcaaagtcaggtttacagttcaaggtcaag

SEQ ID NO: 142578 - DNA, 169 bp, Homo sapiens
caaaccatgctagcaaggaagagaagggacaccaaaaaaaggagaaaaatgcctgaacaattcacaagctattaaaaaaaattttttaaggccgctggatctagaattattttctagtctttttttctgaaaaagagcaataacgcctgaacaactcacaaactattaa

SEQ ID NO: 142579 - DNA, 320 bp, Homo sapiens
ttgctgccatcccatcatcctgccacccaagatccccactatcctgacaaagccacaatcggagccgcttcttcatgaagtctctgatctccccaaatggatgtaagctttctctctgtgcatcccatggtgcttggttccggcttctcatgccgtatcctgctttgtagaaccatcatcagagagtgttaaaagagcttcaacgaataccttctttcagggcaccaggcctcactgttgtacatatggtttcacttaatcctccaatactcctagagttttatgttcttgtcattctgcctccctgtcagtggacagta

SEQ ID NO: 142580 - DNA, 581 bp, Homo sapiens
ttagcctcaagcatacccatccaatcagcttaaattgttcagcagttgacctctgtgcttcttcctttgggggtgtttaatctttggtaacagttgtgcagtggtagccttatttcggggggcagtccctactttctgtcacttatcgaggcctttgccaaagaaaagtggaagccgtttccttgacatagccttatatgacctgatgtcattaggagaagagttaaaagacagtatcccctctctcctgcttgtgtgccaagttcagtgttccctttgcatttttttggggtgggttggctatattacagaattccaccaaaagtgctaagtgtcccctcctgcagaagtatcgtttgtattcacagtaggctacgtgtggatgtttcagccatctgctctgctccctgggtccccgggtcaccaccatactgagaaatataggactctgccaaagagacgtggaggccacgtcggcttgtcatggtgtcctggaagactctccagcagccagaagaaccttctgtgctgttttcactagagaagatttgagttgcagcctcttggaaagaacatgacgg

SEQ ID NO: 142581 - DNA, 181 bp, Homo sapiens
ccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctct

SEQ ID NO: 142582 - DNA, 297 bp, Homo sapiens
gctgtccgtgggctgtctgagggcaggtggacaggatgttccctggggcagcagacattcctggtcgaaggtgacaggcagcggggagatttaccatttccggtaacccgagtccctgggatgtcgcattctctttgccaaggacacggcatccctcccttgccagcccttcctgccatttcctaggctgggcctgtctgactggggcttgaagacaggctggagggaccagctctgggtgccagaggttgagactgagggctctggccctgattagcacccccacaaagacctagc

SEQ ID NO: 142583 - DNA, 233 bp, Homo sapiens
caatagtcctcccttatccacagtttcactctctacagtttcagttacctgcggtcaatcatggtctgaactattaaatggaaaactccagaaacaaacaactcataagttttaaattgcacaccattctgagtagcatgataaaatctctcaacattctgtgccatcctgcccaggaggtgaatgtccttttgtccagcatatccacactatagatgctacttgcctgttag

SEQ ID NO: 142584 - DNA, 729 bp, Homo sapiens
tcatcacacctgccacctgccaggcaagcgggagcctcgtagcagaggcctcgcatcccacaggccctcctggaggggtgggcagagggcagcccgccaacaccgtctgtcatccagctgtcaaagccattaccaacacggcaagataaccatccttgtggggaattattatttggaagtaggaccagaaatgcaagttaaaccgcaagatgccaccacacagccataattaaaaagacaaatgccaccaagtgctggcatgatgcagaagagctagagtccttccacaccactcgacggggcacgaatggggcagcaactatgggaagaattgagcagctcccggaaagacagccacagagtgaccactcggccagccctagagcagtgacaccctcgtccacacaggcacgtgcatattcacaaacagtacactagccacgatagccccgacgtccatctgtgggcgactggagaaacgaggtatgcctccactcaggggacactgctcagccatgaaacagggaagacaagcccaggcgcagtggctcacacctgtcatcccagcactttgggaggccgaagcgggtggatcacttgagctcaggagttcgagaccagcctggccaacatgatgaaaccccgtctttactgcaaatacaaaaaattagccaggcatggtggtgggcgcctgtactatcagcatcatggggacttggagcgctcgtg

SEQ ID NO: 142585 - DNA, 776 bp, Homo sapiens
aaagttacccactgctaccccaaatactgaatattgccagaaaatctgtaaatgattacataatgtttacacctttataagtggtaactttgtaggtaaatattattcaagttatgaacctctgatttaggaaacctccttatgcaaatggttggcttcccactacagaaacatcagtaataagatagtggtttagactcccaaatctgcgaccagtctgtatgtttgaatcctggcttatgatcagtcatagctgagtgatcgtgggcaagttattcaaccgctttgtgcctcagtttcctcatctgtaaaaggataataggataataatggctcctaccttatgggattgtgaaaattaaatgagaatgtgtgtttatgtatgtgtgtgtttgtctgtatttgtacctaataccctattggagtttaccactattatttactgttcctcttctcttttcctccctgtgtaaacagccccataagttatctggaagttccctagtatctctttcttatcttctgttactggaagactcctttttcttctgtctttggtcccgtgttagttgcttcattttaattgaggctatcttgttctagtgtgcaatacattctcattgatcccttccctatacatttcttgcctagacactttgaaaaagtgtttttgttttgggtggaaactgaacattttctaataatgactcataaacccagccaggtgttaaggatactcctatatcaaggaaaatgaaagctatacagtctcaagc

SEQ ID NO: 142586 - DNA, 1020 bp, Homo sapiens
aggacatcgggggaaggctttagacttcctcagaacatggcttctaatccccagaaccctctagagctgagagtcaaggccaactgagcatgctgagctcccacctttctcttcccagtaggaagcccagggaccttggctctgaaagtatcaaccgaggccagaggcgaagcaaggcaggtcccagccatggccgccacaccacagcttgtccccctcattgctgtgcattccttcagcacttggagcgcagttttagtttgcactccgttaatttgtaagtgttcttttgtcttttttccttggctgtcctgactccctcacccaacaggggctccccaagggtgggggctgccttccttgtcagcctcctcagcggaagccctgcactagtgcccctgcacccaaaggctatagggtgcgtggcacggaccctgcaaagagcaaaagagctgctggatggtgcaaaatgcaaagccccaacaaacaaggtgatgaaggggcagtgtcctcattttccaggtgggaaactgaggctgagggaggctccacagccacatcagactggcagaaagaggtggagcaggaacctagattttgttttcctaccagagcctcagctcactctgctacactgccctgcctccctaccacacagtcctgcacttccagagtacatgtgagattagcaagccttcaaggcacaaactgggtcttattcatcttcatcttcctgggggaacccgggctgaacttttcttctccccagggaccctccaaagaacttcagggaaggaccagtgaaacatgaggctgccaggagcaccaaactctgacctctcatcaccttatcagaggggctcctttggagcctgagatgtgagagtatgtggcacccagacactaggcaggtcccaggctggacgggttcagtcccagaataatcaacccacttgccatggatacggaaggggggaagggaagggcacggtctctggctagggctccacccccaggcct

SEQ ID NO: 142587 - DNA, 120 bp, Homo sapiens
atcctctggagaaccctgactatacattatgttctatatattttgttcactttattcttccttgtcacggttaaacacaaaagtcaccccttataaataaaacaaacacccaaatcgagg

SEQ ID NO: 142588 - DNA, 427 bp, Homo sapiens
cttgtctttttattaaagtgaaaaataattcatataccatcaattcacccttttaaagtgtacaatttggtggttctctgtgcatttacaaaattgtacaactgtcaccactctaattccagaacatttttatcaccccaaaagaaaccctgtacctattaccagtcactacccattctcctatgatgccagctaaaatctactttgtgtttctatggatttgccaattttggacattttatatgaatggtcatacagtatatagccatgtagccttatgtgtctagcttcttttatttagtataatgttttcaaggaggaactgccaaacttccaaagcagctgtaccactttacattaagaagagtgatgtatgagggtttcagtttctccacatcttctgcaacttaccatctcttttactaca

SEQ ID NO: 142589 - DNA, 228 bp, Homo sapiens
gcaccctgccctgaattccaaaaattacctgcccccaattttcagtgggccctgctcatgttttggcataatttgcaattccacttggagcacctggtgccagctacttagctgaatcgctatgtggaaggctgaactccttgcacctgtgccttctccaacctctcctgttagcttggcctgtcccactctgaagggcatgtctagtgccaagtctcagtccctttc

SEQ ID NO: 142590 - DNA, 253 bp, Homo sapiens
cattaaacaaataagcacaccagtaacgacacaaaaataattgtgaaagtgctctgaaggaaaagtacaggatagatagagcaagaaaatgccttcctgagaaaggctgtatacctgagatttgaaggggggcatgccctgaggcaggaaggagcttggcacattccagaaactgaggggcagccaatgagaaaatgcatggcattcatttgaatagtctcactggaggtaaatctgcatcatcctctgaggg

SEQ ID NO: 142591 - DNA, 349 bp, Homo sapiens
gcagtgatatatttttatgatataatggaacttggttggcctggatttgcttttgtcttcaattcccaatattatgttttattcacctgagcttttggtaaacacggaggggctgtaagcttgggattaagttaagctccctgacaaatttcggaaatgtagatatcagttatgatctgaatgacactggatttgaggaaattgttaatggtttcttgtgacttgtgtggcaggtagatgaccttcttacttttatttaccttgagtagcattttgggtagaatgtgcagtaactagtaaatttgaaatttgtgaagagtttaagatttgcccttttcgaaaatgggat

SEQ ID NO: 142592 - DNA, 383 bp, Homo sapiens
ggcaacatagtgaaaccccatctctattaaaaattacaattataagtgctgggtgtgcacctatagtcccagctacttgggaggttgaatcaggaggaatcccttgagcctagcagttcaaagttgcagtgagctatgatcacgccactgcactccagcctgggcaacagagctagatcctatctcaaaaaataaaaataaaaataaaaaattaggagttcaaaaaaaggcagggtggttaaagtattaaaggcagtggtcaggggaagcctggctgggaaggcaagatttgagcaaacattggaaggagggtagggagtgacctatggggaggggcagccaagcaaagtccccgtggtgggaacagaataataagcagtggc

SEQ ID NO: 142593 - DNA, 271 bp, Homo sapiens
tctagaagcgttgagaccacaaatcccttgaaattgtatgcaatgtagtacatacatgtttattttgggggatggagggtatagaaagttttcatcagattctcaaaaaggtccagtgaccccttcaccccaaaaaccacattgccttaagaaactgactggctgtcaaatctgaaaacaagaaggaacaccatgtttagctatgtgcaaggagttatctggcattctttagtaacaaaaattatattattaatggacattgagagattta

SEQ ID NO: 142594 - DNA, 455 bp, Homo sapiens
caagatgaaatttgggtggggacacagccaaaccatatcaatgctgctatgaacattggtgtacaaatatctgctttcaaatcctagagtatattcctacaaatattaatgctgtttctaacctgaagtaattgagatgcagagatgtgaagtaattgagatgcagagatgtatgtctgaagtcatacaactacttggtgatggtgctgggtttctgggtttacttgttcccttccattgatcccaaaggacacatgcgagactgccttaaggcgaagtgttttccttccttttttgagatgacagtgtcagcttgtgggaaaggttggcattgaagtctaccagatctgagttcaaaaccaggcacttgcctttgctaagcatgatgtcgtagccaatctctggctccatttgcgatgtctacctcatggggattgttgaaatgattaaatgtg

SEQ ID NO: 142595 - DNA, 735 bp, Homo sapiens
atggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgagcgaagggttttgttacagcatgtgcatgaaggctatgaaaaagatctgtgggagtacattgaggactgagaatggacctgcataaaatgaactctgaaaactttaccatctagagtgtctcatgcaattaagactatacaaacacatatctaggaggcactaagcctattacgacacggctggtctgta

SEQ ID NO: 142596 - DNA, 471 bp, Homo sapiens
tgccaagagacagaatcttttctcagatgccatatcttctagaaggaccaggtgatgctccttctctgaagttcttctcaaagctgtgaccacaaaacccagcttcaggagtagtgacagggtgacacagaggcccctttatggagagttgacgggcgatttttttgaagatcccaatggctgtgggtcccgccagaaagtcttatcttttctcagaataggggaaatgcattgtcggggaaacatcagaggctcccttacttgagacactcattaaaacagttgaggggataagagccaggcctcccagcgataagaggtctgagttcttgggatcagaatgtctggatgggtgattcccactccaggggcagacctcagcatgtgggagctgcctcagcacaacaaggctattgtaggatgccaagagcaaggacaatgcactgagctccggtctctgcccccagatct

SEQ ID NO: 142597 - DNA, 174 bp, Homo sapiens
ggagttcaagatcagtctgggcaacatagcaagatcctgtctccaacaaaaataaccccaaaactcccttttccctttttccaaacacttaatcccgaagaatgtccagatcaaactcttaaaaccatctgcatctttccattccaaagtctactcactgatctgaagcaccaa

SEQ ID NO: 142598 - DNA, 434 bp, Homo sapiens
cttagattccctgcctccagacccaggtgttttctcttttagaaagttagcataaattgacctcagattccgtgcccccaaatcttggtgtttttccttgattcagcacgaaatggccttcagttccctgcctccagaccctattctcctgcctcagttggggaaatgtgtaagtatttctaattcacccttatactaaagggtagatccttgtgatttcagcactgtgtgaagttctactcgtagatataaactgtattttccatcttctgttgacaaggctgtgaaaacccatgctcaggttcatccagctcagcaaacgtctcaaggaagaagtcatctctctgggttctgccttcaattagtttttctccagagtgtttttttctctctctttccagattaaagacctatttaaagaaaactttaaaata

SEQ ID NO: 142599 - DNA, 724 bp, Homo sapiens
ttagtccatcctagaattatctccttaggacactggtatttttctgcctttggactccaagtgaaacactgactcttcctgggtctcaaacctgccagcctgaaggctggaacttcaccatcagttctcctgggtctccagtttgctgaatgcatatcttggaacttgtcaactttcatagtcataatcttgctttgtcacccaggctggagtgcagtggcatgatctcagctcattacaacatctgcctcccaggttcaagcaattttcctgcctccacctcctgagtagctgggactacagttgcataccaccacatctggctaatttttgtatttttagtagagagagggtttcaacgtgttgaccagctggtctcgaactcctgacctcaggtgatccacccgccttggccttctgaagtactgtgattacaaccgtgagccaccgcgcccagcctgaatcctgactttctgacctagggcaatttaacaaaattttctgaatctcagtttctccatatttcattgagcaatgaaagtgtctttctcacaacattgtgatgaatcataaaatggaaaagaacaaagcaacacagaatattaaactcaatgcctgttacataatcaatgatgcatacattagtactattagagtcaggtattgctatgtctatgacaataactacagatgttctttactagaacgtgaagaaggaacaaaa

SEQ ID NO: 142600 - DNA, 693 bp, Homo sapiens
ggacgtcggggaggcctcttgctcatgcatggttcgcctcatgacggccaccgtggcagccacagcctgagctcccaggctcctcttttcagcagtggatttcaggagtgaaatggaggccgggtgcggtggctcacgcctgtaatcccagcactttgggaggctgaggtgggcagatcacctgaggttaggagttagagaccagcctggccaacatggtgaaaccccatctctactaaaaatacaaaaattagccaggcgtggtggcgcacatctgtagtcccagctactcgggaggctgaagcacgagaattgcttgaacccaggaggcagaggttgcagtgagcctgggcgacagagcaagactctgtctcaaaaaaaaaaaacagaagaaagaaactgaataaggccgggtgcggcggctcacacctgtaattccagcactttgggaggccaaggagggcggatcacgaggtcaggagatcgagaccatcctggctaacacggtgaaaccccatctctactaaaaatagaaaaaaaattagccgggcgtggtggcgggtgcctgtagtcccagctactcgagaggctgaggcaggagaacggcgtgaacccgggaggcagaggtttcagtgagctgagaccgtgctactgcactccagcctgggcgacagagcgagactctgtctcaaa

SEQ ID NO: 142601 - DNA, 507 bp, Homo sapiens
attttctgtgtttgcatctcagctctgccactttgtagctctgtgacctaggactaactcaacttcctgagtctcaattttcttgtctataaaatgatgaaaatgctgcccatctcatagagttatgaggattaaatgagcgaatacatgtagattccttagaatagtggctgacacttggtaagtgtcattagatatcattagcatttctatatctttcactttatatgtctcttctggctgtcttcatgtgtgcatagttgtactcttgctaagaaatgcatagatttacttaaggatgttgtgaagcttgtccacagaattataatgtggttttggagtctttagtatattataatagagggaaaagttattactgtcaattttttccaccttcaaaaacaattattgcttaagaattactgggattaattatcttttaaatgtttaaatctgaattcatatttataaaattaatacctgttcaaaatcaatattagtagaagc

SEQ ID NO: 142602 - DNA, 284 bp, Homo sapiens
atgaaactgccagtaaaatcatagaaatgcctcctatcaattatacatttgttagcaatgacaaccttcacatccatttttacttgcgccactaaaactttaagtaatataatacttagagtttctccttttctctatgcttcaaactacagacttctccacatgttctttaccttctctccacacatacacacacatacacatgcaagctttatgcttgtcagaaatcactgaattactcttcccagaaatgtcagctcagaatggtttagacacccagctgg

SEQ ID NO: 142603 - DNA, 483 bp, Homo sapiens
gatgtgagcagaaacaaaggaagacaaatctagactgatgggattttcattgacataagcaatagaggcaatcagtgagatttgtttggacatcttgagtttgaggagcccatagattaccccagcaggattgcccagttagtaactggatagacaggtctggagctcagaaaagaagccgaggctggagatgcagatctggaaatcagtaacatataactgaagccatggtagtaagtggaatcatccacagagactgtgtagcatgaggaccaaaagccaaggagagagcctgagaaattcctaatgcttaaaggatggccagaagaagagagatcagaggagactgtgaagaagtggtttattgaagttggagaaggtagcagacgttatttctcaaagtcaagagagggcagatttttgagaaatgaagagtggtcaatagtgttgaacggcattgagaagtcaagtaggatgaggcct

SEQ ID NO: 142604 - DNA, 399 bp, Homo sapiens
cagtagagatgagacagagaaagatactattgactggcaaggacctttactctgtgtgatctgaggattcactgaaggtggccaaatctgtatttaaataagatgactatggccgcaggttgaaggatggattaaattggaggcagggaaagtgggccatagaagatatttaaacaaaaggtgagtaggcactgaattaggatagcagcaaaagtacagaaattaaaatggacttagaagaaaaaaaggttggacatggctggttgagggtaggagttgtgagagaaggaagtcaaattcgtattgcctgacttaatttaaaaagaggccagatatgatggctcacgcctgtactttggaatgctggggctggtggatcacctgaggtcaggagtttga

SEQ ID NO: 142605 - DNA, 740 bp, Homo sapiens
ggtgtgatggcggggacctgtaatctcagctactcgggaggctgaggtaggagaattgcttgaacctgggaggcagaggttgcggtgagccaagatcacgccaccgactctagcctggccgacagagcaagactccgtctcaaaacaaaaacaaaaacaaaagacaatgttgagtggtgggtcttctgctttaacccctccaacacctctgactcccgccttgtctccctccagccatgcgggttcccaccctccagcctcagcctgtccccatctgtgtccctcagactcagaggtgtcctccccagagacgcagacatgggcctctgccaccctgtattacagtgccctgcagtcaccgcctgcctgtgcatcccttgccatgctgtgacctcttgtgtctctgttttcttcttggtaaaacggggatacctcagagggcagctgtgcaacaggacaaattcacacacgagacactcgggatgctcctggcacacagacagggtgaagcatcccttgtccccattgtcaccttctctattagctcgggctgccataacaaagtgccatagactgcgcggcttacacagcagaaatttacttcctcctagttctggaggccagaaggccaagatcaaggtgccagcgaattcagtttctgtggaaattctcttccgccttctcactatatcctcacagggcctcttctctagacatgcataaagggagacagatccctg

SEQ ID NO: 142606 - DNA, 548 bp, Homo sapiens
cagtagcaaaacggctgtgcctgctgctctgtatagaaatgtgttaccagaaatatatgccaggaagggtcagtggctttgcatttatgaatcaggtgtgggagctctcaaagaaaaagaactgattgaggtttaccatctctgaggtcatatgcctaaaggtggacttccataggagtctgagagacctgagatatacccatgaaagatacatccttcaaaggcaaaagccaaatagtagccaaagaagaaagcatgagttattttagcctaccaattggtgaagtttgtgaatcacagtctatcactagttaatgcagattatcaagtgtgcaaagcatggagaggaaagatgtcttagccttcctgtctccagagaggtatctgaaattcatgcccgaagtacaactcaagtagatgctaatagagatagagaaaataacaggagaagcagagttggtgagggataaatgacttgctattgaaactgtaaaattatcatgctagaaaggatgaccagccaagattagaattcagggattccaggg

SEQ ID NO: 142607 - DNA, 185 bp, Homo sapiens
cagagaggagtgaagttcagatccggctccagcagagcccctccacccactcaccacataccccttaggcagcagtttccctgcaagtgctggggcagccattcacacacacacagtctgactcagagatttcatcttcccacctgttcacctttgctcaggaagcccctgcccacatcccattc

SEQ ID NO: 142608 - DNA, 303 bp, Homo sapiens
gtcccttatataaaatggcattttatttgcatataacctacatgcatcctcctgcatactctcaatcatccctagattacctaatacctaatacaatgtaactgctacggatgtaagtaattagattatatttttttaatttgttttttttttttgttttttcagaaggggtcttgctatgttgcccaggctgatctcaaattcctgggctcaagccatcctcccatctcagccacccaagtagctgggattacaggtgtgcgtcaccacgtcgggcttaattcatatttttttattattgta

SEQ ID NO: 142609 - DNA, 100 bp, Homo sapiens
ccctagcctctgtgctcagtacaacccaaaaatttccctttgtggtttcatctttactgcattaaacatgcccactctctacccgagacttaaactgaaa

SEQ ID NO: 142610 - DNA, 659 bp, Homo sapiens
acttctctttcctgctgccatgtgaagaaggatgtatttgcttctccttctgccatgatcgtaagtttcctgaggcctccccagccatgttgaactgcaaagacactttcagaagaggaacgaaggcctggaaggaaaagcatcaggggaacgacgcttacgtctctcctcctccctccggtctcccaccagtgctcccattggctgaagccaaccagaagccacaggactctatcacccaggctggagtgcagcagcgcgatctcggctcactgcaacgtccgcctcctgggttcaagtgattctcctgcctcagcctcctgagtagctaggattacaggaatcctgaggtcagcatcatcccaatttcacagagtatgacatgacgtctcagagagggtaagcagcttgccaaacattccacagccaggaagctgtaggaccagcctgtgctcctaaggactggctcctggctgctatatatagaactaagcctggtggaggtgtcagaaatagaggttcacttctgtcatcaccgacctccctccacacctttgcaaaggaggaaactgagaggcagggatttccgcagagcaaggaacccaaattgctgcctcctgtgatttatacactgcaccccaagctgtaggggtaaccca

SEQ ID NO: 142611 - DNA, 538 bp, Homo sapiens
acttctctttcctgctgccatgtgaagaaggatgtatttgcttctccttctgccatgatcgcaaagacactttcagaagaggaacgaaggcctggaaggaaaagcatcaggggaacgacgcttacgtctctcctcctccctccggtctcccaccagtgctcccattggctgaagccaaccagaagccacagggtaagggatcccaggccatagggcacccccaggtcagccatccagggttcggagcaagctgaagggaagatggtaggtggagaggggcaaatggagaacagtcaagtctaggcagatggcactgtgcatgtaaaacccagctaggagagccaccagggggctggtgagcagccagaacccagctcttcaaatcttcaggccagtgtcctcacctgtaaaacaaggatttgaacccaaagaacaccaagatcccctctcatactaggattccagctgatcaccccggcctgggcctgggctctgctctttgcccctgctccccccagcagagaagtagtccagcaag

SEQ ID NO: 142612 - DNA, 494 bp, Homo sapiens
gaaagacctaatacatataataaaggtaacacaagacaaaactctcaccacagcctaacatcttagatgctctacggggtctctgcagtttctattagggaccccatgggtttgaattccattctagatttgataagaaaatccaaatgctcaaccccctcaactccctacccctccaccccatttacaaaagccaagtgaaaactaaggaggggccgggtgcggtggttcacacctgtaatcccagcactttgggaggccgagacgaggagaacacctgaggtcaggagttcaagaccagcctgactaacatggtgaaaccccgtctctactaaaaacacaaaaattagccaggtgtggtggtggacgcctgtaatccctgctacttgggaggctgaggcaggagaatcgcttgaacccggaggcagaggttgcagtgagtggagattgcgccattgcactccagcctgggcgacaagagcgaaactccaaag

SEQ ID NO: 142613 - DNA, 513 bp, Homo sapiens
agaaacatgcccccctcctatcatgcacttcccagcacagaggttgagctgcagtggtcatggagaggcgctgtggagctgaatggagtttgaggctgtctgcccgttagttgtacctattccaccaggtgttttggtgttggaagacttgagatcaagttctcagttggcagtggtttcaaagccctgctgagaagactgactgcctttttgggtacctctattttgaagtggctgtgacatttgactgtaatgtttagctcgaatgtgttttgtgcttgatgagctaatagcatgccttcctctaaagatagtatttcagtggtggcagaagaggcttcctctttggtcttgggggacggggacagaagtcagcttctacccctcgatagaaacttacctggtgccccagaattagtgcagaatacccaaataacaccaagataaaaaaaaggtatcccaccgaattgagttgaggaggggcatcttaattttggttgcatatagaggggg

SEQ ID NO: 142614 - DNA, 391 bp, Homo sapiens
agaaacatgcccccctcctatcatgcacttcccagcacagaggttgagctgcagtggtcatggagaggcgctgtggagctgaatggagtttgaggctgtctgcccgttagttgtacctattccaccaggtgttttggtgttggaagacttgagatcaagttctcagttggcagtggtttcaaagccctgctgagaagactgactgcctttttgggtacctctattttgaagtggctgtgacatttgactgtaatgtttagctcgaattgtatcttctagtgctatcatgtaatgtaactaggcatgccgttactctcgtagaagagtaatatctctagtcggtggctagaagaggggtcctcggtgcacacggggaatcggcaacagaagg

SEQ ID NO: 142615 - DNA, 181 bp, Homo sapiens
ttgtctgtcttcggagacatctgggagaacaggattcctgaggtcacagggtggggagctaagctctggctgccgggctgtaaagctgatgttcaaggggagaggtcccaggctcctctggtggctgggggatggggctataagatggtgagctcgaagctccagggaggagtgggctggg

SEQ ID NO: 142616 - DNA, 210 bp, Homo sapiens
gtattagccacccacagaaaaactcattggaaaaaactcccaacctcgtccatctcatcaagacatacattttaacataaatttacttggaatgttatttatttgtcaaattgtatagcacacatatgctcttttgttcaagtatatattactaacaagttagtactgatgtaatgatcgtgcaattcagaataaatttcttatgtttag

SEQ ID NO: 142617 - DNA, 371 bp, Homo sapiens
ctgcgtcttctgcaactaggcagctctgcatacctctgggcctccccggggtcttgccaggcccctccctggaggttttaagggaaaagcagagagcagaacagagcagaagagtgaggcaccatggaagaaaacatatgtccttcccatgggagactaaacgttccgccaaagtcagcacctttgaacatcatctttgactattaaggcagttgctgacaccaccatttacttctctctcctcttcctcaaaacagacttctatcaaaagacataaaggcagaaccgtgggatcagcaccacacacagctgctttcttcgaacatctgaattatgacttcctgttcctgggatgatgctgggaacagcca

SEQ ID NO: 142618 - DNA, 321 bp, Homo sapiens
ggagtgtgtagactgtagagggatagttggagataatttcagagaaggaaattggaggagggcatgtagggctttgattccagagtgaggagtgttatgtgcttaggaggcaacagggagccgcttgtctgaactctcatctggactggtggaagtccagggtgctggcggtgagagaacaaagtagactcggactgccctggaaaatgcagaaccctgggcacgtaggaccaaaaggggaatcaagactgagactgtcactgaagcataaattcaaagagatgcagatgagaggaggggcctggtggaagatgaaagtct

SEQ ID NO: 142619 - DNA, 453 bp, Homo sapiens
cctgactagccttcctagagcataattccattcacacaatggtccatattcctaactgcacatccaataactgatgattaaaatccacgacccccgccctggtactcaatgccttctatgatctggctgcaacctccctcacggcctagtcttctccctccatctccttcatgcttcctccctctacttccttgcgagtcttgagccccaaattaaacccttccttcttgccctttgatactcaaatttttcctctacaaccctcttacctcctcccactaaaaatgttctcctccatttttttatgtctttctagactcaactagacaattccctgcactagaaagtctcctctaacccttccagacagacagacagatataagccctcctctttaccatgacaagcaggacctaaaatgatgttgacgaccaggtattgagcaccttggta

SEQ ID NO: 142620 - DNA, 161 bp, Homo sapiens
acaaatggatggaaggaaggatgaatgagtggacagatggatgaatgaaggagtagtactctttgtggggcttaactgcactgtctgaattgattagtgtctctactacatttctcatgtgtctctattacatctatgtaacttgggaaagaatatttcct

SEQ ID NO: 142621 - DNA, 373 bp, Homo sapiens
gctccagctccctcttcacttaatcacaggaaaattcctgtccccttggtgcccaagatctaagtctccagttaggaagaaagccttgagtgaattccagtgctaatccgagagccttctcagaggtttttgtttttaaaagactaaaatgggccaggtgcggtggcttgcctgtaatcccaacactttgggaggccaaggcgggtggaccacctgaggttgggagttcaagaccagcctggccaacatggtgaaaccccgtctctactgaaaatacaaaaattagccagcgtggtggcgggcgcctgtaatcccagctacttgggaggctgaagcaagagaatcacttaaacttgggaagcagaagttgcag

SEQ ID NO: 142622 - DNA, 288 bp, Homo sapiens
agcggaaggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcacc

SEQ ID NO: 142623 - DNA, 389 bp, Homo sapiens
ctttcctggagggagtcagcagggtccccttgagtggtgggtaaccctaagatggtcttgttggctaacccttggacctggacacaggagaacattcgaaattggccttagcctggagaatctgggatggattcttgtagtttatataggagtccgtgctggggaggagcagttggggctatattcctactgctgggacctcattttttcctttcctcccagaagctcaagtgtaatgggaagggaaaggtgttgaagtcagggtaaggtgacggggccgccaagacaggaggcgcggggcacacccagggccagctttgcagcaagttgggctgcagcctggtggttgtggggatttctgcacctggtgcttacaggtgtcaagagtg

SEQ ID NO: 142624 - DNA, 732 bp, Homo sapiens
gccagttgaggatcagtgagaagataaattacctttgaaattgtaatgttaaatttggggagaatgagactgaaattagaggggatttaaagtatagcaatgaaatatgttggcttctagcaagtaccgttacactgttttcctgtctctgttaattaacatcagtttgctgttaccttactttgttgctttaaacaaaaatttcagcctctagatctgtaaagtgatctatacatttaaaggaatgaaatagtttatttaatcagaatatagaataaatgtagcaaataggagtgtagagtacccaaggattgtcagaagctttttgctaacctattcattgtgtgttacaaccacctcaccaaagttcacctgtctacctatctatccttgaatgagattaaatgctattatgaggttattttctttgtgtttttttttttttagacggagtcttgctctgtcacctaggctggagcacggtggcgcgatctcggctcactgatcctggctctctgcctcccgggttcaagcgattctcctgcctcagcctcccgggtagctgggactacagacgtgcaccaccacacccggctaatttttgaatttttaatagaaacgaggcttagccatgttggtcaggcatgtcttgaactcctgacctcaggtgatccgcccacctcagcctcccaaagtgctgggattacaggcatgagccactgtgcctggcca

SEQ ID NO: 142625 - DNA, 638 bp, Homo sapiens
ctggatggtgtggtgtggcatgtgattcccagaagcacccaggatggagccaagaggaccaagaggaagcagagccaactcctgatgggccaggcctcaagcctcacctacccctgcatggctcactgtgtgagaattattattattgtttaagtcattaattttgcagtgggttttctgattcagcagctaaaggcttcccaaaagattcacattccttcaggagtgggttttcttccctgacccatttcctggatatagtgctcagaacgcaaacttgaaatcagttatttaaaatgatgcttgcacgttgctgaatggagacgttctactgtacccaacagaaacttaagtgagttacttatatcagccaaaccttgatcctactgagattaaaacccagcctgggctcctgcctgggactcataccagtgggccttgctccctctctggagtcttctccgtgtgtcagcagcataagcatcaagatgaacagttttgaaagacagcctttgccaccaaatgtcccttaattctcttaatggcatcatcatcctttaaagcatccaggctcaaaatcttggtcctcatggacacccgcctccctggcctctatcatgcattcaggcattcagttc

SEQ ID NO: 142626 - DNA, 585 bp, Homo sapiens
gcctcctgagtaattgggattacagggacgcacacacaccagctaattttttgtatctttagtagagatgggatggggtgtcaccatgtcggccaggctggtctcgaactcctgacctcatgatctgcccacctcggcctcccaataaatggctgttgttttaagctgctgagcctgcagtaatttgttacaacagtgatagaaaatgaatacaggataacaggtaactcctgcttcagggcaggaggcctgatgggtcccatgtctcgctgcatagacagacaggccaccctttcagacctacaggaatacttgtcgtttcattggtgcttgtcgtggctgcagatcaaacactggatttacacccctggcactcatgcacaaaagtcttatcctggaaaaacaattcagcagcctgttcaaaacattttttttcctgctgagccatggagttctttgttgcaattccaagtttggggatcacagatataatttacttaaccttaaaaaaaatttttttttatcaagtgctatgctgtctattagaaaaaggaaagtgagaaatcccagtgcaactgtagggtc

SEQ ID NO: 142627 - DNA, 540 bp, Homo sapiens
catacgaaaactagctgggattacaggcacttgccaccacgcctggcttatttttgtatttttagtagagatggggtttcaccatgttggccaggctggtcttgaactcctggcctcaagtgatccgtccgcctcggcctcccaaagtgctgggattataggcatgagccactgctcccagctcagccattattttaatttatgaatggtttgtatacctagttaaaaaataatttggggggatgggggggacagagtctccttctgtcacccaggctggagtgcagtggtgcagtcatggctcactgcagccttgacctcactggctcaagcagtcctcctaccccaggctcccaagtagctggaaccctaggtgcgcatcaccacactcagctaagttttaaatttttttatagagaccaggtctcactgtggtgcccaggctggtcttgaactcctgtgcttaaccagtccacctacctcagcctcccaaagtgctgggattacaggcatgagctaccatgcccaacaacaaaaaaa

SEQ ID NO: 142628 - DNA, 601 bp, Homo sapiens
accagttcacctcctattcaccactccactaatgcaccagttcacctcctattcaccactccactaattcaccagttcacctcctattcaccactccactaattcaccagttcacctcctattcaccactccactaattcaccagttcacctcctattcaccactccactaatgcaccagttcacctcctattcaccactccactaattcaccagttcacctcctattcaccactccactaatgcaccagttcacctcctattcaccactccactaatgcaccagttcacctcctattcaccactccactaatgcaccagttcacctcctattcaccactccactaatgcaccagttcacctcctattcaccactccgctaatgcaccagttcacctcctattcaccactccgctaattcaccagttcacctcctattcaccactccgctaattcaccagttcacctcctattcaccactccgctaatgcaccagttcacctcctattcaccactccgctaatgcaccagttcacctcctattcaccactccgctaatgcaccagttcacctcctattcaccactccgctaatgcaccagt

SEQ ID NO: 142629 - DNA, 360 bp, Homo sapiens
cgttcctcccagagaggaagggagtgatgctgctggagctgtttcaaacggacggacggaatcacttcatctgtaatccagacacatgcatgcatcaggcaaacataaaattctgttgtcttctctgaagtagaattctataaaggcagcatttccaaggccaaaaagatgaccgaacagacagtgccctgttgatccagctagaatgagctctgcaacaccatcaattttgtcctacagctctttttctggtccttgtccgtgtaccagtcactccttataatgaagtcacttgattgagtgttgttcctgttgcaagcagggagaggaaagctgagaagccattcaataaatgttatg

SEQ ID NO: 142630 - DNA, 164 bp, Homo sapiens
gttaatattctgtgcatattcttccagatagttttaaatacaaacataaacacacatatgcacacacgtgttttataatagaggttatgttacacatgctattaaataacctgactttctaccttattgtgtcagagatattttataaatagttacttttaaag

SEQ ID NO: 142631 - DNA, 268 bp, Homo sapiens
ttcacaaaccggacaacaggcctattcctgtgcacctgaagtagaccatcagcccagtaccagccctttggaccaaggtcctggagacagtagagaccaccctgggcccagacaggatccacgcctgctagagcccctgatagtaggctcaccaactgtggactccattgtggacccagcagcagtcatgttacctggctccaaaagcatttggctacaatcccataggcaaactcatttgcctgggaacttgtactgcctgggaact

SEQ ID NO: 142632 - DNA, 294 bp, Homo sapiens
ccggctcccagcaggcgtcgttgcctctgccctcctgctcgctctatgctctgccaccagcatttcatcctgtggatgacaacgccaggtggatgcagtgttcttccattggttacttagctccccagattatctgtggaaaggagtgggggcttctaaactgtccactgccaatggggtgcagggtgactgttcctgaaggcagcccttcagggcacagctggccaggggtggccttgtgagtggacacaacaggcttttaggtctctttcttgggcagggcatctcttgcca

SEQ ID NO: 142633 - DNA, 315 bp, Homo sapiens
gaaggctggggtggctgtggcaatgtattaaaataagacagcactgaagtttgccatagtgattaactcttcctttcacaaaaagagttctctgtgccatactatgctgtttgatggcattttacacaatagaactttcaaacttggagtcaatcaatcctctcaaatcttgtcacatcaaccaagtttatgtaatattgtaaatcctttgttgtcatttaacaatgttcacatcatcttcaccaagagtagattctatctgaagaaatcactttctttgctcatgcataagaggcaactcttcatcctttcaag

SEQ ID NO: 142634 - DNA, 397 bp, Homo sapiens
ggagatgcagatgggatggggatggccccataggctggtctggactttccctgtgcccaaggccagacactggggaaagctcagggagagaagagaacttgcaaagcggagtcacattcttctctctcatggcgggttcctcctgaggggcctgctcttgtgagatgacatgaagaaggggaatggggagaatggcggccagaagaagacatatgacattccccagggtcaatggtgcggcccgtgtgtctatctactggccctccactcctcctgcgccactttcttccttccccacagccaccatcctagtccaggccatgcccggccactggctgcagcctccattgcctcccttctccatcctttgggtcctctgcccacagccagagggacc

SEQ ID NO: 142635 - DNA, 767 bp, Homo sapiens
cctcatataacatagaaacaattgcccaaatagcaggggaaacaaaggagacacctatccatggagggcaaatggtgctgattgatgttagtaggggggcgtccagtgaaggtctcctgcagttcccctcggcttgttaatcccttcatgggttccaggaaagatgatgcaggtgaatcccaaaactggggctcagcccaggagggttcttggcttcatgcaggaaggaattcaagggtgagccaacagagtaaagtgaaagcaaaccaagtttattaagagcaacagaatacaggaaaatggctgctccatagatagagcagggctaccccataagcagagtagcactcatggattgctgactaactctatttatagctactccttaattatatgctaaataaggggcaggttattcataaatttcctagaaaaggatgaggagttctcaaaaccaaaggttcctcctcttttaaaccatataatagcttctggacattgccatggcatttgtaaactgttatggcaccagtgtgagtatcttttagcatgctaatgtattataattagtgtataacacagatcaagggcaattagagatcacattcgttgccatcttggttttagctgatttagctgatttatttaatgcctcctgttttgattagcaaggttgtgaccagtgtttggaaaacaagtcctgctgatctacctctatataagataattaaattagataatccatgtaaagtgttcatttggaacat

SEQ ID NO: 142636 - DNA, 319 bp, Homo sapiens
catttaggctgttttcatttttcacttgttcaatcaatgctgccatgtacactccagcagtacactgcagtagtggcttgtgtgagatttctccaggtgtgtcctagggttggagctgctgggttgcagggtctgttcatctccaaggaggttgtccacaccagggcttttaccgccagctgcctcacaatagagaagcatccagtcaccagggcctcccttggccccatgcaggtccgggtgtccaccccaatcaacagttttgcttatttctggtccacaaaaaggtttcagttattttgatcttggctagaccttt

SEQ ID NO: 142637 - DNA, 262 bp, Homo sapiens
agcagattatttgtgctggtgtgttggaggggaagaaggatgaaaaatcatgaaatctgagacccaatgagttcaatttcttggttcacagatgaggaaagggatgtttctaaatgtttaatagaaaggtaaagaggtttgctcagtgtcacatatttagtggcataccaaatgatctgttgaaatgagcacagggctgggagtcaggagtctggattcttccaataactgattccgatagctttcctgtgcccactggcct

SEQ ID NO: 142638 - DNA, 415 bp, Homo sapiens
gaggggactacacaaggacagaaacaccagaaggcgagaatgactggggctatgttagaagccaagatttggtctcagaaagtaatgtgtaaagtaattttaattatttgttatttttaatgagcaaggtccacaggccggacgtggtggctcacgcctgtaatcccagcactttgggaggctgaggtgggtggatcacgaggtcaagagttcaggaccagcctggccaatgtggtgaaaccccgtctctgctaaaaatacaaaaattagctgggcgtggtggtgcgcatgtagtcccagctgctcgggaggctgaggcaggagaatcatttgaacccaggaagtggaggttgcagtgagccaagactgcaccactgcactccagcctgggcgatagagcgacactgtctcaaaa

SEQ ID NO: 142639 - DNA, 341 bp, Homo sapiens
tgcttggcgtgcaagagacacacacacgtttggtgtcagaagcgtgtatgagagtagaggaaattgtatggtttgtttgttcttttataagctacattcttaaggccaaggataaagccttggtctttcaagttaaaaaaacaaaatataccttttgtaaatcttacctcaacccctatgaaataagcaaaagtgagatcagcacacccatttgcaaatgaggctcaagagtggtcaaatcccctgcatgcaggggctggtaagaactgcggatttaattctaatttagaacaggccagagaaccagaagtcatgaatgatacctacaaagaatgcaagaa

SEQ ID NO: 142640 - DNA, 503 bp, Homo sapiens
tcctggcattacttctgtttcattcaacagcatacacaccagagtgtctcttacatattatatacatcagtagaggccgggcgaggtggctcatgcctgtaatctcagcactttgggaggccaaggcaggcagatcacctgagggcaggagttccagaggatcctgggcaacatggtgaaaccctgtctctacgaaaaaaatataaaacttagctgggcgtggtggcttgtgcctgtggtcccagctacttgggaggctgaggtgggagaatctcttgagccctggaggtggaggttacagtagctaagatcacacagtccagcctgggtgacagaatgagaccctgtcttaaaaaaaattgtggaaatgttgaggaaataaaacactaaaatttagcaattcaaggaattattattggactaatgattgactagttggatttcctttttttttttacagtttaatctggaaaaatggacctgccagtatattttgtaattcg

SEQ ID NO: 142641 - DNA, 525 bp, Homo sapiens
aactatgtaacctctctgtgtctcagttacaaaagaaacttttcctatgttggctggaagggttaaattaaataatgcatataaatggcttataaaattatatggtcaaaggaattacattctaatttttgaaattttttcaaaggaaattttcagttttaatgcccaatctactgggtgaaacaaaagagattccaggtataccttcccctttcccaaaaaaagataatcaaaagcaaaacatagtagcttatcccttgtcctgatacaagcaagctaataaaatcttgtgtactttagggcaggtagtgccacctcacatacatggtttaactgaagtgtttcactgaagttagctgatcaagagccactttgcacttgaccaatctttaagtgctgctatgcctggaccaaatgtgacttcagccaggagaacccaggccttagaatttaggagccattaggtcaagatgtctccagtggtgggtggggcagcagaagggtgatggttgatggagcaggtgt

SEQ ID NO: 142642 - DNA, 458 bp, Homo sapiens
ggcagggaagcaattgcagtggtctgggcccaacccttctggcagagcaaacaggcactctcaagtctcctctgtgcctcagctcaggttgtgtctgggtgcttcccaccctgttcctgagaaggcctctccctcaggcccttctcacgcaggttcctgagaaggccacctgcttgctgtgacccaaccatttccccgacatcacctggtgcccagccctgtctgattgccaagagaacaggcactgagggcactcatggcagccccagattttggaaatggggaaggaacaggcaagactgcttagagataggaaagaatatatgtgagtttggtggtcaagggtgttcagagaatggattctggccagtgagcatgactgactgaagatgtattagtatagaaaccagaacctgaaacttaaaaaatacatacatatatatatcctttttagccct

SEQ ID NO: 142643 - DNA, 705 bp, Homo sapiens
tgttaagtgaatttcccaaggtccacacaagtcagtggtagaagcaatcttcagagtgcatattctaacccctccaccataaacctctctagattctctagactggttctaaattctgtagcctcacattcaccttcctccctaagcattgtttactactgtaactttccctcgttgcttccaccagggatgctaaacctcaccactattaacattttggaatgcataattccttgttgtggagtttgacagcatccctggcctctatgtactagacacagtagccacaacctcctccccagtgtgatgatcaaaaacgtctgtagacattgccaaatgttccctgtgagcaaaatctactgactgagaaccactgacttacatggattcttctgattaaactgaattacctgatactcctaaaacacatatttctccctctatgctttttcacatttgttttcccctcttgagcttacagtgttcttggcctcctcctcatcaatcttctctgtttcatagtctttcagttcctcagcatcttttacagccagaggaaatactaacctgtctggttactgatctgcttgtttctatgccttttttgtttaaaaaatggtcaccacttccaaacttttgatttaaagtcccttaaagatccctggagtcttgagtttaaaatttagtttgtactatgcattccac

SEQ ID NO: 142644 - DNA, 302 bp, Homo sapiens
taaaagacaacgaggcaaagggagacgttaggatgtgagtctgatcagggagaaaggagtttagaactttctctcagggatccaggaagctaacaccccagcttcataactcacttccactgtacctactctagtaactggtaatatgccggctcaagggggtgtgtggaggaaggtcaggaaaaagggagggaggaagtcagccttattctgtgagctgtatttgtctgggggtgccctccccactagaaaatgttccccaatctcagcagggccctcaatagtcccattctccaccccat

SEQ ID NO: 142645 - DNA, 471 bp, Homo sapiens
tctgaggatccccgtttggggtctttgctggtactgtggagtctgtgtcacctggtattattgggaggatgagggagaattaaatgaattgctggggtgtttggagaagctgtaagtttcaatgaaggggtcactcatgacaggaggacccattcccttcctactccaccccttctcctgctccacagaaaggagagatggagaagaccctctccaggtcaagtgaccttacaataaggccaccaccttgctgtgttccgcaggacaggagactatgggactcctcctcctcacccaactctaatagcaagtgaatggtcagtctgtcattcctctgatcacaacaccttggggaaggcggagcagtgagtgaagatgaagcccattagaaacgttccaggagagttccaaccctgagcagggtttccacctgccccttggagacaagaaaggctggcataaccgcaaaag

SEQ ID NO: 142646 - DNA, 239 bp, Homo sapiens
atctgggattacaggcacctgccaccatgcctggctaattttttctgtatttttagtagagacagggtttcaccatgttggccaggctggtcttgaactcctgacctcaggtgatctgcctacctcggcctcccaaagtgttgggattaccagcatgagccaccgcacctggccagttagttattttcaattctatcccttcactacaattcgaatactcacttttcttcctctagctg

SEQ ID NO: 142647 - DNA, 281 bp, Homo sapiens
agcagatttaaagagagatctgcaccttgcttccaaggttcacatagtttgccctgtaggagtaaagagcgtcctgccagccacaaagaagcaaagtaggcctaggcctctgatccataagtagaggaataagagtaggaattcttttttcatcctgaaggccagaaaggggctctaggctgggcatggtggctcatgcctgtaatccctgcagtttgggaggccgatgtgggtggattgcttgagggcagatgtttgaaaccagcctgggccacatagca

SEQ ID NO: 142648 - DNA, 408 bp, Homo sapiens
agcactgatgccctggccacccacccctggttcccacctcctgagcctgctggggctcctttttacattcctttggggatcagagggcaggctggttctactgctcaggctggagggatgggatgggaacagaccatcatgggattagctgaaccgctccctctccctgggccactccaatgtggcttttaggtactggcttgccttttgggccagtgaccagggaggggcttcttggaatgtggggacacatgggggcatggggagcccatgtggtgctccctgaatctcatgtggtccacctgactgtttgccaggatttgaccccaggaatcctgaaaccctaaccctgaagcagcaaaggagggccttgaaagaagaaggtggatggaaagttctagatccaaa

SEQ ID NO: 142649 - DNA, 785 bp, Homo sapiens
tgtatcattaaaatttccacagaacaatgaaccttaataggcgctaatgcaattgtgaattatggtaattgttacctaaattaatctctgtactttccattccttattgccctgtgcataaggagtgtgaaaaagataatgttgaaactgacatttgtataaatggtataaaaatttatcttatttaataaaaatttaatataagaacttgctactttgtaaagtagtttactcagaaaaaaatgttagatttgttgcaagttgggtttataaaatctttaatttgtgaaatttgggagggaaactggcagttgactcattatggttatctttggggtatgtgtatgcaccgaggtatcgggatggtacatgtatgttcctccgtgcacatattgccagggcagtgtatgcattcgtacccttatctgtgtgcctggcctctttctgtgtgtttatgtttactcatttacgtaaactaccctcttggtgtaataaaatccaccattatgtgttgaattgtgttcctctcaaattcatatgctgaagtctcctagttcttcagaatgtgaccatatttgaagataggacctttaaagaggtgattaagttaaaattaggccgtatgtttgggctctaatccagtgtgactggtgtccatctaagaagaaattaggacagagacatagagggaagaccattggaagacacagggataagatggctgtctacaagccaaggagagaggctcctgaagaaaccggccctgccaataccatcttgtcaga

SEQ ID NO: 142650 - DNA, 341 bp, Homo sapiens
tccagtcttgggagggctggctgggaggccaagagcccacctgttctgcttggcttagaggctgggcagtagcagggctgagccactgcctcagagggtggtagtcgggggtggtctgttttgacaagtggagaggagtgaaggggagaaggagagctcgccatccttcttgggcttgctgagtttatgcatttgttttgttttactggcctctgttagtccctggtgcctaccgttctccgtccagcctcaggacttttgcgcatgtggtttccttagcctggaatgtaaagggagccttccttcctgacctggttcgtgcctcttacccctcagatctc

SEQ ID NO: 142651 - DNA, 346 bp, Homo sapiens
ccttacctcagacagataaggactagctatacatgaaacgcagactgtggctaactttaattctttcccaaatcagattttcatgagacattttcagttctttcagtgaggcaaatgaatttctttaatattttacatatccattgttaaaattcaatgcaaaaacaactctaatgtcaaatataaattattttgttgttaagtttaattttgaataatcttcttctcttttctttggcattagaacaaattgcaattactgaagtccaaagaattataaagcactatttaagcatttacattagatatcaaaattgaagaatacaaagactagtttattaatgga

SEQ ID NO: 142652 - DNA, 339 bp, Homo sapiens
gcagaggccaagtcaggaaagcagctaagggaacgtgtacacacatccatgacgtggatagattcccacagtggcctgtagcccctgtgtcagtcctggaacccagtgctatctatgcctgtgaggaccctgcaccaggtccctgctgctctggcctattagagaaaaggaaccttgggggtcattcaggccagaagtccacagacagagctcaggccttctctgcccaagctctaccagagagtttctgcttttattcttttgtatttgtttttctcaatgaggtagtgttttaaaatctggttccatgaggagaaggagaaaggtgaaaatcacctg

SEQ ID NO: 142653 - DNA, 569 bp, Homo sapiens
ttaatattctactcattcgaaaaatatattaaaaattaagatggaaagggaaaaataaacctaaaactgcaagtgtactgaagaaaatgaatctaattgtatttcaaatgaataccataattatggtaaggaaaaaaaacaaagatagaaccaattcaagcaactagtgaatgcagtatttgtgttcagtgttttgtcaggatggaattgagttgggaaggaatttcatacaagtcctaaacctttttttgttttgttttgttttgttttattgttttagtggtggggcaaagcagttctgaaacaattttagatgctttataggtctgagcaaatgtgttcattgttgttgagaagcagaatctcaatgaaaaagaaaagataaaatagaatgaatgaagtcaagaaaggaccctgagttgggtgtgatggtatgcatctatagttccagccacttgggaggctgaagtgggaggatggcttgaggccacagtgtgctattatggtgcctgtgactagccactgtattccagcctgggcaacatagtgacaccttgtctcttaaaagg

SEQ ID NO: 142654 - DNA, 400 bp, Homo sapiens
ccgagggggagtttccttgttgctatatggttaggggagtacatgtaaatcacctgctgtctggagaatgctgaacagaaaagcatcagtgagcagactgttcaggtttgggtgtttggcagacattctttcaaaaataagcgagtgaacctaccactccggagcaaacaacagaccatatctgttgccagtgataaaatttaagctttcaagtgaaaatcagaattttaggaaacttgtattcaccactgtgagcttgacaacttctaggtacttgagactcttctgatgagattggcagcgaccttaacaaacgtgctgttgtatgataaactgtgtcaatgcttttaaaatctgcataactaggtgagctgtcgttttccaaatgaccagtgcatga

SEQ ID NO: 142655 - DNA, 157 bp, Homo sapiens
gccgacgacagggtggacagggagacagttggggggaggaaaggagccagtgtgcaagatagaggatcggagcaccttgttctgcacaggctcagagaacgattctcaaggggaaggagggaggagtggctcatctgtgccaaatgtgaatgaagtt

SEQ ID NO: 142656 - DNA, 383 bp, Homo sapiens
gaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttgga

SEQ ID NO: 142657 - DNA, 868 bp, Homo sapiens
aggactgtgggctggaattgggaggccaattctggaactataatatttgattactaaaataaatgaatatgttttgctttttcttttgcttttgaaatgtattcaaaaatagaaaaatgtttatattaattagttctcatgctgctatgaagaactgcccgagattgggtaatttataaaggaaagaagtttaattgactcacagttctgcagggctggggaggcatcaggaaacttacaatcatggcagaagcagaaacaaacacatccttcttcaaatggtggcaggagagagaaataagtgcccagtgaagggggcagccccttataaaaccatcagatctcatgagaactaactcactgtcacaaaaatagcatgagggtaaccaccccgttattcaattacctcccactgggtccctcccatgacacatagggattacgggaaatagaattcaagatgagatttaggtggtgacgcctaaatcaaaacattgataaactatatcaatgtttaatttggttttgactatatttttagagaatataataaagcttctacatatgaaaatttttttttttttgagacggagttttcactcttgtcacccaggctggagtacaatagtgcgatctcggctcaccgcaacccccacctcactggttcaagcaattctcctacctcagcctcccaagtagctggaattacaggcatgtgcctggttaattttgtatttttaatagagacagggtttctccatgttggtcaggctggtctcaaactcctgacctcaggtgatctgcccgccttggcctcccaaagtgctgggattacaggcgtgagccaccacacccggccggaatgttt

SEQ ID NO: 142658 - DNA, 289 bp, Homo sapiens
ggcaataggacgtggagtgctgtggatcaaaggcactggtggtggctcttgtgatggagaggaagttttggcagagagaggttgaaggaggatgacctgaaggattaaaatgggagccagataagtgagatgtgcagggtgaagggaaggaaggggatggttggggagagataaggatcgccaggggtctaaagttctgaccttatcctgaccaacgtcctgtctattgccataaagggagagaacttttccctctagaaggaaaagaacattgtgataatggtaatgg

SEQ ID NO: 142659 - DNA, 187 bp, Homo sapiens
cagcagcttagccacagcatggcacagtcgcctccttcctgctcataaacctcatccttctctctccttgcagctcctagacacccttaacagaggcttctctttgcttctccctccccatgggaaacaagtagatttggacctcagcttgtcctttgggtagaaagagaccacagatttaccctta

SEQ ID NO: 142660 - DNA, 151 bp, Homo sapiens
ggtattctttcctctgcactaattccacctcctggtggtgcatgccttggagtcccagctactcaggaggccacggtggaaggacagcatgagcccaaaagtttgaggctgcagtgagctatgaccatgcatgtgaatagccactgcaatc

SEQ ID NO: 142661 - DNA, 226 bp, Homo sapiens
  misc_feature (38)..(38): n is a, c, g, or t
  misc_feature (49)..(49): n is a, c, g, or t
tggtgccttcatctcgtcccacctccaccaagtaagtnaatcttaactnctccacttcagaatgctgcctttccccttaaacctcttcttcattcttcccaaagattaactcaaaaaatatttattgagggcaccctacattctaagcattatatcagaacattaaggccaggcacactggcttacacctataatctcggcgctttgggaggtgggaggagaggaa

SEQ ID NO: 142662 - DNA, 213 bp, Homo sapiens
ttttccctgcatctatcctttaaggcttcctgagtctctgaggttgcatttataatggattgttctcattggttaatctttctgagggttagttactcttccactcccatggtttcaactccacatatatatacagtgcaagctcccacatgttaaaacaccagtccagatctctatactaagcttctgatatctacgtttaattccctactt

SEQ ID NO: 142663 - DNA, 1113 bp, Homo sapiens
cagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggtgggt

SEQ ID NO: 142664 - DNA, 538 bp, Homo sapiens
ttaagctgccagggtttgaccttctcacagaatcatttggattattacccaagaccccaattttctagcccagtgtttcaaaaaatgtggtcggtggattacttgagcaccatcccagataaacagaatcataaaatgcataaaattttatgcacgatgatctctgagaacctgtatagacacctgcagaataaactggaggccactgagctttagttgtcttacactttagttggcaaagcttatgataaaaaagtagatcttagtcagtacaccaatatgctttcaaagaatcaaactaataattagtacatagttttaagaataagcagagttatccctctcattatttccatggtactaccaagttaaaacattaaagctactggggaatctaaagtaactacattatgaattcactgcttcatccaagtaagtatccctgatggtttacttagaaaacattttatttttcaccaacatcacagaaggcatgttattgaatcattagttctgatacgtaacacaacttagtctc

SEQ ID NO: 142665 - DNA, 396 bp, Homo sapiens
cgtaacgtcagctctttcacttggcacagatcctggacttgcagaaggcaggagttcgatttctataatggttcttcatcactatctgaaattatcctttttcctattcatttagtgtgcattgcacacccactatatgctagacactgtgtgtgtgcagcaggaatgcagcttacataggagataaaataagacagcaactgaaaaaatgctggtatatgatgtcagcacaggtgttctgaggaagaccgtgcccctgccatcatgcagaggaggagggaaaagaactgggacacataccagtcactagaggccatgagatttttctcttatctgaaagaagaatataaactcaatgtgtcacagactgaggccattctgcagccactaggccat

SEQ ID NO: 142666 - DNA, 372 bp, Homo sapiens
gtcatttaacctgcagatttttaaagtttttttctcccttgttggtgacggctcagtaggagttgagctatatacttaaaattggattttgaatgaaaccttcacatacatcctcctcaacaactcactctcagtttgaaaaagccgtagggggtgacagggcagtggttggactccaaggctatttttaaatgggaatttttgttgttgttttccaagtgtaagaacctttttgttgcctggtatattagggcaacattggaggctgcgaaggttaaggttcaatcattattcattaggttatacaggtatcccacaccaaatctgtttggttcctgggttcaaatagaaagaaccagagagttagtttag

SEQ ID NO: 142667 - DNA, 130 bp, Homo sapiens
cagggtaggtgccagctgaccacagggcgcatcccgattgcatgccctggacaccatcaacctcaagaggcctttgtatgagattctgaagtgattataccataaagatcatatttcaggtccaaaactc

SEQ ID NO: 142668 - DNA, 199 bp, Homo sapiens
cctgtggcttctgcatgcaccttcctcaacccctgaggagggttagatcatcggagcaatattcttgtccaagttccagttttctacagtctggctgtgtagtcatttctgtgtgcttgaaggagcttgtacaagtattgaccacataaggcagcatgttgcaagggtcctacccaacagattaacaggaaagaaatgg

SEQ ID NO: 142669 - DNA, 610 bp, Homo sapiens
gaaaggagacagggaaattagaagtcatttgtaatgaagaggtcatgaatcaaagcaatggctctgatgacacagagaagaaatttgagaaataataaaaagtaaaaccattagatgttagttactgtgagaatgtggggcgtggggtctaaaagtctacattctagctttggtgactgagtggatgtgcaattcccagagataggaaatggttattttcagacatactggatttgaggtgccaccaggagatggcaaatagatcactcagttggagagaaagatctgtaaattatcgataactaagtaatgaaaggaacctggatgagagatcacccagggagagcataaagagtgagaagagatgaaggctgagtctgagattagcaacatttaagtacagtcccattttcctgttaaaaggggtacttttttttacataatcataaactttgttcatgttgggagaaataggaaatgatttagtctttcttcattttgcagatcagaaaactgagggtgtcaaagaggttatgtgactttatttaaagctgttaatctgtagaagtcaatgagaactcaggtttccaaactgaggccaggcagttcc

SEQ ID NO: 142670 - DNA, 339 bp, Homo sapiens
gtgagaaagccagatctaccggtgctcgttatcttcctcctgacttcctcctcctggtatatgctcaggctggagtttaacgagtgagaagagatgaaggctgagtctgagattagcaacatttaagtacagtcccattttcctgttaaaaggggtacttttttttacataatcataaactttgttcatgttgggagaaataggaaatgatttagtctttcttcattttgcagatcagaaaactgagggtgtcaaagaggttatgtgactttatttaaagctgttaatctgtagaagtcaatgagaactcaggtttccaaactgaggccaggcagttcc

SEQ ID NO: 142671 - DNA, 459 bp, Homo sapiens
tagttatgcgcgcacacacacacacacacacatccatccatattcctaattacctaaacatgtcaaaagccatggtttacgcgaatgctttggattcatttgtaacttctttctcctgtggtggggaacccagctcttattatctacagtccttttacttattgttcagttccagtgtacacttattttcagaactgcccatacccgtgtagggaacacacattgactgactagatgagagcatttatgtggttttgtggtttttgcctttggccttacactatccagtcaagacagtggtttccagttacttgtagttcccagtcccttcagtgtggttatcttactatttgtaacatggttagcttcatctgttcgtgttttatttcactttcggcaccctccccatcctagttggttttaatgatttattttgaggggtgtatgaatagtatctga

SEQ ID NO: 142672 - DNA, 348 bp, Homo sapiens
cactctgtcgcccaggctggagcgcagtggcatgatctcggctcactgcaacctctgcctcccaggttcaagcaattcttctgcctcagactactgagtagctgggactacaggtggctgccaccatgccaggctaatttttgtatttttagtagacagggtttcaccatattggccaggctgatctcaaactcctgaccttgtgatccgcccgcttcggcctcccaaagtgctgggattataggcttgagccaccatgcccagcctcatcatgtgtttttataggccaggcttgtggcttctttggcgatccaattctatcaaaagttggaaacatcctgatctatt

SEQ ID NO: 142673 - DNA, 237 bp, Homo sapiens
attaaatacagtcgatggaggtgaggagaggagggagacatcccaggcactggctgctgcacagggaaaagctcgaagtcagctcggtgcatctgttgagagggggattcctgatagaggctgtgaagattaaagaggggaggggcaggatgacaaaggttctcaaaaaacagcgtcccatctggaggcctgtgtcactggagcacttgtattaatagaaacttggccatctctgcc

SEQ ID NO: 142674 - DNA, 354 bp, Homo sapiens
accaaagagagaaacagagggatccaatcacactctccaagccactggcctgggaaggggaaaggacagacaaaggtcatagctgggcttggtcacaggaactgacctggagctgctgactaagggcatcttgaaggatgtaattaccttcctcccttggggccccagaacaaggaagccctacagctgaaaaacagtaattaccaggcagatcgagaagacagcctgggactcgtccctgaggtataaaaggaggactggcggatgtggagccataagacctggggtaaaggagggttctactctcctagctgggagacactgggcagctcatgagcttcctaggacactcag

SEQ ID NO: 142675 - DNA, 425 bp, Homo sapiens
ccacacggtgttctgcaaggaggcgcgtgcatcctgtgcgtgcatcgaacctgctgaatgggaaagtgatcagtgtgaggcggggagtggagggcgggggccgtgagctgagcataggagaggaaaatgaacacgtcgtcccctgcacccttgtcccccacgatgaaggaagaacaaagagccaggcacctgtcagatgaggggaaggacagaatgactcaaggacgggatggacccactccaggctgagccctccctgccctgggcagcccctgcagtcaccttttatcaggatgacacgttcactgccttgtcttggtcaccttttatcaggatcacaccttcactgccttgtcttggttctcatgaattttaggtcttcttggaagccctgcacttcctagccagtgctcagaacacacaag

SEQ ID NO: 142676 - DNA, 334 bp, Homo sapiens
acagggtgcaggaagtataggcgggatgctaacgtggctccagaggagccaatcctgacacgtcacatcctagaggcctgacaacggttacacacacctaccaaggtgcccctcccacaggagctggggcctgccgctctccaaagccctcagccaacaagcccctctcccctcttttcctcctgcctcgtccaccttttctccccacagttctgcaggctcctggtgactggtgcccagggactaatatgaacagacaaacccgctccatgctggcagctaaaccccgtccctcccgtgtgcccaggaccctgatctcagccagtaggagggg

SEQ ID NO: 142677 - DNA, 385 bp, Homo sapiens
gtggagagggagggagattatggtaataatgcaagaccaggctttaggaggagcacgccgggagcaatgtgcaaaatggaattgaggagggagagacagatgcagggtgaatctttacaataccccagctttccaagaaaattgtggttctagttctccaacctcaaagttgaacttctgtagcagcatgggacatggaaggagggtggagatgtgacagggacttaccagacaaaaggggctgcaggacctcaccacactgggctcattcatcttgcaccaatgacttgctcttccaaacaacactgccctttgttaatcttttcttgaaccaggacccacagaaatacactgaccattttctggacctaattccagaatacgc

SEQ ID NO: 142678 - DNA, 166 bp, Homo sapiens
gcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagcta

SEQ ID NO: 142679 - DNA, 500 bp, Homo sapiens
tacagattctggaattttccagttttacgtatagataagttttgaaagtatgatttaagaggatatgaaatgtttgtattggctatacttgaatttttttattgcaaaaatgtctgattttctgagactggttttctaactatttataaagaaaattggttgtggtctctttggaaaatgtagaagaaatgtagttgtgtgttctagtgccttggccagataggcttgctagtctttattgaagtttaatgtattctgacatgaatacaataactaataagggctaaagttgtattgttgttgctttttttttcttaacatttgcaatccacattgaacagtgttttataacaaaatcttagcttatgattcagaataaataattcagaacattcagaataaataatttggtggcagcagcaggagttaagttagtgattttttagagttaagttttaggagctacaatttataaattaaaaattttcctattaaagtta

SEQ ID NO: 142680 - DNA, 382 bp, Homo sapiens
catgctctagccacagggacaagctcaagtggggatagatcactgtgtaaagggaaaatctcatgcaatcttttagctcagagccttctgccattctgtttcttctgccctaagcatatttaaagtcgccaacagagacaaatggagatgaagattaagaaaaagggaaaggctgggcactgtggcttacagctgtaagtccagtgctttggggactgaggcgggaggtttgcttgaagccaggagttcatgaacagtctgtgtaacgaagtgagatatcgtctctacgaaagattaaaaaatttgctgggcatggtggctcatgtctgtggtcccagttactcgggaagttaaggcagcaggattgcttagccctagaggt

SEQ ID NO: 142681 - DNA, 702 bp, Homo sapiens
ctgtagtttcgcttttaaaactgttctgtgaaaataccttatgcagtgctttcttaaaagccccatttgtttacttttactaagctgaaagcacactttacgtctgggagcaaccaaataacagatttgctctcctttgaggactcatcattcagttaaacatttttgaataatgacagtgggtcttgggtttcaaagatgagacccaatttctgcacttgaggaaaccacaggtctaatcggagggcaacagtgtcatctggaagtgccggctcagggatgccgtcctgacggaagtcatgaatgctggaagtgggtctcgcagggtgagaggagtcaccaggtaaagatgggttggaaggacctggcaggcagagcagggagcaggaccccagtccagggcagcagggaagcgggagtctgggcagagctgattccaggcagctcagtattgctggcctgtgcatcctgagacttatccgagtcgcaggtgaagctggtgggaatcaggcagagtgcagagctttagctggggcagggttagccaagagcctgtcatggagctgctctctgggcactgggaaacataagtctggaggctttggctgcagctgcagataaagatgcaggggcctctgacgatgggggccttagtcatctcagaggtggtgcagagggtagaagcctgactggggtcagaga

SEQ ID NO: 142682 - DNA, 392 bp, Homo sapiens
tgtattaacacatggaaaacattgtacaactctctgaagttccttaaaaatcaagttttttacaccaaaagggagaagaagtttagtatgctgggctcctaaccgtgattacctttcctgcagatcccttaaaattaaaccagagctactcttgttttcataaaaaatgcttctgcaaactgtggaatacatagccagtcctcactattaacttgttctcctcacctttctgacaggaattcaacagaatttactgagcactccttgcaaaatcagagcagaagcaggaagtactaacagtgctgaaataacactaactaaaatcttgtctgagagaacagactggatatcattataggctgccatgttctggaaggaaagcttctggtttg

SEQ ID NO: 142683 - DNA, 301 bp, Homo sapiens
tgtatgtgtaaatatacttacatatctagtagggacagcttattgagtacttactagatatacttttaagactttatggttgttgctgggcgcggtggctcacgcctgtaatcccagcactttgggaggccgaggcgggcagatcacgaggtcaggagatcgagaccatcctggataacatggtgaaaccccgtctctactaaaaatataaaaaaattagccaggcgtggtagcgggcgcctgtagtcccagctactagggaggctgaggcaggagaatggcgtgaatccaggaagcgcag

SEQ ID NO: 142684 - DNA, 201 bp, Homo sapiens
tgcctatagccccagctactcaggaggctgaagcagtaggatagcttgcacctatgaggttcaagctgagctgtgattgcatcattgcgcaccagcgtgggtgacaggccctgtctcaaaaaaagaaaagagatggccctgcatggtggtacacacctgtaatcccagcactttgggaggccaaggtgggatgatcacttg

SEQ ID NO: 142685 - DNA, 884 bp, Homo sapiens
gcaaaggacttttcttgttcttgttctctggtagagaataactaagactggtgttaatatttttcttaattctttggataattaattagtaaaatctgagcatgaattgtttttatgtacaggtttttaattatgtatttattttctctgatagaggaccattcatatttgctgtttcttcttgtttcactctctgtaatttgataaaatttcaagtttatttacgtaaaattgtttatgatgatattgttttttaaaactctataggatctttagtggtgacccatcttgattcctgttattggtattttgtgatttctcttctttacttatttagtcttttaaggaaccaacttttgccttttaaaatattctgtactgtatgttctttcctatttttatttgcttttatatttataattttctttcttttatttctttagttttaatttactattgttttctaaattctgaaaatctctatttcattcattgatttcaacctttgttctttttttagtaaatgcacttaagactataaatttccctctaagcatggctatactagcatcccacaaatcttagtatatttcattttgttaacattcagtttaaaatattttctcacctctattttgatttttaaaaatcttactagaaacttagaagagaactgcttaatttccaaatacttgaaaaagtttctagatatatttatttagatttctaatttaatttcctacattcagataatatcgataatatactttgtataatcttaattatttaacttttgggggaaaatgctttgtagctcagcatctatcaaatgtgtcatgtatttcatatgtagttgaaaataaagtacatttcagttgttaagt

SEQ ID NO: 142686 - DNA, 408 bp, Homo sapiens
atagccggaggggagcggttacgatcatatatgcatacgtttctgacaggcagaggaaaccatgtccacaaaactgatgttctttggggtttgatgtacagacttgtccaatcatgtgtgtggttcctgcgagtgctgatgactccgcagtgaagctctctgagttctttgatttaaagttgtgatatatggggggaggcagaagacaaacagaaccgtgtgaacctttttatcatgtaatcagagacacctcacactgttttgttgcatctctgtgtgtgagtcagttcccaggcctggccagcttttcgtgccatttggcaacatctctggggactgtttttctttctgtctctgtggaactttctgagacaagaatgtatctatcctgctcggccttctacctgg

SEQ ID NO: 142687 - DNA, 203 bp, Homo sapiens
ctcagacctgggctttttagttacataaaatccaaaccaactgtcagccttcctagatctcattccctgcttaataaatacacaaacccactaattcttatattgatagtaggcataatcactactagagctacatggtggttaactctagaggttaacagaaatggataaattaagtgggacatttccaggaatgctaaact

SEQ ID NO: 142688 - DNA, 587 bp, Homo sapiens
aagtgattctcctgcctcagcctcccaagtagctgggattacaggcacctgccaccacacctggctagttttgtatttttagtagagaaggggtttcaccaagtcggtcaggctggtctcgaactcccaacctcagatgatctgcccccctgggcctcccaaagtgctgggattacgggcatgagccactgtgcccggtgtgataaattgagattatatatttaaaatttctaacatagagtctggcctactagttccttctttatccatttatctccagtatctaggactgtgggctagatggtatgttttaaggatgcaaggatagagcatgatgagaagagggtttatcaagagtcctgggacaggactgagaggaaggctgggatgcagctggggagggatcatgcaggagggctgtgctgggagttgcaccagaggcgttgctgcaggtagcctaagggatggcttattgaggattcagagaggcctcaagccaaaaacccttgtcaagagccaggtttcttagccccagtggactcagtcatccagaacacttgtcatttaacttagagaggttccaagat

SEQ ID NO: 142689 - DNA, 296 bp, Homo sapiens
agagcttcactggagccttcctcttcagcatgaccgtccctggccacctgatccagagctggcggctcccaggcatagcccatccctgctgcggctctgcactgccccagtcctcacctgcatgcaggggactattcacatgctgaccgtctgtccatctcccgtaagaacgtcggctccttccacgtctgctgggcgtggaggatccctcacagcctccccgacctcagagccatgagagacttgcaaagcttgaaacaaactctgaaaggactcttcacagataaattcctcca

SEQ ID NO: 142690 - DNA, 203 bp, Homo sapiens
acactgttctcaaggctaatagacgtactgttaattttagctcatgtgtttaaatggattgtctatcaggggaaaaaagtcaaatatgaaattgttctaatgataatttgctgtaattctaaagccaatatgtgaaagagctgtgtaataatatatttaaatactaaaaaatcttttggacattaaccttagatgctgatgtc

SEQ ID NO: 142691 - DNA, 324 bp, Homo sapiens
acctcaggcctcttccccaaaccagcttccagaacgcaaaacaatcggcctgggactaggagatccctctgcgagggaaagtgatccaagagaaaagacctgcaagcactcaatcaccctgtgtaaggcttacacttaacaactcccatggacaaagagtttttactcagctttttattgattcggtctttaatctgaacagatggccaaagtttactaaacaactgaggaaaatctctaacatgaaataaagaggccaagataacaaaacaggagacaccaaattaacagacaaaatagaaagaaagaaagaaaaaagagaag

SEQ ID NO: 142692 - DNA, 424 bp, Homo sapiens
ggtatgggagtgggggaggaggcagattatggcaaaacagaaagggaggccactaaagtttatcacaaggcagataatctgccacaaatgaagctactactctgttccctcacgggaagagaggtctaaaccctggggtggatagcaggttggccagggatctgatgcctccccacccgaggcctgggaaacctgagggtaggcagatgtcctgaagatccaggaataccccaggacctttgaaccccatgtatggagggtctccatcccacaggacaagtccaccaccaggcggcccactagaaggcggcaggggagcaaagggaggccatgggcagcaaggagacagaggctgaagagaccccccagatttggcgagaggagccagtaaagctaggtgaaggggaaggaggccagcagcctg

SEQ ID NO: 142693 - DNA, 295 bp, Homo sapiens
ctggtgactcccagaagaagacagaaggttaagctcacagtttggacccactttttgtgctaggaggtgtgggattctggttgtgcatgtgtgtgtggactgtgaccagtgtgcaccctggaccagggagctggatgcttcaggcttcaccctgactctgcctgccttgctcttggcccttggagagcacttggatcttggttttctcactggagtgagttgtaggcagctagagctgttttggactgctgaatggaggggctgtactggctttcctggcacttaggcgatccta

SEQ ID NO: 142694 - DNA, 227 bp, Homo sapiens
tggaaaaacttttaaaatgtagagagctgaaacccatccctgcagattctgatttgaagggccaacagatagggatctgtacttcaaaaggctttacaagtgactctgatgtatgtccccagtaaaaaatgactgctcaggctgggcccagtaactcacacctataattccacagcactttcccagaggccgaagcaggcagattgcttgagctcaggagttcgaga

SEQ ID NO: 142695 - DNA, 2810 bp, Homo sapiens
ttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcaccgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagttggtgccagcaagcttgcccatgcaaaagccgcagcctttgggagggacgaagagaaggaagagcgcagagccggcaaagtgagatgcaccgccgttccgtgccatagacaagtggcgcctggggtattccctctccagaaccgttgcatcactgcacgcc

SEQ ID NO: 142696 - DNA, 872 bp, Homo sapiens
agtctccgtttgggaagacgagagtgttccagagaggacggtggtgatggttgcacaactcggtgaacgtggttaatgccacagaactgtgcacgcgagcaggtcagagatggaaaattgtatgttaaaaattaaaataaagggactaatgcaggtaaacaagacacagcaatcctgagtcccaggctggcaggtccctgcttgcgggacttgcattagagggtggcgtgcatgtccctcgcctttcggcagtacacatggggtgcacgtccacattttgacttgtggtggcaaaaaaaccaaggctttatagagagctagtgaatgcacacaagcaaaggctggaaacgtgtctgcgatgtagcagggaacaaacatttctacgctgctgatgatgtatgtcgcttttactttttaggtgaagccaaaaaccttccctcttacccggggccgagcaagatgagggattgctactgcacggtgaacctggaccaggaggaggttttcaggaccaaaattgtggaaaagtcactctggtaatgtcttctgttgctttacttggcactgatgtgttttctttggtgtagagaatgtccccagggtgtacgtcaccttcccattttcccatgtgtggagaacgtcccgagcgtgtacgtcaccatcccgttttcccgcatgtagggaatttttctgtgcgtagacaatgtcccgagcgtgtacgtcaccgtcccgttttcccgcgtgtagggaatttttctgtgcgtagacaatgtcccgagcgtgtacgtcaccgtcccgttttcctgcgtgtagggaatttttctgtgtgtagacagtgtcccaagcatgtacatcaccgtcccattttccca

SEQ ID NO: 142697 - DNA, 2599 bp, Homo sapiens
ttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcaccgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacgtgagtgtggggcccccaagcctctctttcgggttgaggcctggccaggttttctctgctctcttcccgtacctggccctgggctcacccttccccacccactgcactccaggcttctcagagtcttcgtgttactcgggttgttcaccaggtgctggtgagtttgtgtcggaatctcgcatcaaagcagccacactctctgtgcccggggtcaccggggtggggtggaacctgccggaaggtggggcctgagctgcttcaggtggcgtcccccgcagggtccccaatgtcaaggggccctctgtcaaagacatcccagaagcaggcttgggaccgtctggaattccttttggaagcttttttattttgatataattttgaatttatagaagttgcacgagtagaacaagtactttccacacacccttgacccagacccgtgtgtggcctcgttccccggtcacgcttgacccgggcccacgtgtggcctcgttccccggtcacgcttgacccggacccacatgtcgcctcgttccccagtcac

SEQ ID NO: 142698 - DNA, 1170 bp, Homo sapiens
ggtgccatcaccatactggtgactcaaagcagtcagcgctcaacttttcaaaggagaggcattgccttccaattttaatctcatcactcggagtaaaatgataagatattgaaaatccactgcctgcctcaggtctcagaacgcagaaagtggggggtgtggtttttcacctgtgcagggaggcagctgaggcccggaccccggccctgtgtgctcttcacacaggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagttggtgccagcaagcttgcccatgcaaaagccgcagcctttgggagggacgaagagaaggaagagcgcagagccggcaaagtgagatgcaccgccgttccgtgccatagacaagtggcgcctggggtattccctctccagaaccgttgcatcactgcacgcc

SEQ ID NO: 142699 - DNA, 462 bp, Homo sapiens
cggacgccctgttctagaaacatctggctgcacctgcagccactgtagctgacaggagggtttgcttctctgctggcccttggatgctgccagggtctggtgcccaactctctgcacaggcagaggccgcagaggggagagggcgggagggcgaaggccagccaggctcctcctgagctggtggccacgcaggtagccgaacggttccctctggcagtgttgacacaggacggttccatggccagggcctccaagcacctggcctggttgtgctccttgtaaaatgtcaggaagccgactgatgggcgtgcactgacctcacagcccacaggcaggtgctcggggccaggctctgctccgtctgcacttccgcgtccccaggagacaaacgctgtccccatcgccatttcccagggaccccaacaccatcttccgaggaaactcactggcgtccaagtgcat

SEQ ID NO: 142700 - DNA, 272 bp, Homo sapiens
gcgagttttaaggagtcctacatggctacattttatgaattcttcaatgagcagaaatatgctgatgcggtgaagaacgtaagtatcgactcaccctccgaccgcccgtgtgccgtgctcaggagacggagttctcttttaaaattgagatagaacccacatgacacagacttggccattagcgattttaaacaataaaggcgttcggtgcattcacagcgctgtccagacagccttgtcccaagtcctgggacacctcctcccacagttgg

SEQ ID NO: 142701 - DNA, 3050 bp, Homo sapiens
agtctccgtttgggaagacgagagtgttccagagaggacggtggtgatggttgcacaactcggtgaacgtggttaatgccacagaactgtgcacgcgagcaggtcagagatggaaaattgtatgttaaaaattaaaataaagggactaatgcaggtaaacaagacacagcaatcctgagtcccaggctggcaggtccctgcttgcgggacttgcattagagggtggcgtgcatgtccctcgcctttcggcagtacacatggggtgcacgtccacattttgacttgtggtggcaaaaaaaccaaggctttatagagagctagtgaatgcacacaagcaaaggctggaaacgtgtctgcgatgtagcagggaacaaacatttctacgctgctgatgatgtatgtcgcttttactttttaggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcaccgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagttggtgccagcaagcttgcccatgcaaaagccgcagcctttgggagggacgaagagaaggaagagcgcagagccggcaaagtgagatgcaccgccgttccgtgccatagacaagtggcgcctggggtattccctctccagaaccgttgcatcactgcacgcc

SEQ ID NO: 142702 - DNA, 1862 bp, Homo sapiens
  misc_feature (1341)..(1341): n is a, c, g, or t
ttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagaaactctgagtntgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttct

SEQ ID NO: 142703 - DNA, 405 bp, Homo sapiens
cgaggacggccaggtgcctggtggactcttgcacgtgctcagccacgagacctcatgtgcgctgtcctgagcccacctgtgtcctcagatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactgggtaggtctgtgcctcggtgcccagctcgtgcactgtgcaggaaatgtggccaaggggctgagtagggagggaccagcagacagtgcatgcctgcctgtaagctgcaca

SEQ ID NO: 142704 - DNA, 421 bp, Homo sapiens
gagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctagtggtcagctactggggaggctgaggcaggagaatcgcttgaacccaggaggcagaga

SEQ ID NO: 142705 - DNA, 366 bp, Homo sapiens
aggtttcctgccgagcttgcacttctatttgcaaggtgtttaatggtttggtctgaaaacactctggaggaaaacactgtcctcctcaagacttatccagcccctcacacagctctgggccagccaagagggcccagcccagtctgtgacaggagataggtgccccagccaaagccctgcatcctgacaatgactatgcaaaagggaatggctggcttcaaacacactctcgccgttcatctccaagacagaaatgtgcacaagcttagtctagtcccctcagcttttagcatctgagaaagcatccattcctaaccttagaactagacaggacctgtgaagctatcctgcaaacctctgcatcct

SEQ ID NO: 142706 - DNA, 159 bp, Homo sapiens
ttccatttgtggcacatgaacatgtgaactgtatcgagtcagtgtggattaagtggttgtgaggaaatgagtcccatctgttaaagcagaatatctgagaagtcattcatcacacttgttctgcattcagttgatgtggacataatggaactaaattat

SEQ ID NO: 142707 - DNA, 511 bp, Homo sapiens
ggacctctggatgcaagtgtcctctggatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacacatttacacaaatgctcacactcaatcgcacacttacacttgtgcctgccacccactcatacttcctcacactcaccaaccctcactgacttacacttacactgggtgtctcattcgcacacccagtaatcccctcacactcacactcatgcctccctcgtgctcaccctcacacacacacattggctcaatgcaccgacgctttcactcccac

SEQ ID NO: 142708 - DNA, 325 bp, Homo sapiens
gaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaa

SEQ ID NO: 142709 - DNA, 386 bp, Homo sapiens
tgcaggctcatccatatattatctcaggtaatcctcacagaaatctagttaagtggctatgcttattaccccattgtagagatgaggaattggaggctttgagaggttaaataacttgcccagaatcacagagcacatgggaagcagagccaggattcagggtaggtttgactctagaacttccatcctgaccacgattcccacggttttctgagtgatggcctattgacatggccctttagcccaacacagggtctcccacagggcttggtgggtacctgaatgaatgaatgactacaagaatgaatgaaccaatgacaaagtgaatgagatttctgaagactggattttcaaaaaaacatactttatctcagtaagaaaagcaa

SEQ ID NO: 142710 - DNA, 274 bp, Homo sapiens
tgttgggattacaggcgtgagccactgcatccagcctcatccccaagataatttaaaaaaaaaaaaaaaagtcctcctttccttagaattccaaaagttttcactgagtttttccagcacatttacagttttgtgttttgctttgaaatcagttccagctggaccttgcaagagtgtgtgtcagagaggaaggaggtgatctgaatgtttttaaacaaaggacaaagcagttgtctccacatgtcaacactgactaatccgtcttgtggctttg

SEQ ID NO: 142711 - DNA, 905 bp, Homo sapiens
gtgggtttgagagtagaataaagacattcggacttgcaaggtctttagaatgtattctttctcgggaagctactagaggatgtgccgtgttgagaaaagggtgttaagcaagagagatgcatgggatctgagaaatggacttttcataggagagaaactaagggaaggcagacgatgatgatggtgaaggagcagcagttcttcaggacatcccgaaagccatgaggggtgtctccaggagaaggtggaaatgcttgccgacttgacatgttggatactgtggaaattggtatttagagacagccaggttagcatacttttggctgcaagttgcaaaagatccaactcaaaactgacctaaaatgaaaaactggggtttattctctcacataaccagaagtccacggctagcgcagctccaggagttaacttattcaacagctcaacatcatcaaagttccagactcttttcacaaacctttgctcagccatcctcggcatatttgctatttcctgtcaggcttctagcttgcaggctgggcctagtcctgcacataccaaagctgacgggcaggaaggggactctctacaacccaagagacctaagaaaccctcccaggaataccatctctcttccaactttcactggtcaggctccttcctaaatccgtcactgatttaagaaatgggcctccggactcggtcataccagtgctcttctgcataggacacacaagcgaatcaggtgtacagccgggtggggtaatgaatgaggttgtcaaaatcccaacacattcacaaccaactagagaaacactgaattatatcagttaggatatttaagccacgtggaaaggagcagacaccagaataacacagaagccttggtgggctaaaaaaaaaaa

SEQ ID NO: 142712 - DNA, 269 bp, Homo sapiens
ttctgggattacaggggtgagccactgtgccaggctcaattttggtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaat

SEQ ID NO: 142713 - DNA, 152 bp, Homo sapiens
agcaacactttccaactcatacacgtttaacaacatggagttgaatatttgattcctcctctccatgaactgccatatttctcacatctgtgtatttctattttcatagctgtcatatcttatcacttcacatgggatatttattttcttgg

SEQ ID NO: 142714 - DNA, 261 bp, Homo sapiens
tgagattcagaagtataggggtgttggccgtgggggagtcatccaacaggccccaggcagggtaagccccaccgaagcctccaggcctgacagcctactggtctcctggtggccacaacgtcactggaagccccctttctaaagcacagctccaatcatgtcagaaacatccagggcttacgaggaaactgctccactccctggcctggcactcaaggcctggagatccggcccccacttgcctttccagtcttagaattc

SEQ ID NO: 142715 - DNA, 193 bp, Homo sapiens
ttgctacgttggccaggctggtcttgaactcctggcctggagagaacagtcaaattgttatttcagcctcccaaagtgctgtgattacaggggtgaggtaccatgccctgctgaaatcaatattaggaaaacatcctggtcaaggttatgcaactcatgtgatcttggagaagtatattcaccttttgtttag

SEQ ID NO: 142716 - DNA, 530 bp, Homo sapiens
tactgacgccaattcggccaatgggagccctttcaagcaggcttctgtgcccttttgatgtgtctccaccacttttgagcatgtctttgtttctggtgtaacaagatgttctccattcatactttcatgcatttcatcatttctcaaaagagctttatttccttttagtaggaatagatctagaaatcaagatttgggtgctaatatgttcactgctactgatctccaggtacttctgattctatctttgacgtacctctttcattctctttgttgcattgtcactatctctgacttggcttgtagttttactgtctgcttcctggactgctgtagtaacccgccattagtcctcttgcttccatgatttcctctttcatttcatccttcacacagccattggaattttctccccaagccacatttaagatcgtcttggctgggcgtggtggctcatgcctataatcccagcactttgggagtctgtggtgggaggattgcttgagcccaggaattcaagatgagcctgg

SEQ ID NO: 142717 - DNA, 134 bp, Homo sapiens
cctgatttctttcaccacacacgacctcttgtaccatgggaacaattcagaacttggagaggggaaacttagttttaaatctcagctctactacttactagggtttaaattagtataactgaatctaaattagg

SEQ ID NO: 142718 - DNA, 397 bp, Homo sapiens
gatttcattcaaatgtgaatttcattagctgaaaaatcccaagataaacagttgtttaaaagataaaatcccatttttcatgtttttcaaaaagaattaaattcacatcatgttgcttgaagtcccagaccacctctaaaaaaaagtaccatgaactccacaatttttcaattactttggtccagaccagcagtgataaaaatgctcactttctaaaaagtgtatttatgtatcactgtgcatacacacatggatttatttggttttattctttggatttatttgaatgaaatcaatttgcaaagttaaattagggatttaagcatttggaggtggactaggagaccctgaatgagctcagtattctctctgagtctctgttccctccacttgaaga

SEQ ID NO: 142719 - DNA, 421 bp, Homo sapiens
cgataattattttctattcagtgccctcatacttctgattctgtacattgctgtacttctttaaaacctctcagagtttaaatttgtttgcaatactatcctttagtttggaagcaatgttttgttactgtcaagataatcttaaactattaaaagcctttaaatccagctgattctcagaaattcttccacctataaaacatgagaattataaccaaattaacaaatcagatatcagaatgccaaaaattaagtcattaaaagagaatccagtgaaagagccagttgtgaaagaacaggaagtgatgtacactgccattttgtagatgaactatttagaaacataagaagtgccatactaatctagaatcaactcagactaacagctctcagcattttctttctgacagtggcatcagag

SEQ ID NO: 142720 - DNA, 537 bp, Homo sapiens
ccgtggactgctgtggggacaaacagaatcagagccgaagggcggccaggaagctctgcgtccctaagagccaccacactgggcgagaggccctgcccatgttcttttgtttgtttgtttttgtttgttttgttttgttttttgagacgaagtctcactcttgtgccccaggctggagtgcgatggcacgatctcggctcactgcaacctccacctcccaggttcagcctcctgagtagctgggattacaggtgcctgccaccacacccagctaatttttgtatttttttagtagagatggggtttcaccatgttggccaggctgctctacaaacttctgacctcaggtgatccacccgccctggcctcccaaagtgctgggattacaggcgtgagccaccaagcctggccatgcacttttcttcttgatcatcaagcctctttctacccccagcctgggtgcttgatgtattctttaatcttacaaaactcactgcattacacctttactctaaaaccttcctagtctatcattcc

SEQ ID NO: 142721 - DNA, 223 bp, Homo sapiens
aggatggcaatctgttatttttacatattttcaaacattacagttcattctttcattttatctatgtttttataacatgcaaaagcttaaaaaacaatttatgagcacagtgtcattgcttgtcctctttgtgatttttctcttctacagtaattataaaaactcttcttctcttcagagatttgatgaatatccaacttcagtttttcaatagtttgtttta

SEQ ID NO: 142722 - DNA, 173 bp, Homo sapiens
aggccacgtttgaactgagacctgagggatgggatggagccgagcatgtaaagatgtggcagaggcaaaggcccagaggtgagaataagcttggcctattcgagagacgaataacctgtgtagccggagcagagtgaatttgtgcaaaactaggctggaaaaggggtagaaac

SEQ ID NO: 142723 - DNA, 439 bp, Homo sapiens
catgatcttaagagaatgaaaagacaaatgacaaactgggaaaaaatatttgcaaatcatatatatgacaaaggacttgtatctagaactaaaaaaaattattagaactcaataaaacaacccagtgtaaaagtggacaaaagatttgaatagatattttgcttaagaatatataaaaggggctaataggcacataaaaagatgcccaactttgttagtcactagggaaatgcaaattaaaagcactgtgagataccactagtgttatacccgctacaatggccataatcaaaaaaacagacaatactgctgggcacagtcacatgcacctgtaatcccagctacttgtgaggcagaggatggcagggaaggactgtttgacaacaggagtttgaagtttgagactagccaaggcaccatagcaagacccctttctcag

SEQ ID NO: 142724 - DNA, 134 bp, Homo sapiens
gttaaactaggattttatacacattttacattttgtagcaatttgagattaggtttcttatttcacaagaatgtctgatcatttacagatgctgagaaatcataggtaattgtaaattataatagttacttttg

SEQ ID NO: 142725 - DNA, 101 bp, Homo sapiens
aaacttaaaactctttcttgaaatattatattagcttctgaaatgataccattagaggctaggacattcatgccccactagtacattcatgcctcactctt

SEQ ID NO: 142726 - DNA, 601 bp, Homo sapiens
gctcttagcttttcaggttcagaaactgatttaatcaagatacagaaaagagattcattatcagagttggtctcaccttaaccaagctcacaagattgatctgtaaagcaaaatgccacttgacatttaagcaaagaaatataactgatggatattcttaaagtaaaaacgactagctcattctttcctgcaggcaggcctacacagggaggcagatcataatcaggaggttctttggtgaacacgaaatcagaataaagctgaatcatatgcttaatggtatagactaagaaaatagtccatcccacaccaaatatgaccctgccagtggaactaagttcctttgaaggctgtcaactatgactccctctgctctggtcagtgtttggatagacacctgccaatgttttgtctcatttttttatgcctcagggctaacccaggcccatacccacccaaatcacttcccaagttagtctttctcctagatgttaatactttcccatcagcttacagtgtcattctttctccttaagcttacagtttaaatctcagcaatcttattttcaaattcttaagggatcccttgctgaacttacat

SEQ ID NO: 142727 - DNA, 1013 bp, Homo sapiens
gaagaaaggaacaaggatacacaaaacaaccagaaggttaacaaaatacaggataagtcttcagctgtcaataataatcttgaatcagattaaattccacacttaaaatatgtagataaactgatttttttgtagacccaattatatactgcctacaagacacttacttcacctatgaagacatatagaccgaaagtgaagggatggaacaagatattttatgcaaatggaaaccaaaagtgattaggagtactatacttctatttagataaagtggacattaagtcgaaaactgcaaaaagagataacatggggtcattacatagtgataaagggatcagtacagcaagaggatataacaatggtaaatatatacgcacccaatataggagcacccagatacataaagcaaatgttattagatctaaagggagagaacaactccaatatggtaatagttggggacttcaacacttcacgctcagaattgggcaggtcagctgtgcagaaaatcagcaaaaactgtggatttaaaccacactttacaccaaatggacctgactggtatttacagaacattttatccagcagccagagaatacacattcttctcatcagcacatggatcattctctaggatagaccaaacaagtctcaacaaattttttaaaaccaaaatcatatcatgtattttcttagaccaaaatggaataaaactagatatccagaagaagaggaactttggaaactatataaatacaaggaaattaaacagcatgctcccgaacaatcactgggtcaatgaagatactaagaatgaaataaaaaaaatttcttacaacaaatgggatatagcaaaagcagagttaagagggaagtttacagccaataagtgcctccattaaaaaagtagaaagatatcacataaactacctaatgctgcacctcagggaactagaaaagttaagaacaaactaaatcctcaaattagtagaaaaaaagaaataataaag

SEQ ID NO: 142728 - DNA, 390 bp, Homo sapiens
caatatgtctaattaaaagaataaaagctaaaacaaaatgaactttggaagttagtgcagaatataacaaaagtggctttttaactatgggcaaaataagaagatggataaaataggcttaccagcagtttcaactcttatttctgttctgactcaccaacaggggaaacattaagatttatcagatacttatgtccttgaacaaactagctagctagctatattcttattaaaccctcaagacaatcctgtgaagttctatcatgcccactttataattgagcaaatagactcagataggttaacttgttttagtcatataactaataggtggcagatccagaatatgaacgaaattatgtgataccacccaaattacatgacaccaaa

SEQ ID NO: 142729 - DNA, 145 bp, Homo sapiens
gactgctagcttcaaagtcctggctaaacgttccttgtgtcttcacatgtcttcacaggacggccccaggccctttcagcatccttgctacttgattctgagcacattttaaacagacagccctctaagtctggcatccatacca

SEQ ID NO: 142730 - DNA, 284 bp, Homo sapiens
taagttccaaattcacagagcgcacagtcctaacaggctgtcatgcctcagttgtttatttgtgacagtgtttcccacagacttttaattttggaatgataggatgtggtgctctggaatggtgtcccagggttttggagaactgagagtaacctgggaaagcaggttacagtgagagaaagttatgaccaggagttgtaccaaaacgcaggaaacatgatatgtatattgttatggtgcataaaaatacttacaattaaaagtcctgaacctacactacatct

SEQ ID NO: 142731 - DNA, 488 bp, Homo sapiens
aaactctgcttcccgggtcaagcgattctcctgcctcagcctcctgagtagctgggattacaggcatgcgccaccacgcctggctaattttgtatttttagtagagacggggtttctccgtgttggtcaggctggtctcgaactcctgacctcaggcgatccgcctgcttcatcttcccaaagtactgggattacaggggtgagccactgtgcccggccttcagtcacttttatggggaatcttatcctgttgattatttttatttctagaatatcctattgatagttttttggggggattgggcatgatgtattttatcctaaaataagatgttactgaatgttaattgcagaattaatgtaaaattgactacatctttcacagatgaaatacatcgtgtatagctgtgggtctgaaaatgtgtggagtggcctggactttacagagcacctggatcaatgtttttcagccttactttgtagtagca

SEQ ID NO: 142732 - DNA, 182 bp, Homo sapiens
tgaagccactgtaatatttcaagactaaattagacactctcttcctagccccctttcactcctccaccctccaccacataggacactttctggaaaagaagtccaggcaaagagacgttagtttaattgttgctaacgtcatataaaaatgatcaccaacttggaatttctgaattcacatg

SEQ ID NO: 142733 - DNA, 521 bp, Homo sapiens
gtcaagtgatctcagccgggcacgatttttttgcgttagatagagacggggtacaccatgttagccaggatagtctcgatttcttgacctcatgatccgcccgccttggcctcccaaagtgctgggattacaggcgtgagccaccacgcccggccccacttacacttgatattttttgagatggagtctcgctctatcgcccaggctggagtgcagtggcgcgatctcggctcactgcaacctctgcatcccgggttcaattgattctcctgcctcagcctcccgagtagctgggactacaggcgcaggtcaccacgcccagctaatttttgtatttttagttgagacggggtttcaccatgttggccaggatggtcttgatctcctgacctcgtgatccacccacctcggtctcccaaagtgctggaattacaggcgtgagccactgcgcccggccgattcccttttattaatacattttcccgtcttctggggcacagtatcattggagtttcactttt

SEQ ID NO: 142734 - DNA, 121 bp, Homo sapiens
caagtttggccagaagtaggtcatcttaatgcaatctgggattaaaataatccaaagctaggcctcagttcttgtgaagtctgttctcattcacatttattcctgagatgatgcccttcag

SEQ ID NO: 142735 - DNA, 653 bp, Homo sapiens
actgaaattgtgcaggaatctcttactggaacacagcaaatgttatccacccaaggccaaatgacaccagaaagttctacccaaataatgctttgactagacctgttcataaaaaaagttttcttcagaaattgtattggtcattgaagtcttgagtaaattcaaattgacagtattttgtttagatccaaatgagtcttataggtcaggcatagtggctcatgcctgtaatcccaacaatttgggaggccgaggagggtgaatcacttgagcccaggagtttgagaccagcttggccaacatagtgaaaccccgtccctacaaaaaatacagagtagcgaggtctgtagtcccagccacttgggaggctgaggtgggagaattgcttgagccctagaggcagaggttgcagtgagctgagaccatgtcgctgcactccggtctgggtgaccctgtctcaataacagaaacaaatgagtcttatagagtgtacacctctcctagtaagtgagcatttcaaataatcttcacaggctgttggggagaatgaaatgcccaacgaaggacaagttctagaaggcttgaatataccataatctgatgagaacctctgagtcagctgctaaatttaagtcagatctcagtgtcctttt

SEQ ID NO: 142736 - DNA, 186 bp, Homo sapiens
gacagaaagcagatagccaaattctctctaccacattttggaaactatgtgtttgagtctgatcaagcatgatttagattcaaattcagaaaccatgtattagccttagttatgtgccaggcagtcctgcactggatccgttcatgtgaatggctctgttgagccctcaccaagacaaatacatct

SEQ ID NO: 142737 - DNA, 146 bp, Homo sapiens
gccttgaccttcaggccacgcggcacacacgtgtggagggtcagccctatttgttgtagtcttcatgccacttgataagccttcagcccttcatagtccatttgcaaattttatttctaaatagcaaaacctgcataagaaataca

SEQ ID NO: 142738 - DNA, 245 bp, Homo sapiens
ttgctcatccagtgctctggttatagctttgtgaatcatctctgcaggcttttccacctcaatcaaaacagtactttatgtctttaatcactgtatagcttcttcttcctctaccattctatctatccctgatatgctgttaattataatattttttctctaaatcagtacagtgttacaatgcaatatgggagtgtgaaagagggaggctaatttatttattttgtttacatttgcttctattc

SEQ ID NO: 142739 - DNA, 229 bp, Homo sapiens
ttcaccgcgcttggccagcaggaccagaaggccttggctgtttgaggactgcggtggaaaggtcctggttggctcctaggaggcctccctcctccttccaaggctcctgctgcctctgaagtagccagaggcctcacttatctcatttccttggagttatgttgagttgagctctgtgaacctttcaaattgaagtcacatctcacaattatttggtagaaaaacacaa

SEQ ID NO: 142740 - DNA, 253 bp, Homo sapiens
catgctttggctctccatgtgcagggcaagcagaggctcctgaggggtttagggggcatttctctggccactggggtaatgtttcaggaaggaacatagctgcctctgccacataaaagagttcacaagcctcacccagctctcatgcacttggcaaggcaggtctctcacctatagtgttcactagcagccgctagctaaattccaggccgtgtaagctcagaactcaaaactgccctaggccataagcctt

SEQ ID NO: 142741 - DNA, 492 bp, Homo sapiens
gacttcaaagagtcacagtaaaaattgaaagtccatctaactttgaagttcaaaaggcaagagacagactgcagtcaacccatccataccaccaaggggtagcccacagaggccagagcaagccaagaggattaaggacaacattgtgcttgggtgagcaatcttattgccacagtctgtcttcctgtgttcaaatagttccgtgttcaaatgagatcagcacacacagagctggccctttctcttacagaaacattaagattgcacactcctggaagtatgtcaactgccacagtctttagtgagtatgggaatcttgggcaagtcttcttggaaattgccacttatgccacagtcttatagaaaattcaggaccttgagatcccctaattttatcattcttctcttggatcctctcttaatgtctgccttccctccactctaaactagcatttactatttattataaatcatggcgtattgttaccaact

SEQ ID NO: 142742 - DNA, 237 bp, Homo sapiens
agtaacttagtctgattcaatattctatagatttaaaaaagagagagagagagagagagagagggaggctgaggttacttaaaattgattttgagaatatgaaaacatcattttggattttgatgttttctgctccataatggagcagaaaattaattttcattttccttatatttgtttttctcctaagacccaattgaggggggagaaaacccatagcatcttaaagatctttat

SEQ ID NO: 142743 - DNA, 504 bp, Homo sapiens
gttactaacagcctggacagcaggaatccacgctttccactgctgtgttgctctgatgggggtgagggcgatgggaagagaaacctgttccgtacacccacgggcaggctccctgccaaaacccgccacacaccatcttcctgttcattttgcctcacggatgatttttaaagctttttaattgtccttaataaattacctacatgtgcatgattgttacaatagtttcattaatttttctctgagcatctaagctgtttatcacagaagtgttaatggaaaagaaaaacatgtcaggcaggcactttctcacacactctgggcttgggcaaattaatgctcatgggattgctttcccacaccccaaacaattagggacgtctttatttcatgccagcaaatcatctttcagcaaggctagaaggaggatgcccaccagagagccctgcagctgcccagtgtggaagcggcacacagatgcctgcctgcctcccgttcagtaac

SEQ ID NO: 142744 - DNA, 511 bp, Homo sapiens
tgaggtctcagggaaaatcagaaaacaagtttttactgaatgaaaacagaaatataacttattaaaattcgtgtaatatagttagtgtttaagagaactttatagcagtaaatgtctctactaaaaatacaaaaaaaaaattagccgggcgtggtggcaggtacctttactcccagctactcagtagtctgaggcaagataattgcttgaacccaggaggcagaggctgcagtgagccgagatcacgccactctgcactccatcctgggtgacaaagtgaggctccatctgaaaaaaaaaaaaaataaataaaactggcatggtatggtaggtggagtaccccaagaagcaggagctgagataaggacttaagtaaaatttatctagaagaaaattccaggaagtaccagtaagggaggggaagtcgagtcaaggagaatctgggggagactgtataaaacacgtctcagaatgggtttattctaggggcaaagaagctggaggttttacc

SEQ ID NO: 142745 - DNA, 505 bp, Homo sapiens
gtagcagcttgcgggaagctggaatggggaagctgacttcaagtaggaacctgaaagccagggcgaggaaatagttttccagaagtaaaattacaaccgtggggatcgtttccttcccgctcctcccttcccccaacctgtgacctagattgaagaagaatgggcagagtggccaccacgtgtctggcttcattaaggatacccgtgcagcccttgggcagtgggagccttagaaagtgtcctacttgagcgactgcctgcctgcttccctgcgtggacagcaaggcaggcctgaaagagagccgccgtctgataccgcaccagtcccagtaccagaggctgtgtccaggacgaggtgcccaggagggcagggaagttaagggacttgcttcctggcaccatgtccctcagcccatgtccctctctctgggaacccgagctcttgccgtattgttacacctttacactttcctggaagtggtgtggcttcgcctgcccccacctt

SEQ ID NO: 142746 - DNA, 672 bp, Homo sapiens
agaaagatgaatccctgtgtctgtcttcctcctgcgaaggggctgcaggcaccccgaggcctgctggagaaccggcctgggttactcagtttgtgcagaagaaagaagagagggacctggtgaaccgactgaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggccggagcagctggagtctggggaggaggagctggtcctcgccgaatacgagagtgatgaggagaaaaaggtggcgagcggagtggatgaggatgaggatgacctggaggaagaacacataactaagatttatcactgtagtcggacacactcccagctggcccagtttgtgcatgaggtgaagaagagcccctttggcaaggatgttcggctggtctccctcggctcccggcagaacctttgtgtaaatgaagacgtgagaagcctaggttctgtgcagcttatcaacaaccgctgcgtggacatgcagagaagcaggcacggtagccaccaggaccatggtgtagccgcaggtggtctggagagagtgaggc

SEQ ID NO: 142747 - DNA, 391 bp, Homo sapiens
gataaaaggaagcaaaagatcgtatctattggggctacccgtgagttagccacttttcttcattctccagggaagagaatgaacaaagtagatgacaggggctggagtatgcattcgggcctttgattccatagagaaatgcatctgtcctatccccgtgtttacatggctgatgaaatcatagcctgcctctcctgcaaatgccccttttctttgccatgtggcagtgagccctatcattgctgtgcctcagggacatcacgtcctggccatatttcagtggtaaagtatgatatggcatccctcactccctcatgttttgggtgaaagctcaaatgaatgaaactcttagaaggtgaccgttattgccttcctggaggtagacagaaag

SEQ ID NO: 142748 - DNA, 362 bp, Homo sapiens
agcaggggtctttgctggtaaccaagttgtcactgtattttgttggcttccaaagtgcaaatgtgccctgcttccccaggcccaaacctctggaacaggcctccctctccagagccatgccagtgttgcactttgacctctagaatcagagtaacagctgtagctctgccccatggggctaagctaccgaagagcatctcagattcttagtctgcttggtggaagagctgcatccatgtaaacttaagagagtaaacctgcatccatgtcacaggtgcctcagtaattaaacaagacactgagccctgcactccagctccacaccacactgaacacctatgccttggaacacagcatcagtt

SEQ ID NO: 142749 - DNA, 233 bp, Homo sapiens
gtgttatataatttaatccacccccaaagcctatgaattgggaactacaatatctaaattgtattgatgaagaaatttagagattatctagaaaggaattttaattgaaagcaattaaatttcacttccattttgattacataaaaatgttatacccaacaatattgatgtaattttattatatgtaagtctaaaatatctaggatcttgaatttaaaacactaatacacaca

SEQ ID NO: 142750 - DNA, 325 bp, Homo sapiens
acctcagcctccgaaagtgtcaggattataggcgtgagccacctcgcccggccgcccaaacattttaaagttagaatctctttttataagcaaaattttccatagaaggtgactgtgtgccactttcctctccaagcacctgatctgcttcatttcacagaatccttagaacagctccacgagtaggtactctgaatactcccgctttacagatgtggaagctcaaatgcagagaggttgggcaacatgcccaaggtcaatgaatgcagaactgctgcagtgggagcaggggtgggtgacacccactagggaggtgctttcaaac

SEQ ID NO: 142751 - DNA, 1000 bp, Homo sapiens
ccatgacagtcagaaacacgtgcacctgacattactacattctctttaagctctaaaaaaaaccccagatgtttattactctgcagaattgcttgattgtaactacatttaatattcattttgtcaaatgcctctgttttatttaaacaagcaataaaagaccacaaaaggtaataaggcaaggtttagggttagaaaagataatcaataaagagggtgacagggacttctctatgctcttttccccccagttcaggtttaccttagagaaaaatccaaatgtgttgattttagtttagtagtgagctgaatctgctgagggttggaactgcttccactctagtctttagattgtaaaggagttattctttagcagaagggccaaagacatgaccttggaataaccagcctgagtttattagaagtctggtttcccactgggcaaggctgcatgggatgctgaaagcagggcaggctctggagcttcattggctactggcctggggcaaattccatgacatctcatcttaaaatggacaagctgcaataatgcccactcatggtaatgccatttgtaggagattggtaagggtggtgggaaaaattgcagaagatgcaaaccttcttggaaggctggaaggttttacaaaagcttcggaaaaggatttggctgaaggcagccagattcttttatctggtgcctgaaagcttacgttagataacaaggggatataaataaactgatctaggtaagttagtttacttaggccttggaacctcgcccttaagcatccacgcacagaactactctctccgggtctgggtgaccatgtgaattgcccacaaatgtgttgactcaaggcctttgtcattaaatctatactgaataaatgcccacagtgccggcttttcggggctgtggctgctgactcattacagcaccctccttggtgtctgtgggtggccgggtcccctagcctgctctttcactggattcttg

SEQ ID NO: 142752 - DNA, 550 bp, Homo sapiens
aaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattg

SEQ ID NO: 142753 - DNA, 419 bp, Homo sapiens
ctatgcattgtatgtctccagttaaatctcttctttcatagctctgccagctaagctttggggatccagctgaatccttctccatacctctagcatcatgcacagtttctgacaatgtatgaactagaagatttgtgtttcgttgttagagggatttatatataaatgtatgtacagcaagatagagctctgtctaggatttcaatgaaaaacaccaactaggaagaaacaggcttcaagaaatggatgagaggagtaggactgaggaagatacattatttgagacacctcaatgcatttgatactgcaaagggtatatttgctctgtgaatgtgtgtgattttgtatgtccacaaattaagctacagacacaaggagcaatctcccacccctgaattttgactctaagcttggtatag

SEQ ID NO: 142754 - DNA, 370 bp, Homo sapiens
caggctccccttaactctagaatacctagggtaatgacagaaatagggcaatccaggagccccaggcacgccccagctgagctcacaacccaaggtcagctctgggagcaggtaccctggaaatacgatggttcctgagccccactgatgggccacttcccaaggcttgtcatctcattcagccctctcagaattgctcttgagaggcagcccagcaccctggttaaatgcgtggactctgggccagactgcctgacttctgacccaggctctgctataagtcactttatggctctgtgcctcagtttgctcgtctataaaatggggattacaagacatctagcagtagccatcccagaagagtactgtg

SEQ ID NO: 142755 - DNA, 167 bp, Homo sapiens
gaggtgttggggagccttctagggcaaaaggagtattttagccaaatcttgatactggtttcgccagtatgtgcacatacgtaaaaatgcaccaagctgaatgtgtgcccattagttcatgtgtattatacctccattaaagtgagagagatggatggatggatggg

SEQ ID NO: 142756 - DNA, 290 bp, Homo sapiens
ggaacagtaagacaactgggcagctggagggaagtgagcagaagtaatgaggtcaaaaagacagtggggtggacatatcatgtcagaccttatttaaggactttggcttttactccatgcgagatgagaagtcagataaaagttttgagcagaggacactgactaagagtcagtgacatgatcacacttacacttttgaacaggaccaggttggctgttgtgttgaaaatagagtgaatggcatggtggtggggcaaagccagagtcaaagagaccaggtaacaaaaata

SEQ ID NO: 142757 - DNA, 375 bp, Homo sapiens
gtatgtactctgcaagaaaataaaatttgaacttgtattatgtcttattatccaagtcagattagttatgcagaagaagcaacactttggattattgtcattacgcaattcaaatgttagaactagaaggtaacattagtgattaatcaaattttcttactttaacagataggaaaattgagacctcaagagatcaagtgatttactgaggcttttacaactgattaatggtaggaccatcttaggaacccaagtctcctgacttaaatcagtattcttttcacacattgtttagagtttagaggctagtttttaaaatacttttagcctagcttagaatttcacacacaatgcagcaaagccacataacagaag

SEQ ID NO: 142758 - DNA, 465 bp, Homo sapiens
ttggtcacctggcttggccatccactggccctgggaccttgactgtggcatttccagagccacatcccagatgctcccatgtggctgtgtccactctcgggtggggcagctgactgcactggccaaatgtgtctgaaaggtgacagatggtggacttgccccaccagcagtgtgacatggatgcactgatgtgggggtgggaggcgctacagggagaacttcacaggggcctggctggccctgaccctttggactccagcagattctcaccatctcctgaggaagacaggtttataggtgtccctggcccccaccccagggtgtccccacaacccaactccaatctcatgcagtctctcccctcttcactcattcagttgctgaaagtctgtgtcatctactagctgtgacctcaactgtggcatctccagagccacattccagctgctcccacgtggctgtgtc

SEQ ID NO: 142759 - DNA, 459 bp, Homo sapiens
gctgggattacaggtatgagtcactgcacccggcctgcaactttgatattttaaaaagaaattcttttgaaactaagagctttcttaataaccgtacttctcaaaatcagagttttactgtttcaataaatgttcaccctagattgtaagttttttgttgttgagccctagatttttttctactagtgtaaatctgtattccctccaagtatggtgataaggggactgagtcttatttacatttgtacaatcactactttacctgttgtatttgcagtaagtcttttgagccctattaaacctgtcaattttcttgtcctgtcagaaaactgagaatttgacttttggctcaaaatggatgttattaacaaaggggtaacaatatagatgtcttagtacaaagaaaaatgaaatgtaagaggagattgtctggagttcaggggatagagtgtcaagtct

SEQ ID NO: 142760 - DNA, 283 bp, Homo sapiens
tggactctctttttggcctgacctttaaagcacattatttcttactgcattagattttcattagttaatatctcatgaaaccacctgttattaacctaaaagttcattttgtggactattcagcccctttcttgctgtccatcttcaaggcgggttttttcttgggatcgtcaccagaagtgctagtaaaattacctgacttctcacacaatcaaaacaggaattggtggggagggggcaaaggggagaagaaacaaaagtataattcagcaaactgaaagcc

SEQ ID NO: 142761 - DNA, 676 bp, Homo sapiens
aaagaaaatcacttttttcctcctaatgaacatcatacctctgtcccatatttggaaagataaatcctgtcctcacacttatagggtttaaaaaatgaactttgccacacatatcaatatttattcagttttgcaaagtcaagctctcttgccctaaatggaagagaagcagaaaatttcttccactatttctcattgaactgtaagcataaatcactctaaggcaagctgaagtttttaagaagggcatttcttcgcatgtttttaaaccacagcttcctgcttatctttacactaatttcctctgataaattataactctagagaaggatataatagatacatcagtttgctactcagataaccacttccccctctttacactatccatccctcaacttactttatatctttctacaatgctgaagccaataacagcacactgcaacttgtgcaaacagatagggcaaaggtttagagggcgccggtcagcttcttccaagtggaagaagccccagatttccctatcaaaatcctttgctgctatccaccatgccttgtcttgtaaaacttaatgggctggaggtcaaatacttgagaaactgaagtttcagagtcttttcccacaaaagaagtctttttctgaaagtagcaagtactccaaatcctgtctcta

SEQ ID NO: 142762 - DNA, 260 bp, Homo sapiens
gggccaaagcaagaccaggacatgtccaaggccaggtcagggccagaacaggagtaggaccatgaccactggcagggccagtgccatgacatgaccagggtcaggacaaggggtagggccagagccagggccagagccaaggtcaggccagtgcaggttcagggcagggccagtgccggttcagggcagggccagtgccagggcaagaccagggcagggacagggtagcacagggccaagacagggtcaggatgggacca

SEQ ID NO: 142763 - DNA, 139 bp, Homo sapiens
acgagaagggagcatggtggaaagtttgggggtgcccagggcgcggggagggcgtcacttacagcgatgacttctagccgctgccggtagagggagctctccgccatgggcctgttgggagagggcaggggcttcgagg

SEQ ID NO: 142764 - DNA, 146 bp, Homo sapiens
agagcactgtcctggaggaattctgtcttcagactcttagggcagggagaggagaaggaaggaaggggacagcaggcagttgataacatatgatttattaattctatactagacatctaataatcggcctctgctagcaatgtgac

SEQ ID NO: 142765 - DNA, 328 bp, Homo sapiens
tctgtactaggtgagctccgagtcaggtcaaacaaggacaatcctccaccagaccggtctaatgacaattctgtgcgaatggggttttgaagaatttccaactctgttatgccttctccagtgcctcccaggactctggttttcaccatgcccatagaatatgggtttacaaggctacggcgatgctagggtgatggggagggtaatagaataagagaaaacaccagaatgctcaacgttcttactgaattcagccattgtttttaagcaaaccctccccagatgactacatcatttgataaatttctagagttctaaaatttgattc

SEQ ID NO: 142766 - DNA, 159 bp, Homo sapiens
ctccaaaattcatgttgcagcttaatccctactgtggtgatattaagagatggggcctttgggaggtgattaggccattagggctccactcttataaatgggatgagggaccttagaaaagggggctgagcatggtggctcatgcctgtaatcccagca

SEQ ID NO: 142767 - DNA, 332 bp, Homo sapiens
acaaaaattaactcaaagtggatcattgacctaaacgtagacctaaagctataaaacttctgaaggaaacctaggagaaaatctttgtgactgtgacataggcaaagatttcttagataagatgattcataggataaaaagttgatgaactgggcttcatcaaaacaaaaacttatttgttcaaaaccttctttgaaaaatactgtggagaaaatgaaatgacagggcacagactgggagaaaatatttgaaaaaattaaaatctgataaaggatttgtttacagaatatataaagaactgtcattagtcactaagaaaaaacccaaacaac

SEQ ID NO: 142768 - DNA, 163 bp, Homo sapiens
cgttctttatgtccagcaggccacgtttgaggaggctggctggggtcccatctgagatgagtgccggtgtggtgcggagttccctgccaaaggagggtctacacagtctcaagatggcctctctgccagggtacacctcagaagggatcttagaggctgcgta

SEQ ID NO: 142769 - DNA, 129 bp, Homo sapiens
cacaaatctctgcaaggaggttcctctttagtgacaatgagtcagatatgtattaactcagaaatgaatttaagaagaaaaaaaagtttgtcatcttatgaataagtgtttcatcttggtttagttgat

SEQ ID NO: 142770 - DNA, 312 bp, Homo sapiens
gggattaaaaaaaaagcagtgagacactgggaaatactttaggttaaaattgtcacgaaagtccagtttgagcaaagactcaacatgggggagaagtgagtcaagcaaagagcttccaggtagaggcaacagcaggcacacacaaaaaatccaatgcatagaatgttaggaatcctaaaaatttaattataacctctagaaatcctagaaatttatcatatagccaaatatgttatacatatacatataatgaaaacaacatatacaaaggtgctatagagataactggagaaaagatgagcttagcaataa

SEQ ID NO: 142771 - DNA, 154 bp, Homo sapiens
gtcctgaaattgcatgagggagcattcggggcagaaaacacaggagtgtcaagggcaatgctgagaggagcagggctctcctgctgctttcgagagtgggtgtcgcagaaggcttgcggggaaggaggatcttggtgtccatacagccccccgt

SEQ ID NO: 142772 - DNA, 429 bp, Homo sapiens
cctagcttctcccatcctcgcggggccaaccgcagaccaattcctttcagatgcttgaaacaggcttccctccagtctgtgccaacaggacagctcccaaaccaaggctcagcttcttgctctggccttctgcagcaggacaaccccctcacaggtcacctaagggtcccatggtgatgggatgccatctgcccctggatggtggggggagtgggaggggctaacaatggaacatgggcagggggatgtcactcaaccttgaataagaccctagagggatgccctctagggtcctgcctatgagcaaaggctctggggcctgactgtcagggtcccatttctgcctctggccaggcatggttgctgatatctgtaatcccagcactttgggaggctgaagcaggaggaacacttgagcctaggagttca

SEQ ID NO: 142773 - DNA, 158 bp, Homo sapiens
cactgtgatctttgtatggaagaaatacactctagccaagtgcagtttagcttggagccacagcagaaagaaaaggcgactttactgagctaccaggcagaaacggagggcaatatagtggctggagaatagacactgtgaaaattaccttagatgtt

SEQ ID NO: 142774 - DNA, 309 bp, Homo sapiens
gccaagagaaatgcccaaggtcccccagctcgcccgtgccggggccaggattgcacccgggccagctgtcacagagtccaaccctttccccaggctgcatggctgcagtctgaatttggacagtttggggtttgtttttttgcctgaagtatgcattgcctcttaaaatgtacttcaccaaccagagtgtaccagactgggaccctctcctctctcctgtgctgaaggtttacggacagctgaccttagctgcatcgagcctgagaagtgcctgtcacagtcctagctggggacagtttggcagctctg

SEQ ID NO: 142775 - DNA, 353 bp, Homo sapiens
atggttgggattggccaatggtgacaagtagtgggaggggaggtctcccagcagaagatgggaaggaggaaggaaagtgggctcaggcaacttccgctctggctctttctctttgactacatgattggcaatcaggatttttctcagggggctgattctttacagctgtctctcttgtgacttccttaactgacccctcctatggtagtaagtactggttattgcccctacacccactcctttgtgtaactaaaccctcctgtacttactcaaccgattcaggtgtgccatcagtctccggcgagacctgggagtgataaaggagcaataatataacagacatggcctgtctg

SEQ ID NO: 142776 - DNA, 325 bp, Homo sapiens
aagtcccccgtgcgtcagccacctcctctcccgcggacctccgtcctcctctctttttggatgactccctggaacccctccgacttcctgcgtccctctccggctccgttctcccttccccattctgtcacagcccgcgtctcctctatttccagtggggctgggatctgtgaccctttggttgtcctcgcctcctaactgaataaccttaacttcagttttccaggctctgctgtactctttgtgcaccctgggtggaaagcctcctaattctttcagtggtcaatgatgagccgaaaaactgccggttctttcgtcttacggc

SEQ ID NO: 142777 - DNA, 175 bp, Homo sapiens
ttcctacagtgatgaaatcaggtttttaaaattctggcccaaagtgagggctggatgcatgtttgttaaatgacagaagacaagttgtatcgaggaactcatatggagaccaaggatatggcagcaaggctgctttgtgcttggccaagaatgtcatctctttctctctctctgt

SEQ ID NO: 142778 - DNA, 416 bp, Homo sapiens
tggtctagagggcaaggtcttggccactgacctcatctggctccctagcttagattccttgttctgggacacccactgggccccaaatcttaagctcctggatgtcaagagggagcctggctgctactcagaaagaggacttgtctcatctagtaccaagtcatggtgccatatcgccaacctttcaaaagtagagtctggaattgccatttacatatactgagcccagtgttggggtgttttcacatcgggagacactaattaggggtcctagaattctaaaatctgtagactcctagactgcagaactgttgcaaggggctttagggagcatgatgctgagcttcagaggggttctgggatttgtctgggatcacacagcaggctagagagacacactgtgggctagaacccag

SEQ ID NO: 142779 - DNA, 635 bp, Homo sapiens
gagaagcttgtgaagccatgtgctgtccgaggggttggggacacaggagtggacaagagagagaaggccttcccctcccacaggttttgcgtggttgggaggtagacacagacatgagagtgaacagacatggtcatttcagacagcgatacgtgccttgagggaaacgcagccagggagtgactgggtggtgccaataaggggccgggtttcaaagagtcactggggccatcagatcagatcatgcagcaaattccttggcacataatcagcactcaacagacaaaggggttctcctgtcctcccactgcacaggtggggcaagtgaagtcagaaagagaaaggctgggccaggcgcgtggctcacgcatgtaatcccagcactttgggaggccgaggcaggcaaatcacttgaggtcaggagttcgagaccagcctggccaacatggtgaaacccctgcctctactaaaaatacaaaaattagccaggcgttgtggtgtgtgcctgcagtcccagctactcgggtggctgaggcaggagaatcgcttgaacccggggagcagaggttgcagtgagccgagatcgtgccactgcactccagcctgggtgacagagtgagactccgtctcaaaaa

SEQ ID NO: 142780 - DNA, 434 bp, Homo sapiens
aggctagttagggaggcagatattttaattccaaattgtcatggttcatctgggctggtctttttattgcttctactggcttaggggctgaatgatgtgttcctgaaattggggttttaattcacatagctccacaagatgttctcaggctcgttttttattttctaacttccagcgctggaattagccattctgtgaggaaccggggttccctttagtggagagcagtgtttagaaaccaagatctgggtattaggcatgtgtgttactactggatatcattgtttctagatccagttagcaggcagagctaggatgtgtatgtataccagcctgtgcctattaacttcccctaactccagacttgtaaggttatattaatttcaattccagtccaacactagaagattttattttattttttttgagacaga

SEQ ID NO: 142781 - DNA, 191 bp, Homo sapiens
aggtccagaagaatatacaataatagcaagtaggcctcccatgtcactatcctatttccattttgttttcattatagaactcatcactatctaacatatgcttggttttatatacttatttaattccttattacctttctccctaactagaacgtaaacacctatggccattgtatcctctaaccagccca

SEQ ID NO: 142782 - DNA, 346 bp, Homo sapiens
tgggcctagcccacacagggtcacctctggctccaatgttgacttttctcactctcgctgtctgtgtcccatctgccacccaaactgggggttcctgttccttctcctccttacccccacaggagtcgtgctaacacaggtccctaacatttcccatcaggggcatcaacaccgccatagagcagccagagaacgtaaaaaaaacaacacagccactgtgagaacccattagcagtgtcctgtgatcctggaatgaagtgcaggctaacagggtcccccctagtttggccccatctctagtctcacctgtacctcttcctccccaacttagcctcaggcttttcct

SEQ ID NO: 142783 - DNA, 187 bp, Homo sapiens
gcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgt

SEQ ID NO: 142784 - DNA, 329 bp, Homo sapiens
caataagctgagcagaagaggttggttttaaagacagaaaaggcctgaggaaagcagtaacaaaaagtgggtatcatttcaaagtttccttgtgaaggttaagacaaagaggactggctgggtgtggtggctcacacctgtaatcccagcactttgggaggccgaggcgggctgatcacctgaggtcaggagtttgagaccagcctgggcaaccccacctctggtggtgaaaccccacctctactaaaaatacaaacattagccaggcgaaagaaacagcctgggcgaaagaaacagcctgggcgaaagaaacagccgggcgaaagaaa

SEQ ID NO: 142785 - DNA, 565 bp, Homo sapiens
ttgacgactgttactgtggtggtgtaagagaagagagaaaaggtggtttgagagtttttcccaaacaatagctatttgacaatctattttaaaagccctaaaacaatgcatccccgcaaatatgtgagacaaattccacatgcagaaatctgtcctcagaaactagatgtacaagtacagaaagatgtatgaataaggctttgattataataatgaaatgttggaaagatcctatacatctacctttagggcactagttcaataagctgtgttgcagccatataataatgtcatgaaaaaatgatactgcaggtgtataattaccaacaaagaagtaggtacacactaaactggaatataagtcagttcatatattataatcccctttaaaaaatagacatacatattggaatggaaaaatctgcaataatatagacaaatgttagttaagagtcagtgttcagtatattataatttcaggtttttttagtttaaaatttttgtttatttgtattttctaacttttccaaaacattaatgctttaatttaaagctggcttagact

SEQ ID NO: 142786 - DNA, 544 bp, Homo sapiens
cagagcgcacccagccggcgccgcgcagcactgggaccctgctcgccctgcagcccagccagcctgctccgcatccccctgctggtctgcccgccgacctgcgcgccctcgctgccgcccgtgtgcgcccctcgaccccagcggcaccatgcatctctcccagctgctggcctgcgccctgctgctcacgctgctctccctccggccctccgaagccaagcccggggcgccgccgaaggtcccgcgaaccccgccggcagaggagctggccgagccgcaggctgcgggcggcggtcagaagaagggcgacaaggctcccgggggcgggggcgccaatctcaagggcgaccggtcgcgactgctccgggacctgcgcgtggacaccaagtcgcgggcagcgtgggctcgccttctgcaagagcaccccaacgcgcgcaaatacaaaggagccaacaagaagggcttgtccaagggctgcttcggcctcaagctggaccgaatcggctccatgagcggcctgggatgttagtgcggcgccccctgg

SEQ ID NO: 142787 - DNA, 156 bp, Homo sapiens
tggtactctttgtggtctatctaccaccatagatgagtcctggcaaggtatcgagtaacttaccacagtttgtatataatttatagatttgggtttctataggaaaaattgcctttaataaattcagatcatcatgctatattatttcatttgggt

SEQ ID NO: 142788 - DNA, 323 bp, Homo sapiens
attgagaccatcctggccaacatgatgaaaccccgtctgtactaaaaatacaaaacattagctgggagtggtggcacatgcctgtagtcccagctacttgcgaggctgaggcaggagaatcgcttgaaccagggaggcagaggttgcagtgagctgagatcgcgccactgcactccagcctggcgacagagtgagactccatctcaaataaataaattaaaaaaaactgctccaaacaaaaagatataacttactttagtgcataattctaaacggtgtttttgctataaagggcatcattgggataaatggtgaaacttgaa

SEQ ID NO: 142789 - DNA, 501 bp, Homo sapiens
tggtgattcccttgtctctactaaaaatacataacttagccaggtgtggtggcaggcgcctgtagtctcagctactcaggaggctgagacacgagaatcacttgaacctgggagatggaggttgcagtgagccaagattacgccactttactccagcctgggcaacagaatgagactctatccaaaacaaaaagaaaatgaaaatatatttgttcttaaatgttagtttttaaatgattataattatatagtccttttcatagtgacagctgaatagatattagttgcaaggtaaacacagtgtgctattatgaaccttcattacaaaaaggaaattcttactccttttttagaaatttttattgcactataaaaaaaatggaggaagtactaatcatttattttgctgaattgtttatactgattgcttaatataagtaatgtgggtaatgtcaaaacttgcctcaagtatgatttttgggaagcctttccagacaaagt

SEQ ID NO: 142790 - DNA, 1531 bp, Homo sapiens
atgtgtatgggttgaaggtactttaagttgtgagccagctgctgcccatattgggtcaccaatgcacttgtcaagcccatgtaaccacatgaagtttgatagaaatataaacatttattttgaaataattccatgtgcacggttggaaaaacagtctcccttccctgagaggaatgagtaatttctcccttttcaagaagtgtacagtagaaaatgtaatgagattggaatggattccaaatcagtgacctttttaaggctgaaaccactattttaaatgaaaactttaagttcatacagtttcttatagtaattctacttttattttttagtcagtgtgcttaatcttttaggaaaaaaaactaaccagttattttttactaaagtatgtgaattacaaacaggatgtgcaatgaccaggcagaaagatatttaaaggtgtaattattctaaaggaagatgagaaaaaattcatctgctacagattcaactgtcttttaaatgcctcccttgtcatggagtaaatgactactcaaaaggatttcacaaaagacttaaatctcacccttagcaatcaaccggtcggccacagctcagatgcctcattagcaaaatgaaattgcacaacagacgaaacatagcaaaagaatgtagacatttccatggggtggaagaaaagaagaaagaaaaagcaccatggtgaactctgcttgcataaacaagaatgttttagtggaataaatgtaagctttctcttgaaggaatcccagttagaatgtcattggaaacggcaaaactatttcagcttcatagcagtaatatattccaactttattaccactgaggcacaaagctaaatttgtcagggggaaaggtaagcaaaaattactgacattgcaaccgataaaatgatcttgtgagactcaatattgagaaagaaaattaaaatagctaatatttctgttataattccagtgattactaagacttctgccaagggataaaattacttttccttctctcattataaatttctatatagagctattttaatgcagtaaggactgtattttcatattttaataaatccctcacgttgaatttgccccccatttcagatttgattaggaaatactaaattgagaaggcaggtttttccatctttttaaaaacaagtatgcaccataagcattttcagcggatgtctgccttaagcaatcttggtagagctgtcaatcagtggcaggtgcttgtttaaggaagagaacctgtgaatagatttagcctttcttcctcacagacagctgctcattcacacacgctcatctcgtcttcctcaacttcttgcaccaatcccgcctcttggattgacccacatccacctagcagttgaacaaactgcagattctaattacatgtcccgacagttgctcaacttaatttttcaccaactgaatttcatgcattgccccttgatgttccttccctctgttcactcttttctataagtccttgcatttgatatacttta

SEQ ID NO: 142791 - DNA, 419 bp, Homo sapiens
gaagccccagctgcccgccgagtaaccgacatttaggggaagaatgaataaggagctggcacttggcggctgcttactttggcctggcagcagaaagcaggcctggaggtggcccgagcaccgggtggtggcctcaatccctctggctttcagacatccatctggaccatccccaccaaccgttagggaaagaattcccgcagccaggccatgggaggcttggaagccattaggagcaggcagccaagaactgggggtggcgcaaacggactgggctcaggcagcctgctctagggagtacagaagccacagataggcccaggccagtgctggcttagagggcaggggcagactctttgaaatgcaaggagaaagaccctgaaaaacctcactgagtagtttttaagtgtttggaatta

SEQ ID NO: 142792 - DNA, 486 bp, Homo sapiens
tcatttcttctggtacgaacacttaaaatctactgtcttagcaattttcaaatatacaacatattgttattaactgcagtcaccatgatttacaagtctttgaatttattcctccactttaaataaatttttctgtcttttaaccaacatctccctaattcctcccacaccctagcctctgataatcaacatttcactgtttctatgaggtcaacatttttacactacacttataataagtaagatcatgagtatgtctttctgtgcctgacttatttcacttaacataatgtcctacaggttgatccatgatgttgagaatgacaggatttccttcttttgttaagggtgaatgatatttcactgtgtatatataacatgttttcttcatccattcacccattaatggacacttagattgattccacatcttggctattggaaataacgccacaatgaacatggaagtgatggtagtagtggggc

SEQ ID NO: 142793 - DNA, 117 bp, Homo sapiens
ccacctctcagagcgctggggccacacaggcgttcacaaactcatctagaggaaaatttgtattttcttttcacagatgcaatttcctggctatgctctcccaaaatgtgtaattag

SEQ ID NO: 142794 - DNA, 254 bp, Homo sapiens
ctttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctct

SEQ ID NO: 142795 - DNA, 1120 bp, Homo sapiens
ttccaacttcaaagaaggagactcaacattttacaaaagatgctttgtaaagcaagtggcatcccaccaggtagaaatggcctcttgatgggaccaaaggaggctggaacttgttcatgttgtaaaagttaagctccctaagagagccacactacaaagccattatgagtagtacacagtgccataaaactccagattcaaagttaccaacgctttaatcaaatacacgtgccgactgccgaaatcatcacagagataactgcagcttttgtttggctgattcatgttctgccgtcttggggttcccactttagaagtcagttctggtttggcctgtccaggaggcctgggaggaaagggtaggagcgccagagtcctggaagcatgaggttcctgacctactggcatctaagagggactgagtttgcaggcgcaagttgaatgtagactcatcagcacttctaacaacacagctctaagcaatctggctgtgcccatctcttccacgggctccgctctgaccactcgggcctttctgctcctcgggggcccccttgcttggttttctctgttggaagcgcgttcctctggtgctctcttggttctctctttctcatccgttaaggaacagctgaaatgccacctctttgagaccttcctctccatctgaagtacctgcactgcacactcctcccctcaccacccgctcgcaaagccattcccaatcactagacttcagtgtagtgtagaaataacagcataaacttgaaagcctcaacttctacattcaaatcctggcactgtcacaggggcaagtggcttaaaggcccatggatccatttctgcatgtaagggtaacaacacctgcttcacaagattatacaagtgagtccatgggtcgggcatggtggctcgcgcctgtaatcccagcacttggggtggctgaggcgggtgggtcacctgaggttgggagttcaaggccagcctgaccaacaaggagaaaccccgtctctactaaaaatacaaaaattagccaggcatggtggcacgtgcctgtaatcccagctactcgggaggctgaggcaggagaattgcttgaacccaggagacggaggttgca

SEQ ID NO: 142796 - DNA, 376 bp, Homo sapiens
tgtgtaaggtgactctaccggatctttcaccgtatgcgggggatgcagaaaggcataatataggggagaactggcaagcaatatttatagctggaatacagcatgcataaggaagatgggtagatacatttgcaaaggttggaaaaggacccatcatgttgggccttgtgtgtcatgtcaaggagcttagatcttgtccatgctggaaagacgatgcagagccattgagagattgttaagtcaagaagtgtgatcgtcaggtgtgaaggctaggtgcaactacaggcaccatatagatgatagtttgggtcgggtccttaactggaccatcagaacacattcagagtggctcaactgagagtggttaggtgcctaa

SEQ ID NO: 142797 - DNA, 481 bp, Homo sapiens
gttcccaagctctgagtgttttcacaattttacagcaaatgttttgtttcttctgaacactcagaaatgagtccttctgcctaacaaaattcgatacatagctaaatatttgctctcataagcatcacttttcattgtaatcattttcaatggttgtcttagagcatattcggcatattttagcctttacaatgatattattacagttgcctgtttttattgtagaaacattagaaaacatgctaataaaacccaccacgaaggcacacagcgtcttaggacaggtgctgtgctgaagcagggatgtggtccccttatttagtggcatggagccatgaacttcaggctctgcgactggagctctgtctgctttggattctgatgttggctcccctattgttgtcaaagggtgtcatttatgtttgccgtcaagatgtctatcagcagagtgcttctcagacctctccttttgtttctttga

SEQ ID NO: 142798 - DNA, 464 bp, Homo sapiens
caaatatttataagcccaaacttaaatctaccaggagtcacaaacatgcagaaatctgtgtaaggtgtataacataatggcaatacattttataaaagatcagcaagaacaacctctattgaaaaaaagacagtatgacttagcactaatcataactcataaatttagccaaagaatcatgcatgtacagatgacaagttccatgtaattactttataatttactacaacaaattatgcataagattctctctaaaaatatatccaccttagaccttgcttgggacagcagggggtaggggggctgttaatgcaagtactggaaagatctactttcacctctaatgatcttaaataactaatccaaagaacagtgttaccaggaggctctcagtatatttgattggcaagatctatcccacagatgactccctaagacctcaatactccttatttgcaacatat

SEQ ID NO: 142799 - DNA, 832 bp, Homo sapiens
actttgcctctcgcctctggacggcggcggggcggccgccggattcgcggccgcagggagcgccggagacggggagctattccgccccggcgctccattcggcgcccgcagccctcagggggtcggccccgcggcttgggagagggcaccgcggcctcggtgtgcgcagccctcgggcgcgagggtcggcaggcagcggacacagccgcgttcccagccggtggggctcagccgtggcgccggcgaggactccccggccacccgcaggtaacgccgggcggagggcgcgctactagcagcgccggagatactcgagcccagggacccccgggccagcggagggcaggagcggagccccgagggagcgcgggccccgacggcgcgctcccccgtcagccacgggcaggcaggccccgcgtggcggcttggggtggggggctgcagcggggccctcgggccgaaagtcccccgggcggccagccatgaccttcgggcgcagcggggcggcctcggtggtgctgaacgtgggcggcgcccggtattcgctgtcccgggagctgctgaaggacttcccgctgcgccgcgtgagccggctgcacggctgccgctccgagcgcgacgtgctcgaggtgtgcgacgactacgaccgcgagcgcaacgagtacttcttcgaccggcactcggaggccttcggcttcatcctgctctacgtgcgcggccacggcaagctgcgcttcgcgccgcggatgtgcgagctctccttctacaacgagatgatctactggggcctggagggcgcgcacctcgagtactgctgccagcgccgcctcga

SEQ ID NO: 142800 - DNA, 146 bp, Homo sapiens
ctaattttttatcctaacatatgtcaaacattatgccttgttcaaggctgagttctgaaatctcctgcacgcacatacacacacacagcaaatgggatctagaaagaagtactacagtgtaagtgcagacaacatagaagagtaaa

SEQ ID NO: 142801 - DNA, 754 bp, Homo sapiens
gagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttctaatttttctaccatttggagaccgtaggcatttgggcctgtcaccccttggatgggttcctagtttgtttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttggaaa

SEQ ID NO: 142802 - DNA, 737 bp, Homo sapiens
ggttactgcctagtctgaaccctcagctgatgatagttttggggttatattggtgttgggaagatcactagtgaaaatggcaggggttcatttctagaggtaagaaccttaatatccttgatcttagttctaatatgtccctcaaatgaaagatggcattccctgtacttgtaccattcctaatcataaaatgatttgcagctaaaacattttagcctcacagcagtgaagctttatcattcctaagaattgttcattacatgagcgtcacttcatcccatttaaagatttagctcacaaattgtatttgtccatatgccttagaagctactgtcctaccgtgtcttgtatttcatatggtagaagagtctgagttttttgggttttggtttggtttttcttccttaggtcttgaaaggtagacagaggagtttgctttctctgaagaagcatggatggtaacacatcctcctgttttaattctccattttcttcattgtttacaggtcctaaaccttggcttaaattcataaaagatgccttttcatctatcccagtaatctttagttttatagatttaaaacaaaatttgagtcttgaatcaatggaccagtctatttcttggatgtcaacaatagtgtacattttggatggttctgtatttctcatttgcatgtgaaacatgcttaattataggtatttctgtggttaagtaaatctggttttgacctaccttt

SEQ ID NO: 142803 - DNA, 488 bp, Homo sapiens
ggagattccctgagctcagtccgacttgggagcagggaaaacccaaggtgcttctcaggcatggatgtccagaagtccatgggaaaacggactctctcagtcaaaactctgaaaaaaaatcagtctcacattttttcttctccactttcctgcaggatatgagacctgggtctttgtagactcaatctgtgtggaacagatgaggaaacagacctacacctgattcaagggggtaatgccttgggggtgggaatcttggggtcagctgctccctttctttttggcttttgatctttctttctggcttctgacctttgcaaactttcacaaaagtcatgagattgagagaatgaacccccggtacccatcactcagggtcactcacgaccaacacagtccctctccccccaccaatatgctccccgccccaatatacactagattattctcagcagctgcttctttctcaacctgtttctcaccaacac

SEQ ID NO: 142804 - DNA, 397 bp, Homo sapiens
tgggctcaggggcaggttcagctcaggcctacggcctgctgggcttgagaagcttcgcctttgtgcctcggtttccttctccgtgaaatgggaggtgcagcgtggtgctaacgtctgtgcagccctgggcacgcctggctccggaagcactggccagtggaggtggcagcaagggatctgcacctgtgcactcgctggacctgccttggggagcagcacgtgtgggtccaggctgcgaatcccgaccggattctcagggaggggttctgcaaggtgcacccggtgggggctgggagctcctccggggcgtgtttccctgtgacgtaaaatgacctctatccctgagccctcccatgtagaaagcgggaaggaggctggccgctgtgtgtgggtgtgg

SEQ ID NO: 142805 - DNA, 571 bp, Homo sapiens
tggaggtaaaattcacgaaagtgcaggcggggggcaccccttataactgggttccccaggagttttaattcttagactgtccacattgagcctccaccaattcttcaattactgacaggttcttctaccctggcactggttcccatggtggtttccactcatgaatctctgctccagtaagatataatttcctgtatttgcctgctggtctctcctatcttaggggcagcagtttgacttgtatcctcacctttcttacagatctaggaagagctgttgatttttcaggctgtttagctttttacttgttagaatgaagtggcgactttcaagttccttacatgcggatctggaaaataagtctcctcattcttttttacagttgcatagtattctgttgtatggtcatacctgtaacttgtttacttactcttcttaaatgatagacaatttgtttccagtcttttactaatataagtagtaaataataaataattttgtagactattatttcccacgtgtaaatatctttaggctaaaatcctggaagtagaattgccaggtcacactg

SEQ ID NO: 142806 - DNA, 2439 bp, Homo sapiens
gaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacggtgaagtctattacaggagcaaatacctgagaagcgatacctacaacaccaatattgaggcaaacaggattgtggtgtctgagtttggaacaatggcctatccggacccctgcaaaaacatattttccaaagctttctcctacttgtctcacaccatccccgatttcacagacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacaggcgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctgatcagactttat

SEQ ID NO: 142807 - DNA, 965 bp, Homo sapiens
tgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagctagtatgtctttttctcgtatttggaatgaaagtacccacattttacaatgtagtgttgagaatgtggctgccaataaatttagcacaatgcaatttatttaccttaaaaaacaaacaaaaacaaaaataaagaaaaatactgatttcaaatcagactcttaaaaagctggaacattagacctgatattttattatgatttttcccagaataagtttaatttctctttgactttcatagaaacactttccccttatagaaattgcactatctccaatttatttctagtttgagttgaaatgaatattttatcagattaattatgtgtcacatttttggtgggttttc

SEQ ID NO: 142808 - DNA, 461 bp, Homo sapiens
ctgacaagagaaagagatttataaccaaattctgtaattgggacttccagtctttccccaagtagagaattggacttactctatatgctaaaaacccatggttgaaatatgaattagttcttaagtgatttttggcttgcataccatttttgcaaacacaaattgtcattactctgctcatttaataaaagaataatttgtagtataggtatatacctcaatcagtgattttgttgttggaaacagaacagtaaatcacactggccatgatgctaacagcgtgatagattttctgttcttgggacaccaatgtcactgtatctcatagcgaaggattatctgctgtaggagcattctcttgactacttataacatttgctgggtgaaataattctccaggttaaggcctcttctaaacagatgaggtcagcactaactgcatttgccagagaagacatatg

SEQ ID NO: 142809 - DNA, 252 bp, Homo sapiens
aacattttttcatttcaccacatgaaatatcaaaactcacccttgtttccactgagacaactttaatccctctgggaatcgacactccacttcaaatttaaaacaaaaaaaatattatttcagggctccctaaggagaagattagccaatttgcagaggaagagcatggttattttatccttatagtgagaactgagaaaaaccatgagtaaagtatgctattctatggaaccagaaaaaatgactgggccc

SEQ ID NO: 142810 - DNA, 389 bp, Homo sapiens
taaactagtttgagccaatcataacatgtttgaatctcattaatcaagacataaaaggaacgagcctgtttgatccaggaggaaccactcttatctggtttaagtcattcacaactagtttgaaccatccagaactggtttattcccatgaataaatgcagcaacacagagctctagaatctccaccacgataccaaaactacctagaatcatgggcaaaccaggactccaggaacacttaaggtgtgtttatgtcatccacatgccattgtgccaccagcacctggaaccactgggcagcctccccgagccttgaggccactgtcacctagagccctagggacagcatcatggtagaagtccaggaccaggtatttccagcaagttgg

SEQ ID NO: 142811 - DNA, 426 bp, Homo sapiens
agtacgggggcctcgtagaccctggtgtggatggagggttcagcgcaggagggatgtgaatggacttcacatctcagaagaagccctcggtgctgtgtttcaaatagtccatatcagtcaaccattctcatctgggggcaattttgtaacacttccccacccactggcaatgtttggagacatttttggttgtcacacctggggttggggtgctcctggcacctaatggagggaggccagggagataccacccaacatcctacaaaatgtagaacagggcccccaacagagaatttctagattgtgtcagtaattgtgctgacagatctgggtatggcaggagaagccaagggtctagtttagattatgtaaatttgagcagctgttacacccctaggtggagaggtcaatagggcagctggaggc

SEQ ID NO: 142812 - DNA, 1047 bp, Homo sapiens
aggccgtggactgcagctgcactccagtctttaagcccagctgtgctcgggtgtctcactttctacaccccaccctcagcatcagatatactctatctcagaagcaaaaagccatccatgaacaaagacctgggaccaagccgactcataatactagtgggaaacggccccaccagcagcccgcacctgcatcctgctctcccgctgcctcactggacccttgcagttaactgggacttcagcagagcagagcctcatcttacggaggtcaagtgtcccactgctgcagggccttcaacctggctatctggtgatgtaggaataggagaggtatccattggttcagactcttcagttgacgcctccactgtagtttctgtaatgacatctggcctcatagcagcatggataaattctggagttgatacacaggagggacaaatacttccacaggacttctcgaatccctcaagcaggtaggagattccacatgaagcagggcttcagcagcttcgactgtcttatctgtacagtgtacattactgctgtgagcagatgcttccacccccgagatgagcagatccagctggttcatgggtccctcatgcagagacgttgccacgttcatcccggggctggagctgctgcttcacactgacttacaccgtgagcagcggcggcaggggaggaggtggaacccgcggcgagctgctgcttcacactgacttacaccgtgagcagcggcggcaggggaggaggtggaacccgcggccggagacacacgccgtggggtcggtcaacacacactcacgcacttgcacacgctccaaggcccggaaggaagctgaggccggcccgcctcccgccaaagggccgaggaatcccgccacctaacggcaggggcaggggccacagctggcaacgcctactttaattttaaaaataatcactggggcctggagcagcggctctcgcctgtaatcccagcactttgggaggccgaggtgggcagatcacctgaggtcaggagttcgagtccagcctggc

SEQ ID NO: 142813 - DNA, 130 bp, Homo sapiens
actttaacaatgtacactattatattttaccctgaatgacttgtgtggctcttacggaggatcctttaagctaagttgctggccagttcctttccacgttgctgagagctccccgcttcaattttaaaaa

SEQ ID NO: 142814 - DNA, 302 bp, Homo sapiens
ttctaagggacacattaatatccaaatgttctcctactcttgccacccaccacccaactctgagcaataaaagacctccccttataaaacttcaccaactctagtagtcgtttcagctggattttaggcagtactcccttgcctttcgaatactcccaatagtacaaactagctaagcaagtacatttttttcctagtattttatccaaaaacattaatactgcattttttattaaatatttaaattttaaataatcctttaggtgactaacacaagtacttacatattcaaacaagacagg

SEQ ID NO: 142815 - DNA, 525 bp, Homo sapiens
acatcatgcaagccacacataaaatgttaaatgttttagtagccatattaaaaaaataaaaagaaacagggaaaatcaattttaataagatattttatttaacccaataggactgaaatatcatttcaatatagaagttattaatgggaatattttacattatatttttaaatatggagtaagtcttctaaatgaagtatgtattttacactttaaaacacatctcattttgggctagacacatttcatatgctcaataaccacatgtgtttagtagctactatattgaacaatgagaatgattttaaaagagtattaaaaattgagcttaaagctatttacgtcatttaaggaataccttcgaaattacctactttattttagaataagtttaggtttacagaatttgcaaaattagtacagagtataatctgtacccagttttctcttgttaacctcatctattaatatagcacatttgccacaattaacaggccaatattaatatcactgttaactaaactc

SEQ ID NO: 142816 - DNA, 204 bp, Homo sapiens
aaatagccaagcagggaggtgggaaggttcgagaaggaaagtcagaccctctccaagcattacaacattcagccttcccgagagctcacttcatagaggagacactggagcctaaagcactgaataaccttccccgaggctgtgcagcagcgaggggtggagaaggaattcccctctgtgaacggccagcctgcggcctcccca

SEQ ID NO: 142817 - DNA, 494 bp, Homo sapiens
gggagaggtgccctggcggggcagggagcgggactgagcttacaagggcctcgggacacattcttgtcacagcagccactgagggccctgtgcagaaccacggcacatgcagaagccacggcccacggagaggaggtgagccgccaaagcaggacgagaccaatcctggtcgccatactcggtcctgtactctttccatagcaccacgtctgccctcggggcttatgtattggtcaacagacacaggcaaacaaaagtcagaaccatgaggagacggctggaatttctaactgtaaaacatacaggatactcacagaactaccggagggagagagtgtgtaaaaaggaaaggacttggcttggatttaagaggaactcctctacgtgactattttgaatattcaagagccctagttccctgaaatgttaaagttagtaacacgaaagcaaatacctcctaaccttcaaaagtacaaatatagtttatcttgaaa

SEQ ID NO: 142818 - DNA, 381 bp, Homo sapiens
ccatccggcggttgtactccaccggcaggttgtactccaccggcaggttgtactccaccggcaggttgtactccaccggcaggttgtactcccgttgttatggtagcgcacacctgtagtcccagctacttgggaggctgaggcaagagaattgcttgaacccgggaggcagaggttgcagtgagccgatccagcctgggagagagtgagactcggtctcaataaatacataaatgggaagtcatatcatcacgaggtccccacttaccctcatgacctcatctaaccctaataaccttccagaggccccgtctccaagtatatgatcatgttggggaatagggtttcaacacataaacctggggaggccggactcacaca

SEQ ID NO: 142819 - DNA, 543 bp, Homo sapiens
accctcgctgccgcctcctgcaactccttcactacttcatagcgtttttctctgggtcacttatttccgcctggtggctctgatagtgtgatttccaaggtgactatccttctgagtctcagctcatccccagtcagccaagaaagaagaaacagcaaggtttggggaatagcaagagtgcccctaacattgctgccagttccctttggaagccccagtctggagtcccaacacactggccaagacagcaatgtcgaggccgtcctggtcccagctgctctgggactgcctccagctcagctcaaaggaaagccatgagttaggttttatcatcaaagagtccattcccctcctccatccttttgtacaaaattatatttagttctgccaaagagatttctgagttgccataaattctccttgctatcagaacgagataaggaattgaaaaggggttacatggagggcagacttcaaagggggaaaataaaatagtctgaaatcacctctaccctctgaattcctccaggcaccagctttatg

SEQ ID NO: 142820 - DNA, 158 bp, Homo sapiens
gcagagcatttagtatctgcaggtcaatagaacacaattagcattcatgcaatagtagtttcaggaagaaagagaggaagtaagtatttgaaaaaaacgttgaatgagaactttacaaaatttaagaaaattatcatcccacggatattagaaaatcc

SEQ ID NO: 142821 - DNA, 252 bp, Homo sapiens
aattacagggagggaatggctttgcaaaattcagagtgaatcttgctggaaggagggtaggtttcaaaacttcagaaagaaccaggatgactccaaaaggaaagatgctttctgaaagttgcaaaactctcaagaagtgataatcacaaatgagaagagaaaattaacccccaaacccagtatagtttcactgggagtcttttttgagaataatccataaggatttttaaagaactttgtccatccattgat

SEQ ID NO: 142822 - DNA, 546 bp, Homo sapiens
gagatacttatgactgtgattagaaatactgtcaagcaatgtttgagattcaccactaaagccctaaatttgttttatttacttgtgtttaactctctctcactgcaggtttgtggaagcatttttcctagtgcttcaatttcttccatgaaatgggaagcaaggacatgttggatgtttgaagaaacagaaggtatgaaatagtcttctaggagagtgggagagtaaatggattgaggaaacaaaataagatttctggtggcaaaggtacagttgaagtcagtagtcatgaatttaaagtgatatcaggcagcatgtagagctataaaatattgttttcaataggttttgaactctggcagtttcatagatttaaatatttattggaatatagataggaggagacaataactaaagaagtgaaatacatggtatgccaggtggtgacaatggctatggggaaaacagaggatagagattggagatagaaattgacaactctttcaaggagttttgctgtgatgagaagaagggaaatgccggtaa

SEQ ID NO: 142823 - DNA, 460 bp, Homo sapiens
ccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactc

SEQ ID NO: 142824 - DNA, 269 bp, Homo sapiens
ctgctaatcctaatgtattttcctcctatggttaatagcaacaccatccactcaaatcagaaacctgaaattgatgccctgtacctcttcctcatcatgctcccccaatatccaaaagcctaacaattttacttcattaacatttttcacaactgtcccctcctctccatccctacctcagatcctcttcaattctgagttatacaatttcacaagcctcctgattattctacctgcctccagtctctcctaatgtccttagccgctca

SEQ ID NO: 142825 - DNA, 352 bp, Homo sapiens
ctccggtgatctgaggatccctataggcgcataggttacatacatcagtcaaaagcagcatgttctgttatttgcaacgcatatgtttaaaactgatacactatgtttgtggacagcactgttcactaaggtattttaaaggcaaaagttaaagaaatgtcagggaaaacagtgctaaggttgacaggaaaaggttccacaagctagacttggtaagctctttgctcctaggatggcctagttttgaactcagatcatagtccatgaagggccagcatatcacatcccatctgcaacacaagactgccagagtgtgtacccaaaggacacctaggcgcctataggggtctca

SEQ ID NO: 142826 - DNA, 449 bp, Homo sapiens
gtctgaggggaaggtgcgtagtctctttgtgtcaggaatcttttaaaatataatcagggcctttcaagggctttctagaaggaatctgcattccaatcagatttatagtattgaaatattgtgccagttcaaatgcatttttaatttttggctcctaaatttaacagaaaattattgttctttttctgttgtattttttctgttttctgttgtaaatctattataaggaattctttcatactaagaaaaatgaaaacattgggttcaacctgttgggtattatgctcactggctggggtgataggactgttgggaccccaagcctcagtgtcactccatataccaaacctgcatgtgtaccctttatagttaaagttgaaattaattttttaaattaggtttaaatctctttagagataagagaatactatgttataggaagaaatagg

SEQ ID NO: 142827 - DNA, 364 bp, Homo sapiens
atgacagctctcagagtcgtggttggaatgaaatgagaaaatgtgtgtggagcccttagcgctcaaggaactggcgctgaagtactcaatgaatggtagctgtgctgtttactaagaacttaataacaaagctgaaaaggatgtgcagatcgcatgagttttggtgggatttcaaagtcctgttttctcagtatgatagagaagtatgccctgttttagtcccacgtcttcctttaatggatccctcattagatgctgcccacgtggaaggatgtgtggatgctgcatgtgatgtgggttagcttgagctagattcttctgtcctgtcggactagggttctcttgggctcattgtaagtgattt

SEQ ID NO: 142828 - DNA, 412 bp, Homo sapiens
aagaaacacagtctcgctctgtcacccaggctagagtgcagtggtacattcatagctcactgtaacttcaaactcctggactcaagcaatcctcctatctctacctcccaagtagctgggatcgcttgagcttgggaggtcaagactgtagtgagcgctgattatgccactgcactccagcccaggtgacagagtgagaccctgtcttaaaacaaaatgaaatttaaacaataaaataccatcgtgtcaaaagtagtttttctaaactccatatttcataaaaagccagagcatgcaacggcacctgttctagacatcaaaaggacatggacaatgcaagtcccaccgcccagtgctcatcacactcatctggagaaccctgaaagtccctgccaggaccagcccaagcaca

SEQ ID NO: 142829 - DNA, 238 bp, Homo sapiens
ttcctatgtttccttcctctctcccaaagcctatcattttctgcaacataatgcgggtaagggaggacatgttaggaaagctggcagagagttctggaggctcccttacactcctgcctactctaatcttagccatctaccacctccaagtactgcctcccaagtactgcccactctgtacaaaccaggccaattttcttttccttctcctctccccttgaggtctgctgtcccctac

SEQ ID NO: 142830 - DNA, 511 bp, Homo sapiens
tgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtcc

SEQ ID NO: 142831 - DNA, 377 bp, Homo sapiens
tcctccccacccatctgacaggtgaaatggcattgcaacttaaggtgctttctttgagttggttagactgaaaaacctgtcgggatttcaggccattcgtatttgtcttactgttacctgttctgattttcctgctaggttgcttgtcttgtagaatttttgggaacttttcatacactacagctttaacacaaagtgattatgtcaagtaaccctctctcctgtttcaatgactgaacaaggaagtctatctccacttcatccacttattgataaacagaatctattaaacaccaccgcctacatagtaccatgtgactggtgaggcaacctctgccctggacgtttcccgctgtgccctaaatcccacaacgaag

SEQ ID NO: 142832 - DNA, 379 bp, Homo sapiens
ccagggcctttgcacacactggtccttctgtctggaatgctttcccccaacacatatacaaccttttcatttgcatgactttatttatcccttattaatcagtttggcctttcagaagtcatcctgatccactcctagggtgggtcaggggctccctcagtgctcccacgctgccctgtgattctccaccacaatctcttttattctttcttcttttttttaaagacagggtcttgttctgtcacccaggctgcagtggcacaatcatagctcactgcagcatccaactcctggactcaagcaatcctcccacctcagcttcctgagtacctgggacacactaccacgcccaactaatgtttttgtttttatttttatt

SEQ ID NO: 142833 - DNA, 465 bp, Homo sapiens
tacgcgttacgaacattgaggtttaagtgggtttgagccacgtgttcatcttgggcaacaacatcagtggctgaatgtctgttggtgactccttaggctttaaatattttgtatcccatgttggggtgggggcgtccacagcttccattaccctttgtcctctcctggagccttacctcttcccgctgggttgctgtgttggtggtctccattgacatctgtcaacattttgttttcttttcttgggtttttatttttatatttcctcaatagaacatatgttctgcaggacgcagctacatccagccatgattccccacggccaaaacaatgcctggcacatagtagttgctcactaaatgttggttgaaggaattgtaacctaactcgtgatctttggggctggaggttgctgagttatgctgtgaaaagtaaacattttccaaaaattgaggatcaaggtag

SEQ ID NO: 142834 - DNA, 371 bp, Homo sapiens
ggccaaaaataagcaagatacccactcttgcctaatatactcagtgctcaatgctcaccttgaaattacatttccctcattgttgatgaaattgcagaggagttatcaaaactgacccaagagaagtttggccattaagcaaaatggttaacaacaagagcatgttgtaccatgcacctgtttttaaagccatctgaacacaactcttaattgtattgtccaaggttaagttggagtttcgtgaagaggatgataattaagtactacatgcctcttataagtaatcgctctattgactaaacctcaataaatatacattatttatttactagtgatatcaatagttctttacatctcagcagccaaactcc

SEQ ID NO: 142835 - DNA, 238 bp, Homo sapiens
ctggtgtttgattacacgcacacacatacacacacacatacacacgtgtcatttttgttgtgggtctagcagactttaccaaaggactgaaggttggaagaaaaggcaaagaagtgtggcatttacttcaagcaatcaagcaacttaaaaatttcaaatttattatgaaatacttttgttaataaaggacctttggatagtctactctgttacttggccatcctcttcctctccttcc

SEQ ID NO: 142836 - DNA, 235 bp, Homo sapiens
agaaaacagcaacactctctgaataatgtcttggtctgtcagcaacgctagctgtctgtttcgctcttgtcaagggtcttgcaggtgggatgccacggtcagtccttccagatagaaacacgaagcctacggcccttgctctaagaagcttgaattctgacatcttaagcattggactcaacccagtcccaggattaagccctccaggactgtctgcttatctttccagcttcag

SEQ ID NO: 142837 - DNA, 466 bp, Homo sapiens
ccaggttgggagacagcaaatttgccaggaagagagccctacagtgttacctaattcaggtgtcctctctaattcttaggcagttggcctttcagtcatgagggaggatctctcagagtgacctacagctccttctgtctcctgcctggatgtcagatgttagagacgcactaaaggcttgctacttagagtgcagcagcagaccagtttgctgttggaataacctggtagctggctagaagtacagaatctcaggctgcacctcagacctcctgaatcaaacttgcagtttcacaagatttgtatggacattagagtttgagaaacacttgtctaaggcttggagatacagccatgagtggaagctgtagcttctggggattcagggcaaagaatgacatgaatttttgtaggtaaattgtgaccaatggaccaagtgtatcgttgtatcagagattactcttca

SEQ ID NO: 142838 - DNA, 293 bp, Homo sapiens
ggctctcaccgtccatttagactaaagggatcagtattttgggcacacccataaccattcatagtaccttagttggggagctctgccttatgtcctggtatttcttaagattcctttcttggctctcttcccactgcacatgcttctttgacaatctcatttacttccatggctcagtcacatctgatatccacgtccaatcaatcatgcagcccaggtaatttacctcctcaaaagcttttaatttgtcatttgtcttcatgtttctaccttagtttaagttaccatcattt

SEQ ID NO: 142839 - DNA, 300 bp, Homo sapiens
gacatggtattctaatggttatgtattgctttacccacagtggagctttaccttacaaagcaaaacagctgtagctgaatgatgaggtcaccgtcataaggccgcatctatgtgaaatggtataccctgtgccactctcaagcaccttcctgtgagccccttcccatgagattaggccttttataaaaatgcagacacctggcttcaggacttaggagagctggcccttaatgagagggaaccctattttcttgtcagttaactgcatgtgtaacaatgcgcatttgtctggtaggtgaa

SEQ ID NO: 142840 - DNA, 199 bp, Homo sapiens
acagaaaaaggaaataattaacattaaccaagcccaggtaacagacagagaccttttctctataaatattttttaaaaattggctgggcatggtagatgtgcctgtggtccagctattcaggaggctgagtgggaggatcactggatcaccaaaggtggaggctgcaatgagccataatcgtgccactgtcctccagcc

SEQ ID NO: 142841 - DNA, 486 bp, Homo sapiens
tgcaagaccccattgcaatcatccttatacctatcatgacagttttgaatgaagtctgccttactgtgctttaacaggtatcattgaattatttttctttaacacatcttagcagtaaaattatcttcaaaattttcttagaatgtatgatcatcatctcttatagctgtatcctgatttccactttacaatagagtgctcatattatcatctcatttgtgcctttaacaaaccttttggggtaacaattgttatttccatgtgatagctggagaaactgagtttgaatgagttcctcaggggaacacagctagaaagtagtattgtggggctggcacacagtggctcatgcttgcaatcccagccctttgggggccgagtggggaagactgcttgaggccatgagttcaatactgacctgggcaacatagtgagacccccatctctacaaaaaaaaattctaaaaataaattagtcagatgtggt

SEQ ID NO: 142842 - DNA, 339 bp, Homo sapiens
gggctcctgggaagggtagagcggtttggcttcaccagcgcgctaactaaaggcccgcaggggagagtaaattaagcgctaattaggaggtaatggagggggagacgcagaaggccctcttactcttggccctcagggaaaaggagttttcctctcactgcctgtagaataggaaggtggctggcaagaaaagtccaaagggaagagaaagtagggggttgagacatctggatcagagggaggaggggctgaaactcctgggttttggtccgcagggcactgggggacgcagactccccagctggacccagggggggggcagggcccgggtgcgctggc

SEQ ID NO: 142843 - DNA, 1541 bp, Homo sapiens
gttgaccagactggtcttgactcctgaccacgtgatttgcccttcttggtctcccaaagtgctaggattacaggcgtgagccaccacacccggctggtgattagaaaattttctaattggtacttggaaagtttcagacactaggaagtaaatgttaagaaggtgaaatacaatgttgtgttaggaggggattaggaagaccgttttgtcattgtggtcaggaggagatgacatttgagttgaaaccttaatgataaccaggtggacatgtgaaaatgtatccacgtgtaaggacgagccacaacacaggaactgaaagaccaaatgacaggggcttggtgagcaagggggagcacgaaggaaggaaaattcaaagaggttagaccctaggtcatgtcacgatcttaaaggccatgctaacagtttggaattgtacaataagaatgatgggaaagcattggagagtttgaaggtgagtagtggcagaatcccacctgtttctgacagaagtccccctggcactggatgaggaatagattataggggctgtgaatgagaacagagattattaataaggaaacagtgattcccttccacaaagtagattctgttaattggtagagagtattcatcagaacacgtagcagggttgggaaaggaggcaaaataagtagaaataaggagtttatggtctagttgagatgaaatattttcagaacattgcaaatgagaaagataatgtcatgaagctaaaccaagtgacatatttatatactttaaaggttagcctgaaaccaaagccaattagactccatgtgtataatgaggactttaatatcacatgctttgaaatattacgtatttttcataacctgtccttcagaagcaatcacatggtatcattcgatcaaatttaaagtgatgtccttggatttttgcagtaggaaactttgacattttagtggagatgtttaaaattattatcatttttctggatctcatgttttaggaatgtacagtgtaaaatatcttgtcatagaagtcacattaaagtgatgttaatgtgaaatttaaatctggaaaagcccccaagtggtttatctgtacttgaagttacttgtttttctgttcttttcctctccaatacatgcaggaaaatacatacttttttgacattcatatagattgttcttattacaatcatccattcatccgtttgcccaacaaacatttattgaccacctacattgtatcttttttgtttttctttaaataacatactactattagttgaaagtatgtgagcatttgtctacgggagtgttttgactttaccagagtaccttttcaatttctgtctttgttgtatcttcattttactgttaattctgcaggggttctcgtttatctttgaattgtaattcttattgaaagtaaaataaaaaaattatgcataagtatataatttgaccacttttccaaatttctataatatgggcttttatagctttttaaaaaagcaggaatagtttctttttaaa

SEQ ID NO: 142844 - DNA, 444 bp, Homo sapiens
ttttttttttttgtagagacagggtttcaccgcattgcccaggttggtcttgaactcctggcttcaagtgatcctcctgtcttggcctcccgagtgctgggattacaggcgtgatccaccacacctggcccagaatttttcttataactgaatacttcctatggattactttattttccttgaattaacaccagaatgtattttatcccccttctgtcgtcttagatatacttgcatgtttggtttttttgttttttgtttttttgttttttttccctctcctgcagttccgtttcctttttctttcacctgttttcatttccctataaatccctgcaccccattccagctattgcataggattcttctagttatttcagtctgtttccttggtgttcatggtggtgttcaaactgagatttgtgttccatcctgggtaccata

SEQ ID NO: 142845 - DNA, 300 bp, Homo sapiens
acattagtagaccttaaacgacgatatagtttccaaatccaaacaaagggtaaacgctaacattctaggaccataccatttgtatctcctatggtacacaagactgaatttttttttccttatctcacctcaagtacccctggcaatctttctttcttttctttttttttttttttttggaaaaaaagcttaactccttcacccaggtgggggggaaagggggaaatttaagttaattgaaacctgcgtttctgggaataaagaaattttcttgcctaagcctccttagaagttggaata

SEQ ID NO: 142846 - DNA, 273 bp, Homo sapiens
taatgccaaaacatggatgaacctaggaaacattatgctaaatgaaataagccagacacaaaaggataaacatggtgattccaattacatgaaatctctagaataggcaactttatagagttagagagtagattagaaggttccagggactaagggaaggggaatggggagttattgcttagtgggtacagtttctgtttggagtgatgaaaatgtttttaaaatagaggtgatgaaggccggatgcagtagcttatgcctataatcccagca

SEQ ID NO: 142847 - DNA, 311 bp, Homo sapiens
gggtgcaggctttggtgaaagcttgaatctggtgtactttaattcccttctaattataacatcccagtagtctgcgtccctttacaggacaaacacgagttaggggacactgagaaaggaaccgaggctctctggggtggctactgctgagtgaggcacatgtggaatgaatggcctggactagattactgggtcttaaacgttctagatgttataaatcatacgtacttttaaaaattattaaatcaatagagtggccaactttttattttttgctgtgtaagaacttgaatgcatacatgctcgtgcaa

SEQ ID NO: 142848 - DNA, 1674 bp, Homo sapiens
cacacacacacacacatatatacacacacacacacatacacacacatatatacacacacacacacatatatacacacacacacagaaaccctatatatatatatctcagagctgagaaaggtatgtgtatatgtacatatctgtctcagctccgtccaccaagagggactagaagtgacacccagtggttatgagcacagctagcaccaagatgctgatttccaaaccctccactaaaaatggaattgaattgacagtccagaaataagcccacacatctacagtcaactgattttcaacaagggtgccaagactatgggagagaatagtcttcaacaactggcgaatggacaagtggatatccacgtgcaaaataatgaagttggactgagatcccacacgataaatgaatattaactccaaacgtattgaagacttaaattcaagagcttaaacaataaaaactttataagaaaacagtagtaaatctttacgatcttggtttttacaatggattcttagatatgacaccaaagtacaagcaacaaataaaaaatagataaattggaatttatggaagttagaaaattttgtgcatccaaagacatgatcaaaaagtgaaaactcaggacaatggcagaaaatatttgcaaatcctatgtataagagtctagtatgcaaaatatataaagaacactgaaaacaacaaaaaccaaacagcacaattcaaaaatgggcaaaggacctaaatagaaattttccaaagaagacctacaaattgcgaagaagcacatgaaaagatgcttgacgttactagtcaccagagaaataaaaatcatgagatatgactttatactaaccagaataaaaatgtaagagaataacaagtgttggtgaggctgtggagaaattggaactcttgtacactacaggtaggaatataaaatggtgtagacaatttggaaaactggctgatggctcctccaaaacttaaacacagaattaccataagacctagcaagggcatttctaggtgtatatcccacagaactgaagacagaaatttaaacaaaaactagacaacccaaatgtctatcaaccaatgaatgggtaaacaaaatgcagtctgttcttcaatggaatattatttggccataaaaaggaatgaggggtaggagggagcagggatagagggttgatggctaagagggatgaggtttctttttgaggtgatgaaaatattctaagttgactgcagtgatggttgtacagctctatgactatactaaaagtcattaaattgttcactttaaatgggtgaattgtgtataaattatgtctccataaagctgtttatttttttaaaagacacacaaaagaagaaactttcctgcagctccagctgaccttgcaggctggcctcttccgctctgacctgtgctccctaagctccctgcgaaggagataaaatgagctcctggtctgcaacagctattggttattgtaatgtctgcttttgtttaaaaagaaaaaaagacccaactccttatacagtttgaattgtatatatttggggatctctgagtttcctgtatctggatgtctaaatctcttactagacttaggaagttttcagcaagatgactggatgatcatgtttcagcctctgtgaga

SEQ ID NO: 142849 - DNA, 765 bp, Homo sapiens
ctctaaaatatattggcattgagctcatttgttaggtttgcccaccttattgaacagatttattttccttatacatacttgtgttgtccttggttacgtgtgtccccaaatgtaaataccaaatttttataaatcaaaaattttttagtgtgtaagagattttatgtaattttaagggccttttcagttcatccttttgcaaaaccatcaccacttaattatacttttgcatcagtctagaagactgcatattggaaagcagtgtaaatctataatgatgtatattctggtgagctgaatagggcattatgcatgtcctacaggtctccgccacctctcatgcccatcatcttccttttgtaggtgtaattcataacatatgcctttctgctgtctttaggtataatcagcaacagcagtcattctttgagtgactaatgtatacttggggttggggttgaaattccttaagccaaatgagttttagcttactgttttgaagtgccattttgtattgttaacaagtgtcatgaagggaaggaactaaaatcaaactgacagagtgtcaaggcaacaaaataacataaacaaaataataacattgtacaacagtctagttcttttatcctttcatatagagcctattttttatatacttttatatttctctactggaccaaattcatgttattaacatcagactttaattgtgggatacttaatgaatatagaactctaatataaagacttacctctagctgaatt

SEQ ID NO: 142850 - DNA, 334 bp, Homo sapiens
ccatgcacagttcggtggcattaagcacattcacattgttgtacaaccatcaacacgacgcatttctagaagtttcatctcttcaaactgaaactttatatccatcaaacaattccccatttccccttcccctgaaagctatcattctattttctgtctcttgaattttactactttaagcaccttaaaagtgaaattgtcggccgggcatggtggctcatgcctgtaatcccagcactctgagaagccgaggcgggtggatcatgaggtcaggagttcgagaccagcccagccaatacggcgaaaccccgtctctacaaaaaatacaaaaatt

SEQ ID NO: 142851 - DNA, 723 bp, Homo sapiens
ggaatttttttacttaaatggtttgattgatacaatgagaggttacagggatctaaggaagtctaggcagtaatctgtcgaagctgctggagaggatgacgaaatggggcgaggaggcaagatgcgggggcctttccatggcaagaaaatactgaatgcactgccataatgtaaatatgagagttacacagacaaagcaaggcaaataccaaagagaatcaggaaagaatgccctgaagatctgcattaaaactgttctctgaaattaagcttgtcttgtgaggattcactgaaaatgagagtcaaccactaaggagatttgtatgaaaagaacccagcgaattagagaaaagatagatgctggcagctaagacaggagagggacatgtgagttgggccagggtacagaaaatgcagtgtggcaaagggcagagtgggaaaggtgggagggagctgccaggtctcaaccacctgggggagaccatgacaaagtaagagacacttatgaggtatttccagaaagctttgttagaataataattaaagaaaagggtatgtcactagggcaaaagattagaaagaaggcaaaagagatggatctgtacaggctaactgcagcagtctatgcaggtctggactgaactgagaagcaatgggtgcagcatagtgtgtaggacatcgaggaaagctgggcagtgagtgccaaaataagcaatacacacc

SEQ ID NO: 142852 - DNA, 320 bp, Homo sapiens
gcagtatggtgggtaagaaaacaaaatattttgatgactaaataaacagtcaaatagagatctccactcagtttctaaaatgcaagatttattacttgcttcaatataaatttatgaggcatcatcttagactcttagagttacatagaaaacaacatagtttctacctttgaggtttataatcaatgtaggtgggaatgcatactcataagagattatttaacaaagtaactgaaacactgaggctgtttcacatttcttgaccactttttttcctgtaaaacaagtcacttcattcattcattcattctatggttgtc

SEQ ID NO: 142853 - DNA, 463 bp, Homo sapiens
aatgaagctgaccttcatatattccttactttaagaaatcaaattgccaactattttcaaaaatactctatattttggaatctagttgagtttaaaaccccacaatctgatggaccaaccagtggtcattcagattgggaccagactcccagggcaattatttgtctgggatatgcctaatcaggcatgctttagaataggttcaaacctttaaagccaatatttaactagaccaatttcccagaacaaatagtaaaaggtaaaggaaatagatgctttcttcttgaccttatgttctattttaatttattgtccgatgtgttcacattaacctcattgcagagaaagctgtatttattggcatcaatttcactgactgcctgccttctccattaatacaatcttcttgagtgagtgaaacatgattttcttttgttctttttttatactagttgtcattatg

SEQ ID NO: 142854 - DNA, 285 bp, Homo sapiens
ggaaaatagaaactaaagagggctacaactagaactgtttggcagtttacataagatgacagatatgaacatgcaaatggcaaagttctctataaatgtgaatacagatgattcactgtagacaccccccaaaccagataggctggaatctgctggattcgggaccaggaaaatggcttcaagacttaggggaccctaccggcctttcagtgtcaaattaggaaagcccaattaatagctgctgataaatttctttagggatgaatatcagaattattgaattcc

SEQ ID NO: 142855 - DNA, 310 bp, Homo sapiens
cttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagt

SEQ ID NO: 142856 - DNA, 957 bp, Homo sapiens
agctatatccagcctggagaagtttccagctgttgtgttgaaaaaatacactaatattatggttataaaattaaactgcacttggtggtgggctggaggctaagctttcagagggtcccttgcctgggttcaggatcttgttggcccttttggcccccaaatgtcgtcttgtcactgtacctagaggggttctgagacattatcagatttcttggggatcaacataggctaaacaagctcatggacattggggttactcattcacaatgagaaatagaaccaggctgtaaggcttggccattcagggtttctcccccatctgaaagagtgagtctgtggggaagacaggctagccagaatgtcactcatgagcaggtggaattggctgggtgacttcagtcaattggtcaatcaagctttgatagccacctctgtcatcacaccaactcttctcaggggcagtccatgacactagaagacccttttctgttcacagtggctaattaagttaagcttgagcattgcttgcgtgttgattgtttacgtcacatgtttacacaatcatgtttttctaaaaccccctcaccttgatggacttgggtttgtaaaatttcttaggcatccattttccagccatctagggtgggctgaatctagagatgcttattttgtttgtgcatttgaattttccataatttcattgtgggagggcagcctaaagtcctgatgttgccttctccatccactgaccaccccaaggtactttgcataatgcagaaaaggccagtgtaatgggagttgggactgctgtgtcctgggctctctgagtggtcctgagcaggtcatgtcccttctagactttaatccttcctcagttggcctctgatgtccccttttccttcctgaaagctacacgcccttgctggggagaggctggcctctccactactgggatca

SEQ ID NO: 142857 - DNA, 597 bp, Homo sapiens
catggtggcacgctcctgtgataccagctactcaggaggctgaggcaggtgaatcagttaaacccaggaggcagtggctgcagtgagctgagatcaggccactgcactccagcctgggcaacaaagcaagaccctgtctcaaaaaacaaaaaccacaaaaaaccaagtactaggttctcaaccttaaatacggtaattaatcattttagagaatggtgaagtcatgaacttctgatccagcactaatgaagagaaatataataagtcacaagtgcaagccacatatgtgattaaaaatttactgagctgggtgtggtggctcacgcctgtaatcccagcactttgggaggctgaggcgggcggatcacgaggtcaagagattcagaccatcctagccaacatggtgaaaccccctctctactgaaaatacaaacgtcagctgtgcatggtagcatgtgcctgtagtcccagctactcgtgaggctgaagcaggagaatccgctgaacccaggagacggaggtcacagtgagctgagatcatgccactgcactccagcctggtgacagagtgagactccatctcaaaaaaaaaaaaaa

SEQ ID NO: 142858 - DNA, 357 bp, Homo sapiens
ccgcgctcgcctgagttctcgccgaaggccagggcggctctgcggcctggcgccggttagttagtgtggtgcaaaagccggaaggagacacatttggtcctggcctcccggcagtcaccgtgccaaggacgaatggactatcgcttgatttggagtacacttcctcctctttaaagattacagatgagggggatctcgcgttctggggtgccctaaagccctcttttggcagggcgcagtggctcacgcctgtaatccctacactttgggaagccgaggagggaggattgcttgagcccaggaattcaagacaagcctgggcaacatagggagcctacctctctctcttaaaaaaaa

SEQ ID NO: 142859 - DNA, 557 bp, Homo sapiens
gactagttctgatcgcgagcccgccctttttttttttcaagatacagatgctggtgactcaactatttcttgaaaaggaaagaggcctggaagcttgggagagggggccaaactttctctggtcatcttcccactgttgccagcaatggtgagccggaaattgaaagaatgacacaaggttgcctgtacagacccacacaccctcccaggaaattggggaagctgggcatccctaacagtccatttaatggaggtggaaaagaggctgtggcttgagcttacaatgccctcacccagtcttcagatgaactcacagctcccaccctaaaatgagggggaaacattaaaatttagagtgggtcttgcctgcctgactttcctctgccaagataagctcaataaggcctgttcacagatgatgcatggctggtataatgggaccaaatgctgcccttgattctactcagaagtagaaagtgggtgagtaccaaacacaggccagcggcgcaaaagggcggcggcgatgaccttctgccggctgctgaaccggtgtggcg

SEQ ID NO: 142860 - DNA, 169 bp, Homo sapiens
tcattaaaaatattatagcctgtgtttgattgtgatgaagttcttacagaagccagtattttggagaaccaagtggctgttacatttgaccattactgtagcattggtgaccataaagactgtgaggtagggtagcttatagaaataagtggtgcctgtaatcccagca

SEQ ID NO: 142861 - DNA, 252 bp, Homo sapiens
tgtgaccctcctgaagaaagcaagggcttcccttgtctatctactacttctttttctatttttattttttataatttcaaatttaattttagattcaaggggcacatgtgcaggtttgttacctgggtatattgcatgatgctgaagtttagggtgcaaatgatcctgtcactcaggtactgaacgtagtacctgatagattttcaactcttgcccactcccttcctccccactctagtagtccccagtttc

SEQ ID NO: 142862 - DNA, 225 bp, Homo sapiens
cttgtgtttaaggcaatgctggagaccatgttggtttgtctgattccagcctgttacagtctgagaggccacactgccgccccacagtggtgtccctacagccccccgggtgtctagtgctgaagccctacttgggtagcatctcatgccctgtggccacggccaggaggcctggtgcctcccccttggctagtattgagcagcatttgggtctttgagatgaaa

SEQ ID NO: 142863 - DNA, 468 bp, Homo sapiens
caggggactagttcaggcattgtggttggcacaaaggtctctggtctcaaagtttataatcccattggcaaactgaaacatagtccccagaatatgaaacagtgacactggacactgtacaattaaaaatcaaatgagtgaggacttctgcttccagccaacaaacaataataacaaggaccacatttacccttccacctaaaacaacagaaaccaaaccaacactggtttttaagacaatggatgtcaagcaacgaaaaaatgagaggtggaaaacacatgtgctgagccctatgcttgctcctgctcactgcccgaagagtttccaggatacagcacaaggaagatgtgttaagtttgccagagctgctgtaacaaagtaccacacactgaatggcttaaatgtcagaaatttattgaccacagttctgcaggccagaagtctgaaatcaaaatatcagcagcatt

SEQ ID NO: 142864 - DNA, 413 bp, Homo sapiens
gcgtctctaccaagcgcttatccagaatctgcttcaagtgcacttcccaagacagccctctccacactaggaaacagcctttcagagagaacatttccatttcacatctgcccattggttctttgttcatcctcagggctccacagagcaatttcttttccagatacagtgcctcagacatttgaaaacagccactccatgcccctcagagataagcaggtatagttacttcaacttttcttcctgagacatcgtttccctacctaatgatcaaggggtttggtgactacgtgagtcactcaggaaccagctgcattcacccaagccccgtgagtgttctgcagaaggcagggagagagggcactgatttcatgtttggggtgggtggtgcaggaaagggggattctggggct

SEQ ID NO: 142865 - DNA, 420 bp, Homo sapiens
gacacattaccttttctatatttagatacacaaatgccattgtgttacaattgcctacagtattcagtacagtcacatgctgtacaggtttgtagcctaggggtgataggctatattatatagtctaggtgtatactaggctataccacctaggtttgtgtacgtatactctatgatgtttgcacaataacagaattgtctaacgatccatttcccagaacatatcatcattaagcaatgcaaaactatattgtcattttctgaaaaactgtgggattgaaatggataactccttaagcttactttcaggcctgtatatgtccttaatattgattggctgaatgcctacaacaagaatagcaaataatatttactgatctgttaagacgtgccaggcataggatctaattgtttttacat

SEQ ID NO: 142866 - DNA, 406 bp, Homo sapiens
attcccactagaggagtggagactcctctgaaaagaggacaagatcaggtatcagatagactggagttggaatcctgactttcctacttggatgtgtcctcttggggaagttccttgcccatctgtagaaggggtgtagcagaggtaccactcctcccaggatggctggggggactaagtgaaatgatggatatgaggcccttggcttggggcctggcacagagtaagggtaaacaaatgcgagtggtttcctgctgcaccaggatgtgggtcaggtcttctccctgctgagtgctgagccatcaatggtacccagctatcccagggctatctgaagcaatgcaggagccagctggtcccctagaacctgccctgggcacaggcgaagcctcctcctcctgggatc

SEQ ID NO: 142867 - DNA, 154 bp, Homo sapiens
gctgcagttgacctggcaatcagctgtacaccccaggctgtttctcatggacagatgaatggatggatgctcaaccagctctccgtgaccctgaacttgtataattgctttgttggaacctgaatgttgtcttttttcatttgtcctcattaaa

SEQ ID NO: 142868 - DNA, 213 bp, Homo sapiens
acttcctccccttcctcagtttctcctccccggggcccattcacaggcacgcactgtggagatgcccacaccacagccatagtcacacacttagtcactcccgctcccggcacaaacacacacagccgtagcccacactcctgacaccagagggttcctccccgtctcctgctgcccacccagcacctccacccagaagtctcaagccttttg

SEQ ID NO: 142869 - DNA, 97 bp, Homo sapiens
cccagctggaacgccttccacataaaagggatagctcccctaaaaggtatatattttatgtctttttttttaactttttttttttaagatgggattt

SEQ ID NO: 142870 - DNA, 420 bp, Homo sapiens
aaggcaattaatgtttactgaacatgtgcctatgggtttagagtatctcagttgaatctccacaagaatcccatccagtgggtacttaaatccacattttgcaaatatgaagacgggaccagaggggctgagtaatgtgccctgttccaaaagcaggaagcagagtagagaatgtgtgtggcgggcccctcaaattctacatgctctgaactaaactcagactctcccctttgcaagtctctgaatttgacaccattctctgttagctcagacctgcgggctggtctcccttagctctccctaccctcatccctgctgatctggctcttcctggagtgtagaagtcaagggctcaggctccagagtcagagagaaccaggttggactcctggctcctccatcaccagccatgtatccccc

SEQ ID NO: 142871 - DNA, 230 bp, Homo sapiens
cagagaggaaggacaagcgtgaggaataggaaaatttcacctgtaggtgggatggaaaaagcttggaataattggccgggcatggtggctcacgcctgtaatcccagcactttgggaggctgaggtgggcggatcacctaaggtcaggagttcaagaccagtctggccaacatggtgaaacccccatctctaataaaaataaaaaaattagctgggcatggtggcatgtg

SEQ ID NO: 142872 - DNA, 262 bp, Homo sapiens
aactcctgggctaagcgatcctcccacctcaccctcccatgtagctgggactacaggcacacaccaccaaacctggctaatttttgtattttttgtagagatggagttttaccatgttgtccaggctgatctggaattcctgggctcaagcgatccacccacttgggcctcccaaacactcacaaagtgtttgggattatgggcctgagccactgcgcctggccctaaataattcttaaatccatcctctcctctctatccc

SEQ ID NO: 142873 - DNA, 708 bp, Homo sapiens
ctgaacttagaagtttgttctttaaaatacaataaagttatatggagctatactttaggactgttaatcttgtagcctgtgtgtaggagtggagagggaccgcagaaaaattaatcataaataacatttcattcatccaaccaacaaatatatattgacactgtgcgtcaggagttggtctaggtgctgggaatataagaggccttccttattctctggactctcattcttttgggagacatacaataaataacagtagagtgctcaaggaaggcctctgaaagcatgacatttaaggtgaaacctgaatgacaggagaggtctgaggggaaaacatactgaagatacagcaagtgtgaagcagtcttgacttactgaagaaagaagggaagaggtattttagaattcttgtattatttattctattggaatatgtatttaagggctgtactgacatactggtgaaggatgagataatgtattttttagtaattaatttcccttggttactactcagttgtcttaataccttgagtcattttgccagataacaagatcttatataaagctattatattttatatatataaaaaatatgtaataattcattgatggccttagaataatttttttttctgggcatccagtgtcttaggcagctgaaactctctaggaccattgtatcattgggaagggaggttaatatat

SEQ ID NO: 142874 - DNA, 352 bp, Homo sapiens
ttcaccagggaccgtggtaccaccatcaccttggtgggtttgatgcaacatgaggaggtggatgatggaacaggcgcccctagattgggtcctctgctatgggggaggggtcattaaaagatctgctttaggtgaatcactctaggctggggcagggtcccagcagaatgtgatttctacttctaaaggtacccagaggtaccaatttcactctgaaaggagccagttcttgctctgctccaatttgctctttagtcttctgggttgagacaaatatgttcaacagagcccccttgtggagagagacaatgtacaactgtctatcaaaggccctgagaaggcctgtagcaaa

SEQ ID NO: 142875 - DNA, 974 bp, Homo sapiens
  misc_feature (730)..(730): n is a, c, g, or t
gctgcgctcccgctccagctaggactctctctgccgcctcctcctcctcctccgacctcagtcctcaccaccctcctcccgctcctcaaaagcacccccgagtccccaccccctcacgccgcacccgcgggaacgaggccttgggaattcaggggagtggctgtgggggcgcgtcgcggctcccagctcggccagcccctctttcaagacatggtctgatccccattgtaaaagctgcgccccgaagaggaggagagagtcgtgctccctgcctggggctgcagggagctctccgtgctgaagctcttgcattattttagggtggggcgaagagggccctggattttggggagtgggggtgggtggggaggaggacccgaggggggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggtaacactgctttacaccacgcagccttaaatggacactcaggacatcagtctccaacctacttcagtatgaggcatcaacaaatgtagcagacaacaaagggtatcttcctattcacctggctgcctggacaggcnatgtggcaacgcgacgctctagtcagcagaacatcaagtccgggccatgaccagccaatgaacataactgcgcgacaggggcactcaatggacgccacaacggcgccaaaaatccacgacgacatcacacacggcacactcgaccgagcccacgcgcaatggacacgaccgcgcaccccacgacgcacgatcgcagaatgcactagacgacagccaggcgcaacacacgaagagaagagtgcca

SEQ ID NO: 142876 - DNA, 99 bp, Homo sapiens
atggggtttagtaacttaaccaaggtcacactggtagcaagtggaagacctaggatttaaacactgaaatatgctttgtttctttttttcaggtaaagc

SEQ ID NO: 142877 - DNA, 265 bp, Homo sapiens
cttaaatgcccatgtgatgagatgtggtgaatgacataggccttgtaatgcagccttaggctcctactgaccttgaacacaagcccactgcagtactgccacagtcactctgataaccaagacagctactaagtgactaatgggcagacagtgtgtgcagcatggatatgctggacaaagggatgactcctatccagcgagacagagcagggtgactcaagatttcgtcacaacattcagaagggcttacaatttaaaacttatg

SEQ ID NO: 142878 - DNA, 484 bp, Homo sapiens
attgtggtagctatctctatttccatattttttttcttatacattgaagtatgactttttctgtaaaagagatagaattgggtatccagaatcagaaagttttccaagagtgcaaaggagatttggaacttaaaagctgttaacatttttgctggactgcctgtttcaggatggcacataattatgctagaaaatctgtggaatagaggctgggctagtatttaggaaaatatggcagtataattgtggaaaaggagatatcagaaggaattaacaaagaatactgggactaagaggtgaatgagagcagattcatacacacattgagatgaccatgggtgtctcttaccactgtttggtttggtatatgaacaacacagaggtgggctgctactacaaccatgtgtgtggagtgttgcatggtggatcaccataataggatcaggtagaacaagcagtggagaagaacagaatcttagcacct

SEQ ID NO: 142879 - DNA, 412 bp, Homo sapiens
ccctggctcccctctttctgcacagttgaccacttgccacaggggcaggctggggagccccactcttctgtactcttgagagggtttgagacttaaagaaataacgttcctacaagaatagagttttctagggtgagaatcccttgtctttcccagctgcgattccttgcagcctggccatggagagaggctggcccatcagacctagaacatgtgctttgagagccgtattcagtgaaaattgctttcttaagtccggatccaggtaatttcatcccccagatgctgcctggggaagtgtcttcttctgggacaggccctggaggccccagctaacctatgccgctgccgccccagccctcacctggttgcccaccccctctgcttgcacctctatcatccctggtggtct

SEQ ID NO: 142880 - DNA, 299 bp, Homo sapiens
ctctatgccattttcatagtactctaggtgtatttcatcacactcctttgcatgttatattgcaactgtttactttttgggtcacttcattaaactacgaactctttaagaatagagacttgtatatctttttcattttgtgtcttcagtgtcaagcctgatgcctggcttatagaagatattccttgatagatgaatagaaagaagagaaggagaaataaatgagctcgtatatgtgaaggcattttgtaaactataaagtgctatgcaaatgttagtgtgattttacattgcattcc

SEQ ID NO: 142881 - DNA, 473 bp, Homo sapiens
atgatcagaattaagaaaatttcatttccttctacttacaaaagagaaaggtaaaaacggtcacatagtttaaaatgcaaatcactgttaaaatttgtattgcactaaacagctttttgcccataagcttagtatgcatacaaggcacctgcaattcatacatcaattacagtcccgtatgcgcatgcagcatcttcattatccaaatgtgatcataaaactaaaatgtaatgctttacaagtgtttcccttggtagaaattcttgtcgaaggcccttagccaatttacatgtctcagtaattcaagtagtctattacgttcgaatactcactctccatcaaaaacatctttttaaaacttcccttggaaaggtaaatggcatgcaccatttactgagtacattcaagatatgaggaaactgtcccagtgaattttaaatagggtgcctaaaagctaaaaggaatcttgctta

SEQ ID NO: 142882 - DNA, 442 bp, Homo sapiens
gccaagtattgtactttcacttctaggacaatcttacgggttttattttctccataaactattaaatttaacctcaaggataagtttaatcattggaaatgccactggatactgaaatgtgccttctcttttttgagacggagtttcattcttatcacccaggatggagtgcagtggtgcgatctcggttcactgcaacctctgcctcccggattcaagtgatcctcctgcctcagccttctgtcccaagtaggtggacctacaggagtgtgccaccactctcagctagcaccttttaaatacatttagaatcaagaacttggggagggcctcaaggaaccatctaatccaacctcttcagttacagatggggaaaccaaggcagaagcaaactgaccttattacgcacctacaatgttccaggcactgtgtgaagccctgt

SEQ ID NO: 142883 - DNA, 210 bp, Homo sapiens
ggggctgtctgataaagaacctgtgtaggtttccatatggctatatacaaagtatatgagcgtagaatagttttaaattttgtcttagttatacttggtaagttttaaaacgttatttaaatagccttaaggtgatatggattgctttagtgactgctgttttaggaatttagttggcttattgctgactatagagggaacgttttatct

SEQ ID NO: 142884 - DNA, 344 bp, Homo sapiens
gcgtaagcagtatagggtccctcaagggagggggaggatcctgggggtcctgggggtgcaataagcccggcaccccttctcttgcttccagctaccccgcctcatcctccagaacggcaagagggagggaaatagaagggaggtgaggggcgagcgggaagagcggcggcgcgccagcggctggagagagaaaaagtttttgcaaaagggaaaaaaaaagtttgcgcttctcgcgggtggtccgggcttgcggcccggcgggctgggccggcgggagggctgggggccaggttgggggggtgggggtggcatcgaggctgcgctgccgtggccctctccgcccc

SEQ ID NO: 142885 - DNA, 741 bp, Homo sapiens
aaataaaacccactttatcagcataatacagtaactccactccactccactcctaagtatatgccaataaaaatgcatatgtacatatgttcaccaaaaggcatacaccagaatgctaggccatctactcgcatgtgctcactattcacaacagctgtcaacaatggaataggtgactaaaccacggtcttctcatccgtgggctagtccttggcaatgagaatgagcaaaccattgccacgagcaacaacatggaggaatctcacaaatccaacgttgagcataaaagccagacacgaaagaaaacaccgtttgattccattgataggaaattcaaaacccaatccaatgaattgatggcattaaaactcaggagcatggctgttttaggtgggggtgtgacggaggggcacaaggggatttctgggggtctttttgaatttgggagttggttacatgcatgtgttcactttgtaaacattaattgagctatacattttatgcttaaaagtgaaacatgtaaaaatcattgctaatataggcctttctgtgactctccttctttcccattctccatccttcccttgtggttttctgaagttggccttcccaagtaagttttctactcttactcctttggtattgcttgggtatctcaaaattttcttttgttttagttatttatttttattcacttttggggcatagtaaagtatgaagcaattaaaattttaaatgaaa

SEQ ID NO: 142886 - DNA, 576 bp, Homo sapiens
agcagtggcaaccccttcgggtctgcttctgtgttgtggaagctttgttctttacctctttgcagtaactcttgcttctgctcactgtttgggtccacactgcctttatgagctgtaacactcaccgcgaaggtgtacagcttcactgctgaagcccccgaaaccacgaacccaccaggaagaacgaataactccagacgcgcccccttaagagctgtaacactcaccgcgaaggtctgcagcttcactcctgagccagcgagaccacgaacccaccagaaggaacaaactccgaacacatcagaacatgagaaggaacaaactccggacacgcggcctttaagaactgtaacactcactgcgagggtcggcggcttcattcttgaagtcagtgagaccaagtacccaccaattccggacacactattagctagctaactcctatttatcctcccttaaatatcaccttctgagagaagcctaccctgaccgtccacacctgggtccaagagcactcaaacttcttttttacagcatttggcacacttgacagagaaatagctaatggtgtacgca

SEQ ID NO: 142887 - DNA, 241 bp, Homo sapiens
ataatattaattgttggtaaaggtacaaataaaggacatactcattctctggcaataacaatgcaaactagtacatctatcttgtaaaattatttgtcaatatgggtaaaagccttaagaacatcaatacataactttaattttaatacagcaactttttttaaaatttatttattttactttaagttctgggatacatgtgctgaatgtgcaggtttgtaacataggtatacatgtgcca

SEQ ID NO: 142888 - DNA, 126 bp, Homo sapiens
cattgtctgtgttaggcactgggctacacaatagggaaggcagtatatagatatgactgagcttaccatctggggaagcaaacatatttaataacacaaattattaattgtaattatgataaattg

SEQ ID NO: 142889 - DNA, 452 bp, Homo sapiens
gagtgcaatggtgcgatctcagctcactgcagtctccacctcagcaggagagcaggaatcttcagtgatccacgggcagatctgcagccattgtgggcacctgttcctccctgcgacctttgtgcccacgtctctccctccagtacctattgcacgacccccacgtccgcctcctgccattgccagcaagtgccttgcgcgggtacctggctgcgcttattaatccattatggtcgctctgtcactggtgccattatgtgctcacgtgcccactccctcaggtttagaagtcgcgtcgcccggcaacagaacaatctgctggcttagcctttggccaagttggcagctggacgaggacgctcagagcccagctctcgagagttcaagtatccgacagttccccactgctcccaggagcggttacccgggcactctgtgcccctcattcctgt

SEQ ID NO: 142890 - DNA, 550 bp, Homo sapiens
cgggagtgggctccttatcacgtgagtggctttcttatcaaagtgagctctctttggctctctggctcttgccctgtcaccatgtgatgccctctgcgggttttgacataccaagaaggccctcaccagatgctggcaccttgatcttggacttcccagcctccagaactgtgagcgcaataaccttctgttgcttataatttacccagcctgtgatattctgttacagcagcagaaaacataccaagacatggatgtgtgtgtgtgttggtgggcggtgaggaggaagagagggagagagagaaaagcttttcagtactctttgtattgaagtacttatctcaggtcagcacagtggctcacacttgtaatcccagcacttgggaggccaaggcgggtagattggagtttaagaccagcctggccaacatggtgaaaccctgtctcttctaaaaatacaaaattagccaggcatggtggcacacgcctgtaatcccaactacccgggaggctgaggcaggagaattgcttgaacctgggaggaggagat

SEQ ID NO: 142891 - DNA, 394 bp, Homo sapiens
ctcctcaacccccgacatcctccaaaagtttagtttgagaaacagctatctgaccttatggctatttctatccaagagggactccattggctctgatcaccacttactaactaggcctactaaaatgtgatgatcttgctgggctcttctacgaaaatatctagcaacccaaggaaggcttgcacttgctcattttgctgaaatcaaggatgctcatgctggccgggaacagtggctcatccctgtaatcccagcactttggaaggccgaggcaggtggatcacttgaggccaggagttcgagacaacatggtgaaaccccatctctactaaagatacaaaaatcagccagacgtggtagcaggtgcctgtagtcctagctacttgggggctga

SEQ ID NO: 142892 - DNA, 503 bp, Homo sapiens
gagctcggcaccccgaaggccggcatcagcagccggtgggccttgccccagttgggctcgtcgttgcgggcggtgaacagcccgtccccgccgaggtcgcggagcatctccagcggccggtgcagcttcttctcgaactctcatatgaaatgtaccaaaacaaaagggctgagtaaggattaaatgaaagaatgcacacaaagaacctagaacacacattacattcagtaagtattaacagttattattatcatcatcaacatttatcaaataaatacttagagcattctagatagtatgaaacctgcatttagaccaaaggaggcagagtgggaaggagcacactaaccttggcttccactggggtccagggacaaggatgagcttatggacaactgagagcacctggatattgtagggacctctgaaaacagctggggaccatgaagcccaaactgggcaagttgccatttctgcaacgttaaaaggtaaactttccacct

SEQ ID NO: 142893 - DNA, 451 bp, Homo sapiens
aggaaaggtaggccaggctgtaaacagaaaaccttaagatggttttccagtatgaccagacaaacattgcaaaaagtagatgataggccattaggcacacaactaaaatgagagaaacataattatcattataatatgcaagtacagactaaaattatggtattcacaaatgatctgcttgttttaaaataaccaaattaccaggagaagaatacaatatctcagacaagggagatgatgaagacccagaattagagcagtgataaactgcccattaactgacataagaaacagatgactcacagtctggggaaggagaaggtgatgacgtctgtttttgatgttttgtatttgagatgttggtggaattatcaagaagctatgcttggcagggggatacataagtttgaaatttaagggggagtttagaactcaaaacagatttgggagt

SEQ ID NO: 142894 - DNA, 468 bp, Homo sapiens
tcataatttattacaacactcacaagaaatgaacaaaatgaccctccctcaaaaaacagtgtgaagacaaagtgtcatgaaagcagccccagcctggtacatggtgatgtggtttggcttgtgtccccacccgaatctcatctggaattgtatttggctctgtgtccccacccaaatctaatctggaattgtaatcctcatgtgtgaggggagggacctggtaggtgacaggatcatgggaacagtttcccccatgctgttctcctgatagtgagggagttctcaggcaacctggttgtttgataaatgtctggcacttcccccttctctctctctctctctctctctcctggcaccatgtaagatgtgccttgcttccccttcaccttctgccatgattgtaagcttcctgaggtctctccagccatgtggaactgtgaatcaattaaacctcttttcgttatagat

SEQ ID NO: 142895 - DNA, 430 bp, Homo sapiens
ccacctccctcctttacagatgaggacaatggagaccagagagtgactcttagagcctggggttctgcttgttaggtgactaactgattcacagagctcctaagtattgcaaaaagaagtgttttaactgactgacagcggtcctaagcattccaaaaagaagcggccccatccctcagccacattttctaatccctggctctggggcatccaaaatgtttgacatctaacattcaaatgctccctgcagccgcaactccatgtaaatcccactcaaggaaaatgtcaggcagtgatcaattctgctgctgtgctgcaagagcaggcaaaagttataaaatggaatagctaatgcctgaaccttgaggatttgggaaacaacttttaagcacaccacggtgctcttaagccattctgtgaggtccagtct

SEQ ID NO: 142896 - DNA, 155 bp, Homo sapiens
tagctcggtacccccgcgcgtcacccagaggcggacttcgccgcgcatcaggcgatcaccctcggaggtcccatgtttgacagggcctgtggctctccctcggggccacttggcaaatctaagcaggttcctgccccagtctagcctagaagcag

SEQ ID NO: 142897 - DNA, 809 bp, Homo sapiens
ttttaagaaaggggaaaagactaatattaattgaatacctattatgtgttttaatgtcttaagtacttttctgggcatttcatttaaattatttgattctcacaacaactcagagccagagatattattccaattttataataaggaagatgcaaataaatcataaataaatcaataaatgatgtagtaatttgctcagggtaagtgaacaaaccataattaaattctgttctacttccagagtctgaaccttaaatattttttgtaaatacaatgactcttccttcaaaatgtacatttgtcctatttataatagtaatgtagtgactcattatggaggaattagaagaaacattttggtatatttcctttcagtcttttaaatattatgttataaagttgaatttatgtattttcagtcgttctgcttttttcacatagtatcattttatatatatacacacatttttatatggtaaatatttcttgaaattaacattttaatggccacttgataatgcattatgtggatatattctaaattaatttttttctattgggcattaatgtcgtttctagttacagagaggaatattggtaagcagtttatctttgtgtataaatcagtgtcagtgtctctcttttcttagatttcctggaaggatatcatttaattaaagggtatacactttctaaggccacttgatgtgtcaaatgtgtatttgacaattgttgaattgtcaaacatgctcataatgtataaattaacaaggctcaatctgattgactctaatgtgtgactataatca

SEQ ID NO: 142898 - DNA, 368 bp, Homo sapiens
tgtgcctcagcctcctgagtagctgggactacaggcatgtactaccatgcctggctgatttttgttgttttagtagagatggggttttgtcatgttggccaggctggtctcaaactccaggcctcaagtgatctgcttgcctcaggctcccaaggtgctgggattacaggtgtgagccaccatgccaagatgatcattgtatgattaactaaaataatgaatgtacatgctcaataagtagtagttattacaattctttttcatggttttgttattgaaacagcaaggttccagtctaggtcctgctgctcacttcgtagaaagccaatcactgagacaacaagtattgccaatgaagaaggctttaa

SEQ ID NO: 142899 - DNA, 801 bp, Homo sapiens
ggaaaacaaaatatatgtagagtgccatcactgttctgttatcattatcactctggtctcacccggattactgcaaaagcttcccaaatggtgtaaaccaaaaataaaatttaaaggtgtcggccaggcgcagtggctcacacctgtaatcccagcactttgggaggctgaagcgggtggatcacctgaggtcaggagttcgagaccagccatggctaacatcatgaaaccccgtttctactaaaaatacaaaaaaattagccgggcgtggtggcacatgcctgtaatcccagctactcgggaggctgacgcaggagaatggcttgaacccaggaggcagaggttacagtgagccgagatcataccactgcacttcagtttgggcaacaagagcgaaactccgtctaaaaaaaaaaaaaaattcacaagtgtcccaaccacctaaatggactccctccttggccaaggtactcaaaagttaacctcaaagactggttcaggccttgacaggaagtggggttcagccatgcctcattatgccctccttccgtttggggtttgggaaaagtgaccagcatttaacatcaacacagaccttaagtcttgaagaaacatttacaatctattttctttgaagcctgctacctggaggcctcatctgcatgagaaaactttgatctccacaagctcttatcataacccagactatcctttctattgataataactctttcaaccagttgccaatcagaaacatttaaaatttacctataacctggaagcaccccctgcaccctccct

SEQ ID NO: 142900 - DNA, 233 bp, Homo sapiens
gccagggtcgactcacacaacactcttccctgacagcaccacaagctcaggcatcgttgaagcatctacacgcttccagtgggtggtggaacgagcatactaccaagggccagtgatttgtggaggattgattttgcacaactgcatctagaggccttgggaaacctccagccctctagccatcttgcccaaaatgtgcggacccacaaacgagaagcagccagacttttctg

SEQ ID NO: 142901 - DNA, 393 bp, Homo sapiens
ccaggcttgtgctccaggccagccttctctcctgacagtgctgatagctcacctccaatcagaccttgaatcatggtctctaatcttgcccctcgcactcattattcctggtgcagtgactcagttttttaatctgcaaaattaggcactggggcctgatgatgttaaaggctacccccaacccctttccttctttggaagtgaggaccctgtgttgacatgctccttgacaaattaactttttgtgactgtatttgtgaattctccagacagatggtaaaatctttgaggaaagaggtttttaatcttagagcaaaccttgaggcccccaaagcctgattagacacagtgggtaccgtgtgtctactgttaaagaaagctatgtgatgagag

SEQ ID NO: 142902 - DNA, 285 bp, Homo sapiens
agcgagtttatgttccaataattaattttcctcagaacacataacagtaataaaatattacaaaaaaagaaaccaaaaaacactggctgggcttatatacaacaaaaatatttgttaattatggacagaacaaaaatcaaaagcagaaaatgcagctgagctctgcctgtgggagcagacagtgatgactgtgagcttatcttttgccaggtaagtggggtgggcaaggggaaatgtggttggtataagaaaatattgagccagactatggtgccatctcacatt

SEQ ID NO: 142903 - DNA, 263 bp, Homo sapiens
gagtagtcctggtagtgagctctctgtcactagaagcattcaaggcagggtggatgatcagtaggcaggaaaggctcagatgatgttcatgacagggagctacataaccaaggtccttgaaccttggattctaagcaaaagaacaaaatccctacagctcttatcactatggttgctgttggcagagcaggaataacacctactgagtgtcgccacgtgctgggcacgttaatctcattatcacatggaatcttcctggtgac

SEQ ID NO: 142904 - DNA, 440 bp, Homo sapiens
ttgctgagcagtgggctttagagtaggtcagtcatctggaggatctgcagtggggagatgggcgagtcttcactggacccctgcctgcggtgctgcttgggagggcagggccccagtgaatgtctcagtgagtaaatgactgtccccaaagaagccataataacctacgaggagatgagatggaggtgaggataagcagagcctggaatttgtgcaaagctgaagggaagtccttcccctggctgccctggggttggcctgccagtaaggggatgccaattaatttctcttgcaggaagctagttcgtgtccaaaaggctcaagttatgaagtacgaattaatccatttaaccagcttctcggagggaaagcccatgacaactgcattttcaaatgccatcctgaaagcgatatttcaagtggcagtgggtgggattaga

SEQ ID NO: 142905 - DNA, 296 bp, Homo sapiens
ggtttgccctttgtgttttaattcacaacatctctctgtagccctcgttgaatatctgggtgacaatacatttctcaacacttagaaataagtcctccacagccattacaactataaagtacagctgctaatagcatgcgatccaagtttcccaggctctcagaaaacatcaaagttttccattgccagaaactttgggtggaaagaaaagtgaaaaggagccttctgatccaacgtgtgagctgaggaatggtgagtgggttagatttatgaactgttagccgtcgtccttggat

SEQ ID NO: 142906 - DNA, 549 bp, Homo sapiens
aaaggagaccaggtggttcgcagaatcgctgtgagcctgttgctcatgggaacccgtctggggtggggggcaccaggcggccactgagagctcagcccctgttcctccagagaggggatcttgttgcaattgccacctctccgtgcaacgaagcacctgccaccatctccgctgctttgtgtcaccagcgtctgatttgaagtctgattgcattgccgcggtctcaggcccacaacctagctaagagggaggctgggaagacaagtgttgcatttcagtttctgcagcagacagcaggtccctctgcccaccaaacaacccttacccagagtgggcacatgtcaagcttttattcaactcggtgttgagggaatcagcgtaacacagctgattcaaaggaggagatgagagactagtattggtttctcatctgtctgtctgtctgttgtcagtgaagataaagaatgccagaatcaaacagctctgttagatgcgaaagtggttcatgccctacagtaaatacaaccataacctttggagtcatcttct

SEQ ID NO: 142907 - DNA, 411 bp, Homo sapiens
agtcatatccagcacctaatccattctcatctggcaccaaccacatccaaccacactcacactttaacattttacatacgtagtgttctatcattggagcagtttggaaagatgtgcctggttgcaatttctttttaacagacacaactacataaatgctgggcttgaaaactattcttcaacaccctcgacagagctttgtcaagtttaaaggaactccttttattaatgttagtctttttcaggttcacagatctgtttttagcctactcttgttgcttttctagagccactgacctattctggctagattaagcattcatttagcttatctcctgagtccatttatacttttcaacccctttggttgtttagaataatagttctccaagtttgttttgaagaatgtcc

SEQ ID NO: 142908 - DNA, 1033 bp, Homo sapiens
gggtccccgcgccgcccaggcctaccccggctccttgggatagatggggaagctgaggcccagaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacggggaagagtgtatcacagccattgggaactttcttcacccatcaaagcctcagggctgaagcatcctgaacaagaactcaggagagtgaaagaaacagttacctgtcggctgcagctggtacagctccccaccccgtacagagaccgaagcgtctctctctccccatcacccagcaccagactctgccccgcgactcagcctgcacctgcttcctggctccatccagccttccagcctcactagatcatcatgggccactggccaacacacagggcagtgccgagccaggccgtggtcacacatggctgggttagtagctgaaaacattgtttttcactggcctcacagtaatggcacctgcccccattttctgtgattgaatttttggatcctgctaccaggttatgatagatttatggtatgtctcaagatattgagataccaggtaataaaacagctataagtcctggctcaagaagtgttacaaacccaagcagggtaaatacaagaaaactgcacccagacacaacatagtaaaattgctgaaaaccaaagattgaatagaacacttaacagtggagcgcaccaaaagccacattaccttccataaggacaccaaatcacacttagcatctgtacttcgaaaatacgacatttcaaaagcccaactcaccagggacttgtggatcttccaaatcttggacaagaatctaattgttcaggtgaaataattaactggcaacctaaattctatcctaggtggaatactctcca

SEQ ID NO: 142909 - DNA, 746 bp, Homo sapiens
gggtccccgcgccgcccaggcctaccccggctccttgggatagatggggaagctgaggcccagaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacgggaagacatcaacacaggagactcccaagactgctggggccaaatgtggcaggtggacgtctccccgccaccgagcaagccatcagttctgcagcggacaccagccgagtgtcctccaacaccatccggtactgcagatagcgtcagatccagacacctacacacacacacacacacacacacacacatatgcacacatatgagctgcgagggccagcctctggaacttcttagcgagtggcccgacgttgaggttcccagtgtgagaggaacgcttgctcaccaggactctggtttagtgaaacgtgaccagagtgactccatcttgacgtgagtaggaggcactcaccaaggcacctataaggcgaatgcttagtgggtctaaaaatagccgtgtcatcaagcttggacaccaattactacttcacagaatatcggtgcgcatatggcggcatctccgagcagagcccgcagacgtgtccagatag

SEQ ID NO: 142910 - DNA, 1785 bp, Homo sapiens
  misc_feature (961)..(961): n is a, c, g, or t
  misc_feature (989)..(989): n is a, c, g, or t
gggtccccgcgccgcccaggcctaccccggctccttgggatagatggggaagctgaggcccagaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacgggtctggggacccaagatcttattttcctttctgtcacccccgcttggttttggattccatgacagctggacccggcttctgcgtgatcttcagagggaaggcaccaggagtggactgcgggacacccagagtggactgcaggaggacacagaagctaggctgaagcgggaggaagctgggaaccctgcacggggccactgcgcactgggactcgttactggtccccaagactcagggagaatgggtgagttgaactggcaaggaggagcccactgtcattacgggcctctggaatcccggcaggaggagattaaccacatggacattcgaggtggcagagagagctgcctagagaaggtgcgggggcagcagccagctgaggcagagcccggagggtttggtgcaggagcgtctgtagtggagggccatcccccaggctcaaattcctcccataggagattttagccctagtggagctgttgtatgtgatctttgtggggtggtcttgcccatcagatggggccagtctgacccgagcatgccttggtctgctggcctctcccagggccccggcctggccacgcctgcttgcagggcagctctgggtgccctgggggcctgcagcatagcttctgcactggcagaccatgcctgattggtggagagctccagcagggcagcccccacatccctgtgccagcntgcccactgcctcccacactgtagcttntccagggcccactgtcaccccccatcttgcttttgccagtgcatgtctgtgcaggtgggttttgctttccttgcccgccagtgtacctgtgtgtttgcaccctgccctgccattgctgtggcaggagtaccgtttgcccaacgccccctgctgactgccattgcagttggagccttggcagacacagagccagccagccccacctcccttgcaccccactcttgcaccaacactgttgcgggagtgaaactaggcacggaatagggaccaccctgcctgtggggcacaaagaatgccacaggcctgggcctgccggtgctccacctccatcccaacaccaccgccagcatggctgttgccagcagggggccctgccccccaggtgctttcgtctgccactgtggtgaacacctgcacagaggcaggcaccccagcacttgctagcaccctgccacagccgatgaacgtgcaccctgtgctgctgccaccacggctgctggcatgtgcaagcaagaatggatcccgctgccactgcactgcaaaatgcactggctggcaccacctatcagagtgtagtgaccggtagtgaggagcaccttgatccctcagtgcagttgattcctaacctccgggagccagagaacaaagttggtgcctgatacaagtaccccagttagagcacacagtctgggagttgggaactgagccttggccccctaaaatcatccagaaacaaagccagtcagctgaatccaacttatactacaatcaaatcctcaaggtcatcaaataggat

SEQ ID NO: 142911 - DNA, 1193 bp, Homo sapiens
gggtccccgcgccgcccaggcctaccccggctccttgggatagatggggaagctgaggcccagaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacgggatcttcagagggaaggcaccaggagtggactgcgggacacccagagtggactgcaggaggacacagaagctaggctgaagcgggaggaagctgggaaccctgcacggggccactgcgcactgggactcgttactggtccccaagactcagggagaatggggaagagtgtatcacagccattgggaactttcttcacccatcaaagcctcagggctgaagcatcctgaacaagaactcaggagagtgaaagaaacagttacctgtcggctgcagctggtacagctccccaccccgtacagagaccgaagcgtctctctctccccatcacccagcaccagactctgccccgcgactcagcctgcacctgcttcctggctccatccagccttccagcctcactagatcatcatgggccactggccaacacacagggcagtgccgagccaggccgtggtcacacatggctgggttagtagctgaaaacattgtttttcactggcctcacagtaatggcacctgcccccattttctgtgattgaatttttggatcctgctaccaggttatgatagatttatggtatgtctcaagatattgagataccaggtaataaaacagctataagtcctggctcaagaagtgttacaaacccaagcagggtaaatacaagaaaactgcacccagacacaacatagtaaaattgctgaaaaccaaagattgaatagaacacttaacagtggagcgcaccaaaagccacattaccttccataaggacaccaaatcacacttagcatctgtacttcgaaaatacgacatttcaaaagcccaactcaccagggacttgtggatcttccaaatcttggacaagaatctaattgttcaggtgaaataattaactggcaacctaaattctatcctaggtggaatactctcca

SEQ ID NO: 142912 - DNA, 409 bp, Homo sapiens
gagatatgtggtattgttctattcattgtgctagttattgcctgaataccttagtttttcatttccattgtgttgttttataggccctgtgagatttatgatttaaggagtttctactttggtgtattttgaggttttgtttcaagatttagaactccctttaactgctcttgtagtgctgccttggtagtggtgaattctctcagcatttctctgaaaatgactttatctttgcttcatttatgaagcttagtttcaatggatacaaaattcttggctgataattattttaaggagtctaaaggtaggactccaattccttctagcttgtagggtttctgctaagaaatctgctattgatctgataggttttcctttataggttacctgatgcttttgcctcatagct

SEQ ID NO: 142913 - DNA, 232 bp, Homo sapiens
gttttctttgggcccagtgcagcttcttgccaaccagttcagggtgtattgaaggcattgtgccagggctggggaatagaatgattggtgaacaaaaatcagtccttgccaccacggagcccacacccaactgggggcacagacaaacggggaagtgtaaaagagaagttgatgagggtcatggggcaggagagggacaatcagcatgtattgagcacctactgtgtaccag

SEQ ID NO: 142914 - DNA, 789 bp, Homo sapiens
agaggaactagcagtgcacaggaccctaggactccctggattatatgccctttgtcttccactaccacagtgcgtagggaaggaccatcaggtgggggcagggctaggcatgtctgagctcagactctccttgggtgggtcttgctgcagagtatttggggtgtctcctaggtcctgcagtagcagtccacttccttcaaagggtctgtggctcctcttgggattgctggtttgttcttgaagtcgatccagagctaaagttcacatgcaagcctctgcacactgctctgttagtccgagtcagagctgcaatctagtcctgcctctcgtctgccatgatcccacctcttgggattggcttctttttttttttctttttttgacagagtctcactgtcacctaggctggagtgcagtggcatgatttcggctcactgcaactttcatctcctgggttcaagccctggtgttttcttgccactatttatatgatcatgtggttcttcctgtttcgttaacctgataaatagcattgattgattaattgtcagatcttaaatcaggcttgtattactggtgtaaacagtttataaagtataattattttttatgttcttagattcagtgtatttagtatgttatttagtgttcttttttgttgttgtttgctttttcacccaagctggagtgcagtggcgtgatctcagcttccggttgcaagtgtttctcctgcctcagcctcccaagtagctgggattacaggtgcccgtgaccacgcctagctaaatt

SEQ ID NO: 142915 - DNA, 295 bp, Homo sapiens
gggaacatcacacaccagggtctgtcatggggtcgggggaggggaagggatagcattaggagatatacctaatgtaaatgacgagttaatgggtgcagcacgccaacatggtgcatgtatacatatgtaacaaacctgcacattgtgcacatgtcccctagaacttaaagtatgataaagacaaaaatagatctagaataggcaaatccacagaagcatattcatggttgcaaggggctgtgggaaggaggaatagggagtgactgcgtaatgagtatggggtttctttttggaa

SEQ ID NO: 142916 - DNA, 724 bp, Homo sapiens
cgattgtagttttactctatgaaaatattttgtaagttacctctgagacttgtttcttttcctccactcagtgggagagagcaaacagtagttgtaatgatagtgtccttcctttttctgtttcttctcctaaaattcaagacacagcatacctttgtaggcctgaattggtaagaaggcaaggcaggggaggtgtgagcagtagaaataaccagggagaatgtttttgatgttctctatgtattcatttactccttttttcatgcattttacagatacttactgagtacctatttactgaacaccttatagatacttactgagtacctatttactgaacacctctgtgacagctctgagctgattactgtaaatataggaattctcctagcagatacagtcactgccgtcatagagcttttaaactagtaaagaagataaatattaggcattgtaagtttgataattattacaaaggaaatgtacagtacattttaaagacatgttactagatccatgaaaaaaatgacagattcaggacctagcaataaatcagcacaatttttcaagcaggcaatagaaataatgtgcttgccccctgaagccctaacaatgattagcatctgccacctgagcaaggtgcctgatgccaacatgaagtcctatgtgtcagggtggctccagctacaataaagaaaccctcctactcagctggctcaaataa

SEQ ID NO: 142917 - DNA, 382 bp, Homo sapiens
gcctcactttgttgcccagggtggtttcaaactcctaggctcaagcgatccttctgccttggcatcccaaagtgttaatttttttatggtgttacttatatagttttaatgtttgaaaacaagtgaataaggaattgtgtttgaggatagatgtttcttaatcgctctattgttaatgaaacttctcactgagaatatctgaatggttgacacccctaataacaagttttatccagaaagcatgtgtaaggttatctgcattttcattaaaaaaaattttgtttttgagatagggtttactctgttgcctgggctgtagtgcagtggcacgatcatggctcactgcagcctcaatttccggggctcagatgatcctcccacc

SEQ ID NO: 142918 - DNA, 339 bp, Homo sapiens
caccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgaggg

SEQ ID NO: 142919 - DNA, 157 bp, Homo sapiens
gtggattttcttaaagtcttgtcaggatgggaataacttttcatgattgcatttgtttgttgtccatcagaccacagatacgacattttgacgcatttgggaatcaattttaacatacagtgctatttccaccttctcacaaccaaataacatctca

SEQ ID NO: 142920 - DNA, 384 bp, Homo sapiens
ggtcaaagctgacataaacagctaaagaaattaacaacagagtctcagaagacaaggccaggggagccaaaaggacacaggtgctacacacccaggcagttgttgtctgctcccagagcacctgacttcagcagccacagcacctgctcctcaagcgcagcggcgcctttgagggagcacagcctggaaggtttacccttcgcagagacgcttgctcttggacttctggctgtacattctgagggttcaaatgaaggatgggacaatgggaaagcttaaatcctctggaaacgtcactgtgatcaatggcttcaaccctcctctacctcataccagttcactggagctgctaacactaagtttccttctttatccgcccatctc

SEQ ID NO: 142921 - DNA, 370 bp, Homo sapiens
gcactcttgctaggaagtgaatgaaagaaattcatttagttttaaagcattagattgagcacatatgcttcaaatgccataaatctttacaggtaaggattaaacactactccactctaggccagacgcagtggctcatgcctgtaatcccagcactttgggaggccgaggaaggcgaatcacttgagatcaggagtttgagaccaacctggccaacatgatgaaaccccatctctactaaaaatacaaaaattagccgggtgtggtgacacatatctgtaattgcagctactcaggaggctgaggaaggagaatcacctgaacctgggaggcggaggttttagtgagccgagattgagccaccgcactc

SEQ ID NO: 142922 - DNA, 435 bp, Homo sapiens
aatgactaccccaatattttatctgcttatgcaaaacctttgagtcctagctcaagtcccactgttgctggaagcctgccagagtttgcccagcccacgatgattgaaagcagccttctgtcatcaacatcacaggtcttagaagagtcctaatagaagtcagctcagtctaggtgatccttggccagcttgtgagctccccgagcttatgctctagaattctcccttgggttcactactcggatggatgtatcctaggtacacagtaaatgtttactgatgctaattgatgattaaaatgcagcatgcttggccgggcgcggtggttcacgcctgtaatcctagcactttgggaggccgaggcgggtggatcacctgaggtcaggagttcgagaccaccctggccaacatggtgaaaccccatctccactaaag

SEQ ID NO: 142923 - DNA, 400 bp, Homo sapiens
gtttccaccttcttgagagccatcttttttagagaagtgcagagttcactatccaggtcctttggctgcatcctggccgggggtgggggcaacatacagatcatttccctcaagtaaaacattgaggcacactggttagtgcttggttcatgcctgtgttttttctttttctggagtcttgccttaatatatatgtatatattttttttgctaatagactgtcctttcctccctccctccctttagaagagatggtaggtttcattttgcctcttgtctccaggtttcaggaaaatgaaaatgatttataagagaggtgacaaatctgcatagagtttttgtttgtttgtttgtttgtttgtttttagtttcagctaaggccccagataaaaatgtaagg

SEQ ID NO: 142924 - DNA, 248 bp, Homo sapiens
agtgtattatcatgttttaaaaacatgttagtgcaaactacaaactcatttattcatctaaatgttttgagcacttactttattgaggctgacactaggttcagactgggaacaggaagatggataagctcatctcttcccatgtgagacagatgcataaacaagtacaatgttgtgtgctaaattgtcacggtgtttaaagtgctatacagatagctactctcacttgattagtttttcattcattt

SEQ ID NO: 142925 - DNA, 867 bp, Homo sapiens
tgcactcactccttcccgccgccttatgaagaagatgcctgctcctctttgccttctaccgtgtttataagtttcctgaggcctctccagccatgcagaactgccccagtgctaatatccagaatctacaatgaattcaaacaagaatttacagagaaaaaaacaagagaactcccatcaagagaagtgggcaagggatatgaacagacacttctcaagaagaagacatttatgcagccaacagacacatgaagaaatgctcatcatcactggccatcagagaaatgcaaatcaaaaccacaatgagatatcatctaacaccagttagaatggccatcattaaaaagtcaggaaacaacaggtgctggagaggatgtggagaaataggaacatttttacactgttggtgggactgtaaactagttcaaccattgtggaagacagtgtggcgattcctcaaggatctagaactagaaataccatttgacccagcatcccattactgggtatatacccaaaggattacaaatcatgctgtataaagacacatgcacacgtatgttatggtggcactgttcacaatagcaaagacttgaacccaatccaaaatggtccacaatgatagactggttacgaaaatgtggccatattcaccatggatattatgggactaaaaatgagaggtctgtctgtggggctgggtcacgtggaccattctttcgccaccttgcgggcgcaaaccacacccagttcccctgtggactggccggactggccgaggcgctctttacaaacagggcgttaagcgggggctccccagctggagacaacgcgttcggcaacccgctccgcgcgggggaatacacc

SEQ ID NO: 142926 - DNA, 347 bp, Homo sapiens
tgagcagggcttgcctcggaggaaagcgggaggggcaggagacatactggtatgccagtagtagattcggaatgtctcttctgatcaagtactgtattggtgacataggtggtgcatactaattcccaattgaccaagggacagaagccaccagagcagtgagctcagagccctgctctctttgatgccatttctttcaggctggctgggttctgactggtcaggataagttggtctatctggtatctcagcaactagtcacctctagtatttaaccttgtcatttgatgcactttcttggtcatcgtgcttatcccaattaggatttaattagagccccataatag

SEQ ID NO: 142927 - DNA, 211 bp, Homo sapiens
ttattggcatttatactcggatgtctccaggcaccccaaacgcactggaaacggaacatgatgttacccaccccacaaggtagaccctcttctagtgtctcccctcaaacaacaggccaccaaattgttcaagccaaaaatctccctcactccccaaatccgatcctttaatctctctctcttttttttttttttttttttgagacagagt

SEQ ID NO: 142928 - DNA, 288 bp, Homo sapiens
tggggttgctaagaaagtatttaagtaagtgaagtaataaggatggggctctgatttaataagattagtgtccttataagaaaatacaccagagagcttgtcttgtccctctacatgtcctcatcttcacacaatgaactcacttaggaaaggccatgtgaggacacagcaagccagaagagaagagagccctcaccagaaactcaattgactgtagccttggttatagacgtctagcttccaaactatgaaaaaatacacttctgttgtttaagccacccagtctgt

SEQ ID NO: 142929 - DNA, 389 bp, Homo sapiens
tttgtgtgttgctgtgagacagaaaatacaagggcacatcttagtacagagattgcagtaacagttgaataaacatgcaatccgatacctcacatctggcatgtcatcatccccaatattttactgacaatcaaatatgtttaaggctgtggctactttataggtacaaatgtccttatcaggacattatcatgcaccaaacctctctcaataaaagctgtcataaacaacaatctcttccctgggtctgcctctgtgctctgtgacttgcccgatattttgatgaggcgggctttggcaactgtctcttagatgaatggttctattacaaacacagtagcttccatgaccgcttagaagagattgttgtttatggcagcttttattga

SEQ ID NO: 142930 - DNA, 233 bp, Homo sapiens
tggtgcagtgcttgcttcctcacagatactcaaatgctggttttctttcttccttcacactccctcacagagttcactgtcaagtaagggagacaggcataattaaatatgtatgcaagaaaaggaaggggactttagagataatgggacttcatttgtggaggaagagagacacgagaaagcaaatagccttgaggaagaatggatagaaacaagttcacactacaatattt

SEQ ID NO: 142931 - DNA, 330 bp, Homo sapiens
ataacatctatctagtaagtttgttgtaatgattaaaagagatcacctctgtaaagtatctggcacctgaatgttagcccccttaaaatgcaggcccggtagaacacatcactatcaaaagaaattatcctccccaatttcaagacatcctgatgctggagcggcattagacactactgcagtagttggaacagaaagaaactgcaatggaaaaaatatgtgcctatcccatcacagttaaaaatgaaatcactcagctgggtacagtagctcacgcctgtaatcccagcactttgggaggccgaggtgggtggatcacctgaggtcagg

SEQ ID NO: 142932 - DNA, 345 bp, Homo sapiens
aaccaatcgtccacttgtgcagtgagcggcagagaaagaaacaacggcacagtgcaaggccccagtctcactgggcagcggctctgcctacaatgaaatatgacttctgagcttggactcttttaaaggccctggggtctacatctggctgactccaggcagctagtgacacgctaaggatataactaaattccacccaaagtgactgatcccatgcctgttatgtgcaaagcactgtgacaactggggtttaagagaaatgggcaaacccccagtccttattcttggaaagcacagagtggtggggttgcggggggtgcgaggctatgaacatacactcctgga

SEQ ID NO: 142933 - DNA, 111 bp, Homo sapiens
tgcaggtttcttcaacatctccctctctgcttcccatcaaacttcaacactgcttgcatttcagtaacacagtcttcaagaatcagcctaattatctccagccacagcaaa

SEQ ID NO: 142934 - DNA, 307 bp, Homo sapiens
ggaccatgggtctaacccaagcacaatggaaggagcctttgttgagcagaaaattgacatgttctgatatatgtttcgaaaatttaacttattactgttgtatggcagatgtgttggagagaagcaaaaatggttgttaggaagcttttacagatgtcttggcaaaagatggttgcttttgtggtaggtaggtggtgcctgtggtgattgagagaagtaggtaactctgggatattgtttgaatataaaactgatagaatttggtgatggattggatataggagagaaagaggaaaaagttaaagat

SEQ ID NO: 142935 - DNA, 300 bp, Homo sapiens
gctgtaacaagaaaatatgagagatccctgtaagaacccaaaattagatttcccccttggaactaaagctaaaagaataccatcaatacattgaaaatttataatctgtggttttattcccttttgtttataaataaagctcattttttgtgtgcaataaatcaaattccttcactttcccaatctgatataggtcaggaggatccttttaaatggaagtcagtggagggaggatgttccttggcatggtcttcctccatgtgccgtgtggctatggcttctcttccaggcaactggacg

SEQ ID NO: 142936 - DNA, 225 bp, Homo sapiens
aatagaagataagagaatccaaacatggtgtttagaaaaaattgctacctgtgcagcatgcgacggagaggcaaatagaaaaacattccattctctgcctctcggtcatgtatactctatctttcttcaagattacatggccaaatgaaaaagtgagactttgttgtgaccccccgaaaatgttctacctttccctttgtttctaaagattaaatgttcaaaaac

SEQ ID NO: 142937 - DNA, 145 bp, Homo sapiens
tacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaata

SEQ ID NO: 142938 - DNA, 792 bp, Homo sapiens
ggaccagcatcacagtatgtaatacgtttttgaataatctttctgatggggcaaatatcccaaattattactttgttgctcacgtagtaaaagatcatgctaaaccaaacttgcattagagaccattggtgatagagggcgctattttttcccaaagagaaattacttaatgtctattgccgctttaaaaaatgggctactggggaggctgaggcaggagaatggcgtgaacccgggaggcggagcttgcagtgagcccagatcgcgccactgcactccagcctgggtgacagcgagactccgtctcaaaaaaaaaaaaaaaaaaaaaaaaaaaaaaaaaaaaaaaaaaaaaaaaaaaaaaaaaaaaaggggggggggggaaaaaaaaaccccggggggggccatggcccacaaccccagtttttgttggacaaaaggggggccacccaaagaagaagagggcgctatataatataaagacaggagaggaggaggaggcggcgagtgttaaaaaccagcgcgtggtcgggaggcggggagacacaccgcggcgacacggcgggacccgtatgggagaagaagaaccccactttcgttggggcgcgggaggcgaccaatatggggggcacaccacccaccaagaggagaattaaccgcggcaggaggaaaactataaacactaccacgcggaaacgggcggtcaacaccacgcggaagttatgcctggccgagaagaaaattcggccaacagagagacgtttacaacaatatacagagagtgtagaaaaaaag

SEQ ID NO: 142939 - DNA, 434 bp, Homo sapiens
tggttaggctgatcatttatgatggtagacagttgtattagttatctattgctccataacaaattaccacaaacctagaggcttaaaacaatatacatttatcattttccagtttccctgggtgaggagtccaggcatgactcaaatgggtcctctgctgagggtcacacaagactgcgatcaaggtgtcagccaggctgcctgcctttcttgagtttgaggctcttttctaagctcagatggttgttgccagaattcatttttttgtggctgtaggactgtggttcctcttttcttctgaatgtcacccaagggcttctctgagttcccttcctagaggccacctgcagttccttgccatggggccctctcacaacatggcagcttcttcaaagccagcaggagaatcttttgctccaatctgcaaagatgga

SEQ ID NO: 142940 - DNA, 222 bp, Homo sapiens
tgtgtgtgtacccgtgctcatctgtgtgtgtgcatgtgggtgtgtgtgtgtgtacccgtgctcatgtgtgtgtacctgcatgtgtgtgcatgtgggtgtctgtatgtgtgtacccgtgctcatgtgtgtgtgcatgtgggtgtgtgtgtacctgtgctcatctgtgtgtgtacctgcatgtgtgtgcatgtgtgtgtgcctgcatgtgtgtgcgtgtgtacc

SEQ ID NO: 142941 - DNA, 336 bp, Homo sapiens
cagccccctgtgcagccatcacacatcaggaaaatacacacatgacacccctatgcaaccatcacaccaggcaaaagcacagacataaaatgctaagtcaataggaatgaacagctcataaaagcctactggaatagatcacatcacagccaggtacatctgttctcagcactaaccattatcattagcttaaaatgcttgaaatcactgtgcatcctcaggtctagggacagattattccaagaagattctgctaaatagatttggcaatgcagtgaaggggacctctactacattaaagtgatacattttgcatctcaaaggctgtcaactgta

SEQ ID NO: 142942 - DNA, 375 bp, Homo sapiens
aatttaaggtttgaaggcataattcaatttggatctcagattacttgcatcatcatcatcattgaattgtgaaattttgacatttattgacatttattcatatctacctcaaaggactttcagaagtttacagattagcttaattttggataaatgggacaatgctatatattgattctgttgacgaaccacagcatttcttctttaaagcagttctcctgactgacatacgtatcactccatccatccatcgttcatcatccatccaccatcagtttatttggaaattaagtgaggctatgtatggtgttttgggtgataataataaagaatttaggaggccccttctagattttatttatttatttagagaca

SEQ ID NO: 142943 - DNA, 492 bp, Homo sapiens
ttctaccatttttgccactagagaggaaaattcaggataatgatctttatttaataagtgtcaaaagtaaaacaaaaactattaatagatgtggtggtacctgagacgcatgttcaaaaggacatgcggcaatataccttgcaggactgggctgcttcttagaattttaaaaggcagtcttctgcagtagcacactgctgtttcaattcacagccacaggtgatctgcaatcaagatcagttattgacatatggctattaaggctttgaagtaaatctgcattttacttcaagtaaaaataataataactctagtgaggccacttagaattaatcaagagtgtccaattcattttacatattgttcacattaaaaagacaaagcttgctcgggcgcggtggctcacgcctgtaatcccagcactttgggaggccaaggcgggcggatcatgaggtcaggagatcgagaccattctggttaacaatggtgaaa

SEQ ID NO: 142944 - DNA, 500 bp, Homo sapiens
ttaactgatgacattatctggtgaaatgccttctcctggctcatccaggctctagagctcccctactgagcacctgtgacccccactcctgcctgccagagaacaaccccctttgactgtaattttcctttacctacccacatcttataaaacggccccacccctatctcccttcgctgactctcttttcggactcagcccgcctgcacccaggtgaaataagcagccttgttgctcacacacagcctgtttggtggtctcttcacacggatatgagtgaaagttcccagctcgtggaggggagaagagcagttctgtgggtttggccttagacgacaaaggctagggttcactgccccgtgcagacacagtccacaggcactgtcactctgacagcctgatatcactagggcctgagagactgggcaagacagagggctgtcaacatatgttgaccacgtcactgtctgcacttaacagagcagattatcaagatcgta

SEQ ID NO: 142945 - DNA, 330 bp, Homo sapiens
attgtggtgttggtgaaaatgaccaaagaatcagtcagctgactttctccctaagcgctgataaggaatcttttgggagtaagatttgggggtggtaggttttaaataggagaggacagaagggagccagacttgggtccaggagacatagtctggggttcttgacaaatgtaagcagagtgaaaacctgggtagagtagaggagtgggtgagagaagcggggaggcgcctcaagagaacaatcagacagcgaggtgagggaatggaagaaacacagtgaaaacctgggtagagtagaggagtgggtgagagaagcggggaggcgcctca

SEQ ID NO: 142946 - DNA, 389 bp, Homo sapiens
aacgttcatcacaaaactggccgccccaaagggacaccatacagccaatgaaaaacaagagtctccaactggccatgatgaaagaccccagaggcgttaagtgagcaccacagagagcaaaacagcaggagcaaaaagctctgtttccataagatgcaaggaacaggtcacgtatggagggagcaagctctgttttccatcaagtacaaagaacaggtcgtgtatgggcctacccaatttaaggggaaggacacagacgaaacataatagtgaaaccttctgatttctaaaaatggaagtacatctccctggctgggtctcccgcgcaggcccgacccacccctcactgaggtcaagagaggagacctggagcccacctaccctccggc

SEQ ID NO: 142947 - DNA, 474 bp, Homo sapiens
actgcacccctacttcattctacctaaataaatccattcttagtggactatagacctaaatgtgaaagcaacaccttcagataaaatccaggaggactgtcttcatgcccacaggtcagagaagactttggtaatacacaaaaagcacaactacagaggaaacaatacattcaatgacataaaactaagtttattttcattaaaagctatgaactgggaaaagacattcgcagcactcctgacaaaggctaagtgatcaccatcctgtgctgagggcttgtttttgccaactgcaccacacgcatatccacccactaccttcccctccttcatcctaattcaaaacctagcagtaaaatcagaactgcacccagttaaagagttgtgctaaggaaggtcatttgtgtgcccgtcaatgataagactgcataaggaaaatgtggcacatatacaccacggaatactatgcagcca

SEQ ID NO: 142948 - DNA, 136 bp, Homo sapiens
ttgaaggtttgggcatgtcaaggctgagatgctgatgaggcatctagggatgtcaggaggcaggtggataattatgactgctgctcaggaatgaggcctgcttgaaaatacagatttttgcatcatcagcctacac

SEQ ID NO: 142949 - DNA, 488 bp, Homo sapiens
ccctctagtgtccttgtttgaggaactgggtaggtgatggtaccatttactggcatggggaagaccgaaagagaaagaattcaggagtttcaaatgggatgactatttgagatgcctgtgaagtattcaaggggaggtgttcatatagcattgccatctgactctttctctgggttcatttcctaactgtctaactttgggtaagttacttaacctctgtgtaccttagtttcctcatctgcaaagtgaagacgataacacctatttcatggggtcactgtgaagagtggatggtttgtgacatgtcaagagcttagcgtggtgcctggtacatggtaactcctgtaaaggtattagttgctggtatattatcatccttttcatctttatcattgtcattatcctcatgatcactggcgtcattatcacgcgtatatagaagacaggttgagctagagatacaagttgggagttcaaaagatcgtatt

SEQ ID NO: 142950 - DNA, 790 bp, Homo sapiens
ggtccccttccacactgtggaagctttgttctttcgctctttgcgataaatcttgctactgctcactctttgggtccacactgcttttatgagccgtaacactcaccacgaaggtctgcagcttcactcctgaagccagcgagaccacaagcccaccaggaggaatgaacaactccagacgtgctgccttaagagctgtaacactcactgggaaggtctgcagcttcactcctgaacccagcgagaccacgagcccaccgggaggaatgaacaactccagacgctgtcttaagagctgtaacactcactgcgaaggtctgcagcttcactcctgagccagcgagaccacgagcccaccggaaggaagaaactccaaacacaaccgaacatcagaaggaacaaactccagacgcgccaccttaagagctgtaacactcaccgcaagggtctgcggcttcattcttgaagtcagtgagaccaagaacccaccaattctggacacactactagtagttaaacagagctatggtttgaatgtttggatcccgtcccaaatttacgttaaagcttaattcccaaagaaatagtattaagaggtggtacctttaggaaatgattcagtcaggagatttcctcctttgtgaatgggattcaggacatcataaaagtggcattatacagtggtaggtccgttttggctttctgtcccttcaccaggaaaggacacttggagaaagcctgtctatgaggaatgggcctgaccgtgaatgccggtaccttgatattggac

SEQ ID NO: 142951 - DNA, 221 bp, Homo sapiens
tatttttgggataattttaactatacacaactttcactttatttttatcttaagaattgcacctctttataaaattctttttgagaaagagtctcactctgttacccaggctggagtgcagtggtgtgatctcagctcactgcagcctccgcctcccaggttcaagcgattctcctgcctcagcctcccaagtagctgggactacaagtgcgcgccaccat

SEQ ID NO: 142952 - DNA, 489 bp, Homo sapiens
ttcacccaccgcaggagacactagctccctcactccagccttcacccctggagcagaagcccccaggagtttactgggggcaaagaacagccaatgacctttcacaagctcagattatctatgctgcaacaaacatttggaagtggcaattcccagcaaattgcaggcaatttagagtcatttgccaagatgcaatctgccctattgctccagggtctttacaaaggccagccagactgcagcccttgcagaccgcagggtggcaagtctcacgccagcctcagagcctcctcagcagaagtctgaatacatcacttacccagaaccaggttgccggcttacagtcatggtccctgaatcctgcataaaactcacctgaaggagaccagctcttagtgttgaagctacaagacgaaaataacaacttctgaaagccacgtcttattaaaaattaaaacactggacacttatcaatctagttaaggtaaa

SEQ ID NO: 142953 - DNA, 606 bp, Homo sapiens
ctagccccacaggcaatgcaaccccccttggctggtgcctctgcagccaccctgctcactacagcacagcccccctctgtcaccctctgtgggtgtgcaaagcctcaggaaggcgacacccacacccgcataggtgcaggtgtgggaggcctagcgctgccgtcttctgtcccacctatggcctgcagttgctccccagcagctgtccccgcgggcttgtctccgcctatcatcacccactgtggacctgtgccttcagaaccccattcgggttattttaatcttcactgtcaattcttcagaggccccagcagcttttaggataaaagcccgaggctgcatgcagaccctgtaccactttctcgttcttaccctgtcagtgtccttggtgacgcctcagacccagtctcaagcttggcgcccacatgaagcccgggctgctgggctgggccattctctcacaccctggttggcttctgtggtggcctggacagtcacaggagggcatcagggccagctcccatgtgacacacatgctctatctgctgagaagaggcgggctctggtctcagagtcacagcatcatgaacgtggagcacggggcat

SEQ ID NO: 142954 - DNA, 478 bp, Homo sapiens
ccattcatagtataaattgtggtgtcctcatttaatgaaataccaccagcaattacgatgaataaaactatacaatgtgaacaaatttacaaacattattttgagcacagaaattcagcaagaaagaatatatactgtgtgatgatatataaatgatcccacttacgtaaggtcaaaaacaagcaaaactggccaggcacagtggctcacgcctgtaatcccaacactttgggaaacaggtgggcagatcacttgacatcaggagttcaagaccagcctggccaacatggtaaaatctcttctctactaaaaatacaaaaattagccaggcatggtggcacacgcctgtagtcacagctacttgggaggctgaggcaggagaactgcttgaacccgggaggcagagtttgcagtgagctgatatcacaccactgcattccagcctgggcaacagagggagactccatctcaaaaaaaa

SEQ ID NO: 142955 - DNA, 309 bp, Homo sapiens
tcatggctgtggcttactaaagacagaacatgctagcctatgtccacttcctcgctatcaaaaaaccttgcaaactttttggttccccctttgtaagttccaatccaggtgttatttcctatttatccccctgctttttataagcactgattgttctccgatgctggctttttatggacttaatagtctggaacatgcaatccaacagtctcaatataaccctggacctcaacttagaaaatcagttcttttccaaatagacatcctacataggataattttttaaaaacatgaacagccatttaggta

SEQ ID NO: 142956 - DNA, 444 bp, Homo sapiens
ccagtgacaaagatgacattacaaaacaacagtgattccgagtctcaaggcctacaatgcagccttatcttacacactgtcataagcaatgtaggtttcattcaacagccttgggaggtgtgttctttttactgcatttccacaaactgggagaggaaagggctgcggtgacctctgcccctcccagcaaaacctaaaaataatttcaaggctggttacttctccccatctaaactgctagcagcgtagttcaggccatcacaatttctagtgatttccaccaagaagagttttccaagtccttctctgcagagcttcccaacatggtaggactaaaacccaggctcttccccatggctgctgcctgcctcggcccctctccacaccctccctgccccctgctcccagtgctctggccatgatgaccggggcaggcctcagctc

SEQ ID NO: 142957 - DNA, 103 bp, Homo sapiens
ggtctgaaggatctggcttctaggggcagaggcatggaggatgatagtagagaacatatctaccaagggacccagtaactcactgaacctaaactatggctgc

SEQ ID NO: 142958 - DNA, 426 bp, Homo sapiens
tcgcccggtgaaggagcatgggcgggagtctggctgcctggctgcctccgcagcctcctctctgccctttgccctggtctgccattgtccctgggtgtcctctgtcctctgtcctagcctcctgaaggagagtcaggcacattcgtagctcagcttatcagaggggccttctccatgacctcggagtctgagtcaccaccacatcccctgagaggccacatgaatggccagagagatttgggggcccggcctcagggcccctgctcctttcaccaccacgggggctccagggaggaggcgcctctcagacccgagctggctgatgacaccatcagtgccatctccaggctgctggaggccatttatagcaactgcccttctgagtgaggagcaaatgagtattttaaacacaccaggaagccatgc

SEQ ID NO: 142959 - DNA, 433 bp, Homo sapiens
caacgctcctgaaacatgtgattaaccacatgcccaaaataacaaaccaaagcaaacaacagaaactcctttgttacttagttccttcaaatcgtttacttaaggttgtgattccttcatgcaccaaacatttcatgtgtgctaggcatgagagacacagaggtttcatcttaaacaactatttaaatgctcatgccctttaatttttcctgagtaaatactatgttaaaaagctacattgaagaacaagttgtttatatacaggaggcagttccgggtagacctactgagaatgaaggaggtggcacaggaaaagtcagctaccacaaacttctgacttttcccagccaatcagaaagaatgcttccctggtaacactgggagtggtgaagaaagtacacacaaaaaggctgggtgcagtggctcacacctg

SEQ ID NO: 142960 - DNA, 490 bp, Homo sapiens
ggcagatcctcttaaaaagcttttcaagaaaccaggtattaaaaaaatccctaaatcaagggaagaactatcaatacaaatttttctttaaaggaatttaaaaaacgcacaagagctttctgtgagattacatctcagttttatccctaagagacataattcctctacagaggctgcctactgagaactgttgatcaaccagaggccaaatgtgagtttacttctgaccatgccactcactggaatctgatttttttattttcatgtctataaagtgaggatggggacactatcctgtctaactcatggggttgtgtgagaattaaatgaattttcacagctaacctatgacagtaccttacactcaaccctcaataaatcagaagagttttcccccaatgattctgtgtgtcagaaagtgtgaagggtgaatcagagttaattatagaggccctgtgatcctaatccacagtctccctattcttttgtc

SEQ ID NO: 142961 - DNA, 283 bp, Homo sapiens
attcagtttaaatgactatgatgtctattttctttctactgggtgacattttcttcctgcttattaaaatacaaaagatctgtaatcccagcactttgggaggctgaggcgggcggatcatgaggtcaggagtttgagaccagcctgaccaacatggtgaaaccccgtctctactaaaaaatacaaaaattagctgggtttggtggtgggtgcctgtaatccccagctactcaggaggctgaggcaggagaatcgcttgaacccaggaggcagaggttgcagt

SEQ ID NO: 142962 - DNA, 311 bp, Homo sapiens
ctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttc

SEQ ID NO: 142963 - DNA, 820 bp, Homo sapiens
attaccggatgcataacctctggttttatttacttggtgcagctttcatagaaggcatggaaaggagagaaatacagagagggagctgccaaaagttagattcaggcagcaacagaaaaaagattagaatccacattgtcagggaattcatccaccccttggtctcccggcaaagtggctgaaggaatagattcccccagacaacttatttctggttgatttccttggggagaactagacctcttttcccaactgtggctctcaggactgtgtgcatatagttgtttgtgtctgctctgcttacacttgacacctgggctcaggaatgctcctgatggcttcctctgcagagtgaggactgacagctccttcatcacggttctcctcagtgccttgcacaggacttggcacaaggtcaggaaatattttactgagtggatgaatgaaagaagctcaaagtaaaactgttccatcaggccagatgacgttaattctccaccagcttttatacagggtgaccatgttcctggttcatctccttgtaattattaatagcaccccttttgctctaaaggtgacctgatttgaaggataaattacagtcgtcctacatttcaggtactattgacagattggtgaacatatttgcagtagctaaaagaacgtgcaactcagtttgggcaaaatgcatggcctatttctagggctcataagaacttcagttgtcccagaagaacagattgagagggatctacaatgttgtttagcataagtttgatcctgttcacctattaactatgacttgctacgttagtagcaa

SEQ ID NO: 142964 - DNA, 463 bp, Homo sapiens
aacaaatataatgaattgcaaggttctgcagatttacggctaattactcttttctacttcttcatctatatttatcataatgtgatccaagatcaagttgcatcaaaatcaccaggatccttacataaaatactcattctccaacataagcccagaactatttaaccaacacctttatggtggactcaggtataaggcattaaaaattttccaaaaagggacaatgaggcatgctgaagtgtgaagaatgcacctagctttatggaaattggtgtttaacgtctaggtggtgtatttattttaacaatgtacacttaatgatgggacacacatagatagttaaaagcaaataaatagtacccaatgggtagttttttgcctttgcaccttccctccttcccatcacacaatatacccatgtaacaaacctgcacatgtacccactgaatctaaacaaaagtta

SEQ ID NO: 142965 - DNA, 331 bp, Homo sapiens
tggaaggggctagattgctccaggttcataactctgattgcaaccaccctctttctcagcctttctggaatgtggctgtttatgctccatgtacccctgggaacttcctgattgcccaacaaagattcaataccccaggctttggagtcattagactggagtttgaatcccaggttcctgactcaagtgggcatgttatgtaacctgtctgagactcagtttcctcatctgaaaatgtggccaataatagtctagacctcccagagtggtggagattaaaagaggcaatgactgtagagtgcttagcacccaatcaatgtcaactattagg

SEQ ID NO: 142966 - DNA, 777 bp, Homo sapiens
gcggccgcctactactactactgctcgaattcaagcttctaacgatgtacggggacatgtgggaaagagtattgatggttagtcactataaaactgctagttgttattcaggatacaggaagagtttcaagagaggacatttggtataacattatatacagccaatggtttaaggaggacaatgtagaagaggttgtggatttggcacttaggaggtcattgttgacagaccttgtgaatagatgagggtaggaaccagattcctgggctttaagtaagaagaggggtagtccaataggccagttatatatttggctgtgaaagaggaaaataaaatctgagtacctttgagagtcaaaggctatttccaggtaaagaaacccagtgcacttcaccattctcttttagataactgctgggaagaagtaggatgattgtaacaccctccacattgacacagaactctaaatgggagcctagggaaagggcacattttttgaaggggtaggcaagaggatattctctagagtaccagtttccaactgttgtacacatttatggaccaagaacataaaagaaacattgttcagttccgacctgaagttatgtagaacaaacattgttctgagttcaactagatgatctttctttcatagctgtgtggacattatgttacctgcagggagtaagtcactgaaggtagagcctcaaaaaaacaccctttgatcttactcctaagaaaaaagagagaaattggaaaaattcatcatagaaaca

SEQ ID NO: 142967 - DNA, 724 bp, Homo sapiens
gcagagtcgttgtgacagtcaatagttacattattaaatgtaataatatttgtattaaatgtaatcattaatttaacagttctgcatttaaaatgtctgttgaatgctttaggtctcatgctttctgtgacacattgataacatttttaggtcggctggtagcaggtgagtcagtaggtaaaacctcagagtttcattacacgttgttcatgctcagatttttagatctgaaagttacatatagattgggatttccaattcttcaaatggcttgaatattgggccaagaaaatatttgtgtgttaaataagctgataagtattttcaagcacttagttcggggcacagttctgggtgctcaggagatacatggagaagacagatccagtccccaaatacaaaggggttatgtgacaaaactgctcaccaagagctgtgcctaggacaagtgtggtaagtgtgagatctttcagagggtgctggagttggaagggaaacacaccatcatttgatgagaatgatggagcaagtagactgcagtcagcccagttgctacacctttgcagcctgcttggctccttctctccctcctccatctggagacttgcccttgggcttggcgtcagcatcatttctcctttagagcctttcccaaccctccccacgcagggatctccagaagagtcgaatgttcttcctctctcacctaaaacagcttacttta

SEQ ID NO: 142968 - DNA, 259 bp, Homo sapiens
cagtttaaggagcggggaggtgcagtgctgtgggtgccaggagtttaaggagcgtggagatgcagtgccgtgggtgccagtagctttttgcagacaagagtccttctgtgctgtgctgcagcgagagctacgacattccaccaaattacttgccacatttctggcattagcaggagatagctgaaggtctgggaattaagtcatctcataaacattcaaattcatggtaaaattactatttaattaggaaaagatctgt

SEQ ID NO: 142969 - DNA, 528 bp, Homo sapiens
tgtctaagatagcacaatttccgtggtacttactattaactatttctaatacatgttgtttttatgctattcaattaaagtaagctgtctttactgaacagcacaagctgcttgtgaccacccagagtcggtggagaacctgactccagtctgccatgccagtgttctttgatccccagtttgacaccatcctttacaaatgtatgtacatgcttcctaaaagctttttaaaaattagcacattcagaataatgattacctctagctgggaaatggggaaatgttattggaaggagaccaggaaatgtcttggtaaatattctacttcttaagctgggtgataggtacccagatgttggctttattattatttgttgttatttacatatatacatcatcttttgtagatatgaaacatttcataataaaacatgaaggaagaaatgaatctagtcatgattcacttgctctaatatcattttttgtttctctccagtttgatgtgatgtagctctctggatgcaaacc

SEQ ID NO: 142970 - DNA, 181 bp, Homo sapiens
ctatgtttacttcttttccccactggactataagccttacaagggaagggaccatgttcatttattcaccaatgcattcccaaagtgtaggattaagactggtggatactggactgctagtaaatatttactgaatgaaagaattttttaagtgagtgaatgaacttcatatgcatatgtt

SEQ ID NO: 142971 - DNA, 195 bp, Homo sapiens
ttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcct

SEQ ID NO: 142972 - DNA, 136 bp, Homo sapiens
gttaattcatgtaaagttcatagaactgtgcctcacaaactgtaagttttcaggaaatgctggccattaatgttttcaaaaatatttttaggctgggcaggatggctcaagcctgtaatcccagcactttgagagg

SEQ ID NO: 142973 - DNA, 167 bp, Homo sapiens
ccacaaacatgtcactggctaagagggatgcattcttccctccaatccaaggaaaaacaagtgtgtgatcacttgaaagatgaccctgtatttctaactggatgtccctggagtctgctgtattagtgtgggggatgacagctgccctgattctatttccccttccc

SEQ ID NO: 142974 - DNA, 358 bp, Homo sapiens
cggggcagctgcaccaccagtgagtctcatgtggttggtgctgagcctgcatctgagcgagtgagccgaggcctggtggaattgccctgcggtctcggtccattgcctcctcctccagtgagagcccccgcctgagcacacccaacctgccacctgtctttacctttcctctgcggtccctgactctgaactcttcaagtaatgtggagttagtcagcactttattgcttctagggaagcagaggtgagaatttaggggtggaccaagaaagctagatcctatctgtggagatccaggttgtgggaggaggtttcatgacatttcttagctgttcctaaaagacatgcgaagcttcac

SEQ ID NO: 142975 - DNA, 426 bp, Homo sapiens
ttttcctgaatggcctgtcttgctactccaagtgcaatctgaagatgagcagcaccagaacaatctgggagttagaaatagacacttggatccactacaggcctgcagaattgggaagggtcttgttcctactcttttcaaagttagagatgtactgccttaaggtttagactatttggtaagccacctgagagttcaatgacaaggcttacgtctcttcctgcatcaaggaaacttaccctagagctaaccttcctggcttaaccaaatgtcaaaatgtttcaaggatcaaaggctcctagtatctactctcctagctagcacccagacactgctatctttagaacgcaatttagaaaaattaaccagcttttctcagaagccccatttttactaggaacaagagaattccaaatttttgtgcaa

SEQ ID NO: 142976 - DNA, 712 bp, Homo sapiens
gacatagaaacacaaagtgagtacatgttattggaaaaaatggtgccaatagacttgcttgatgcagcattgccacaatattcaattggtaaaagcacaatattgtgaagtgtgataaagcaatgtgttagtctgttttgcatggctataaaggaatacgtgtgactggctaatttacaaagaaaagagatttatttggctcattgtttagcagggtgtctgggcaaggcaccagcatctgcttggcttttgtgaggcttcaggaagcttttattcatggcagaaggtgaagggggagcagctttgtcagatgacaagagagggaataagagagggggcaggtgccatattctttaaacaattagatctcacaataactcatgaccacagggagggcaccaagccatttatgagggctctgaccccatgacccaagcatctcccactaggcccaccatcaacattgggaatcaaatctcaacatgagatttggagggtataaatacccaaaccatatcaagcaaagcacaataaaacaagtatgcctgtatttatacacatattacaaaaaatatataaactcactcaaaaaaatgtttttggggggcgctctgggccttcggaaaaaatttttttaaccccctttgtgttggggcgcgggggcccaatttgtttagtgaacacctggccaaacagcgtgtccacgggaaac

SEQ ID NO: 142977 - DNA, 291 bp, Homo sapiens
ttcaactatcagagctatttaaagtcctgcttcccaccccaagtctaaacctccaactctggcctctcttccaagctcctgacatttgtttccaattacctgacatctccacctggattgaatcccaaaccaaaaccatcatcctccccctgctccaaacatgtttccttatattcctataatggctactggcttgaaatcctagaaactaagttcttattcatttatttcctccatatctgaattggttagaatcagattgtaagatcaactgcatgtaacagaatctca

SEQ ID NO: 142978 - DNA, 394 bp, Homo sapiens
tcgccaggacgcggccactgtctggatgtagagagagggacggccacaatgggtcactgctgagtctggacaggcagggaagccatcacagaggggtgaggggagtttcgttgctgtctttggttgagagcacacgcagcacccccagatcaaggtgacctgtgggcaggaatgagtccatcttggcctggaacccgggcgatgggtgccctgaatgtttctcccgttggctagagccgattcctccccacccctcgccatgccacacggtcgcttccttgggaggtgttagcaagaaaagcagaagaaagcggccccaggcatgttgggggaggagccccacccagtggggtgggaagacatcctccgtggctgccccaggagcttaggaact

SEQ ID NO: 142979 - DNA, 361 bp, Homo sapiens
atagttttcctgaaatgtattcttggaatggaattgtatgatacgcttagaaaattctgcataccttatacttcagaatgtgtatgtaaaagactccagtaaatgatccaggaagcaaaaatatttgtgtgttttgcgagttgtattcatatgtgtataaaattcccacagcactttgggtaacaatgctctgcacacttttcctgtgctccttttatccattcccacacttccagcatttcctttgacgtttgattttctttatttttttttactccaatattttcctgtaggtttcaaacctatattttaaaatatcaactgattctctccctctgtcttcaccacctgcatctcaaat

SEQ ID NO: 142980 - DNA, 133 bp, Homo sapiens
caggtataagctataacacaggtgggctgagccagtgcataagccaagcatggcccagtgggtcgagtgtgtgggtgccttctgtggcaggcctgggttgggggtgtcaccagccacggaggtccccggttgg

SEQ ID NO: 142981 - DNA, 190 bp, Homo sapiens
accctcagcatccaggccaccttcctctgggtgaattttcacaccttgatcatccctcagtgtatcctggcattatgttagtgctttaagcagagctggtacatgctctgcccctggtgggtcaaatcaagtcctggtcctgccccttactaactgggtgacaccaggcaagttacttaacctgagtttc

SEQ ID NO: 142982 - DNA, 609 bp, Homo sapiens
tgtttatttccttaaacagaaataaattcaagcatagttttatgttttattagaaataagccactgcagttgctagaactgacatgctttcattttcaaggggttaacttttattgcatggcatagattattagtaatatcctgcattgtatacttttccaaaaagggttggactcctaaggattagaatccttataagcttgagggaaagctgaaactaatttgaacagtaatagaagggattatttttaatttcatagttaacactttacaatggattagatttattacctagtataatccgtagcagatcagatcaaagtttactgttttaccaatatattcatttgaaaaaatacagtggaggaaaagacactttagatggtagttttatggtgcttttctctgctgtaccaaagtgctttgtcatcaatgaaatgttaaccctatgctactttttctgcatgcttcttaaatgtcatcttaatgcttaattgtcctaacttgtaatatttttgtattaaatttttttaggagttccttgtaatttctttacaatttaaaatatattaaacacaaagtgtttagtaaagtacagaagacaattac

SEQ ID NO: 142983 - DNA, 674 bp, Homo sapiens
gtaaccacaggataaaagaagaataaaaatatagagagagaatattagatcagtgctatgaaaaaatagaacataggaatggggatgttgctatttagcctagacaaggaacacataactgataaggtgacatttgagtagagacctgagagaaatgaagtaatgagacctggatattgagataagtaagtgcaaaggtcccaatttaaaatgattgatgggaccaaggaatagatattgatagtccagactaagtggtagtagaagtgctgaaacatggtcagattgtggatttgttttaaaggtgggaccaagaggatttgccaatggattggatgttgcaagtgagggaaaatggtagtcaagggttactatagtattttgaaccttagcaattaaaaagtgggcttattatttataatgggaagagaagagttgaaagaagtaaagaccattgaggtagcagaaagaaatgggagagttgcaaagggtatataggatgaaaatgggggaactattatagtttgtaaactgatgagcaagagctatggattcaggctgccaggtttgaatcctggctccctggctgtgtgagcttggacagtgtttggcacatagtaagtgcttattgttagctgttatttgaataattttttacgtaatagataggtttg

SEQ ID NO: 142984 - DNA, 388 bp, Homo sapiens
aggtcgggagttcaaaaccagcctggccaaaatggtgaaaccctgtctctattaaaaatacaaaaattagctgggcacagtggcgggcacctgtaatcccagctacttgggaggctgaggcaggagaatcgcttgaatccgggaggcagaggttgtagtgagccgagatcacaccactgcactgggcattagagcaagactccgtctcaaaaaaaaaaaaaaaatggactttaaaaagtgacacagaaagccggctccagtggatgggtggatggagagaaagctgcagtcaagagtgaatcagatgggctttaaaagagcatcagacttaattttttatgtttccttttatttgtagtcattcttttacttgtcacatattcattgc

SEQ ID NO: 142985 - DNA, 278 bp, Homo sapiens
tctgtcctgaaggcccataagtcacagaatgcggtgtgttggaatgtgaaatcctttcagccttgcagaatctttatcattgtgctaaattgccatgtggaagaatggcaggtggcagttagaacttagggctttctatttattctctttctattttgcattagtcagttaaggttctgatcttcagaactttgtatgaaagtcagtgcttcatacaatttcacatcaaactgtggcattgcaagaggcaaaccatttggaattcttccttaaattac

SEQ ID NO: 142986 - DNA, 446 bp, Homo sapiens
gcgactctaaggatctccccgggagcctgaaccctctgtgaggactgagcaggaaatgggcggaaatggttcagcacagtgagtgctcagtgatgcggttgtcattgataatccatctggaagggattgcttgtcagtttcaggagactcagagaccactccctcctccaggaagtcttccaggctttaagtcttgggtgggaactcaaactgtgggtgagttgaattggattttcctttccacaaggtgtctgtccccctgtgactctcactgcctgtctctcatcatgggcagggactaggctgaattcctctctgcatcctaggactctgctcagaccctgtcacaaagtcggttttgggagctgttagataaatgaatgaatgaatgttttgaggactcagcactgagcattcctggacacgataccattgttctgagagcc

SEQ ID NO: 142987 - DNA, 346 bp, Homo sapiens
gcacagcccaaaaaaccagatctggagttagatggacgcggtttgaatcctcgttggtctcttagccttggtgtgacttgggcaaactgacttcctttttccgagcctcagtcttctcatctgtaaaatgggcctgatggcactcctctcatcctggggctactataaggagtcagtgagtgtgtgactgggagtcagtgaagggcctgacccattgcaaggctgttacagatcatggtgttgtggcaggttgtaatgccccccaaaagatgtccaggtccttatccttacaacctgtgaatttgttaccttacatggtaaaaaggaccttgcaggtgggattaag

SEQ ID NO: 142988 - DNA, 442 bp, Homo sapiens
gacctaatcaataaaaagcaggcaaagatctcaataaataggagagccttccaggcaacataaggcccaagcaaaggcacagagatgatggggaaaaggctgaccatgttcaaatacatattcttaaagaacaggagatgtacttcataaaagagtgaggtcctatatgaagtagagtcaaagggactaggtccatttaatcagaaaagaaagatggcagtattttaatagaaccttcaattatttaaaggaagtaaacaggggaagaggatggaaaataatggtgggaaacttcctttacattgtcaaaggcctttttttataagtgacactttagcagggacctaagaagaagagaaggaaccagccatggaaggaatgggaggaatgacacatgcagagaacatgaatcaaaaggagctttacattatttggggaatgt

SEQ ID NO: 142989 - DNA, 276 bp, Homo sapiens
gcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttcca

SEQ ID NO: 142990 - DNA, 334 bp, Homo sapiens
tcctgcttcaacccgccgagtttgtctttccaaatcacatgggcaattgattacaccatcaacaaaccccatgtaaccctccaaggaacgaggtgcgtcccttgcagtagaaaaccgataacccaagacatgaaggttcgaatggatgattggcttagctggaattgtgctcctctggaggagactttttaaatgtattcctagttgcaagtccagaagcaagggaagtgaggccctcagggttctatcagagcctgggaaggggaggagagcagagatgctaaagcagtagcagaagatccacagacccctggaaggacatggaagctcgctt

SEQ ID NO: 142991 - DNA, 702 bp, Homo sapiens
ataaggcagacagcaacctcatcctactctttatgtatttcttattctccccttgttttctgatggttgtactaatcaatgttagaatgtttaattatttcttatattgactcacttgtgattatctaccaataaaaatatatttgcaagtaatcatcagatcatgtcattatcaatctcccacctccccttttttgtttgtctgaagctcattttctaaaacattcctcaagaagggcttatagaaacagtggtccttgagtttctgcatgttcctcacagtttgcctgtggcctttgttttaacggtcagtttggctggatataaaatctgtggatcccattttctttctttaatattttaaatacattctcattgttttctggcataaaacattgctgtcaaaagtataacaatatggtcaggtacaggtactcacaactgtaatcccagcactttgggaggccaaggcaagtgcatcacctgagctcaggagttcgagaccagcctgggcaacatggcgaaaccctgtctctacaaaaaatacaaaaaattagctgggtgtggtggtgcacacctgtggtcccagctacttgggaggctgaggtgggaggatcacttgagcctgggagatggaggttgcagtgagccgagatagtgccactgcactccaaactgggtaacagagtgagaccccgtctc

SEQ ID NO: 142992 - DNA, 334 bp, Homo sapiens
tgtacatacatccattctttgtctgaagtgtaagtggatgatgttttcttaccagctttgagatagagtctacatataatgtgcacttcaggaagttttaacagatgcatgcagttacgtaaccggcaccacggtcaagatggaatctttcttggtagaatggtagaatattgctaccacccccgaaattgccatgaccacttttgcagtcagccctctcccctgactcctagcccttggcggtcccccatttgctttctgttactatattttgcgatttctagaaccttatctaaatgcagtcatgtatttcatagtcttttgtatctggctt

SEQ ID NO: 142993 - DNA, 550 bp, Homo sapiens
agtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaag

SEQ ID NO: 142994 - DNA, 176 bp, Homo sapiens
cagcgtcatgattatcgtagctctgtgcaacctgaaactcctgggcacaagcaagctttttgcctcagcctcccagctgggaccgctggtgcacatcaccatgcctggctaattgctctttttctttttttttttttgttttttattttttttttgtttatttatttataaggggg

SEQ ID NO: 142995 - DNA, 230 bp, Homo sapiens
cagctgacccctactgatccttccagtctcaaaataaacaagcctttttttcagtctctcatgaccctactttgcttccatttactttgttacaatttccaactggatattcatttatgtgattacttgttcattgtctgtcttctctattaaccgtccctaccctaagaggaggggccatgtctgttttgttcatctggatgtcttccgtatattttaaatgttggttg

SEQ ID NO: 142996 - DNA, 748 bp, Homo sapiens
ctaaattattttaataaataatgtagtttatatagtgttattctcatttaatgatagtagttgaggcaagtgaggcttagagaggttaaataatacacagttcatattatccctctagaattactggatttttacttctgatcttacttttctaaaaaatcactgtgaaaatcgaatgtctataattaacatgaaattaattaccttaaaacttaaacacatatttttaaatgatgctttgtaacagtggttttcagtgtgtgttttgtattccctttgtgttttcccaaggacctagatgatagcaagcaggaagatacagtcttccacttcagctagagcagtgctgcctttttgttttatggggtgacattgcccactgtgtttttttgtttctaaagcacgttccattgctaaaatgatttgaaacactgtactttattaatacttgttaattgttattaatactaattaattgttttctctttttcccccattgatgactttctgttgcttggaacattttttttctgttgcttgaaacatttttttcccctcttggcttccattgtactataattgggtggctttcttccttcagtttttagctgtccctttttaatttctttgtggtcctccccagtctccatgtcctgtaaagtgtgaaaatgttccaggcctcactcttaggatctctccttttttttctgtttatcctcacaccctaggtgatttcatctaatcacct

SEQ ID NO: 142997 - DNA, 687 bp, Homo sapiens
agcgaatgttatttaaatcaacttgtgaagtcttcattttagatatagaatttgtgttaatgaactggaaaataacattctattgcttggaagatgtgttaaagcctaaaattttatgactttgtaaaagaagaaaaccagctggtgatcagttggcattagtatataaggatgtactcatatttgataatagccatttttttctaacaagagtaagggagttgggaatgggaggcagagacagggacacagatatataaaaaattgtagacaaaactgtattgcgttctgagtatggttctgtgatccatggttcagtttgagaggttcctgtgtcccttatgagaagggacaggaaagccaggaggacaggagtatgtttgggcctgtgcctgtgcttccaccacagaagtcagcagctctacctttctcttttctcctctttatctaataattgtttcctcttcaaatttgggaaatgagcttaatcaaatatttgttgtgtttgttgtttttgaaatgtggcctcagtgtgtttgcccaggctgatcttaaactcctgggctcaagtgatcctccctctcagcgtcctgtgtagctgggactacaggcttgtgccaccacaccagctaagttaatgctaatgtgtagtttatctgattcagttttgaagggcggggtatatat

SEQ ID NO: 142998 - DNA, 215 bp, Homo sapiens
aagggatccacggaataaaaaagacggcattcatgcagccctgcgccactcaggatgccttcagaaatggccacaaaaaggaatagagatgccagagggtcaattcacccagttttgtgctgcaaccataattactgagcacataaaacccgcacttggctatttatctcacaagttatgtttccagatggtaatcacacccaggactttggaca

SEQ ID NO: 142999 - DNA, 669 bp, Homo sapiens
accgtaactgaaagtgttctttccattcctgctatcctcacactagtcaagctatatcacctcacccccttctaatctgttacagtcggctcaaaagcccccctccatctctgatgctgttattcttagagtcctagaaatgagagatggaaaacttcaattaaattcatctagtccgtctcccctgacaatgaaaaaaaatagtatttcacattatattatctaatgctttttcaggccttccatgataacctctgagagactgtccaataggctaatagacctcactttgaggtcttcattttgacccatcatttctcattattatattccttaaagccatcatcctcaatattcatactttgtgaacttgaatgagattagcacagtctctgttagtcataagaaaatcaacatactatatagagtatgtatgacattcaatttacaataaaatttaaaaaaaatcagtatacgcctcattaacaggaactgaagtgttctacagaagtgaattttccagatactaaacttttcttccttaaccaccagatttagtttggttttaataattttgagggggttttccctcctatgtgttatttccgtactttcttgagtgaattcaacttttcttaataattcacattaatcattatcagcattctg

SEQ ID NO: 143000 - DNA, 426 bp, Homo sapiens
attctggtatttcccaataaattgatcaaataatgcaaaatgccaaaagtgagagtccccattctatttttatttccatgttagaagtgaattttgacttataagaacataaaacatcaagctaaagcagaactcaccttgtgaaatttcctcataccttattttagatactgatttaattagccttctaattattttggtgggtgggagtgggtagataatgatagcacataacataagaccatctttaactttaattagattagaataaaccaaatccaagctcacatgtaattaagcagaaagcatcaatgtcaataagaatttgaaaataaaacaggaaactcataatgtgatagaatattcatttggttttgatgtgctagagaaactggtacacattataaaatgtatcagatgacacaa

SEQ ID NO: 143001 - DNA, 292 bp, Homo sapiens
aaggagagatgacacagccgccatctctcgatggaggaattgcaaagttctggaatgaacatatgggattgaaaataatgttgtggccttatttggaaaatacagtctgccacaggacatttcacagatgttgaggggcagggcagtccccagctgatatctgagttacaatcaggaaaaaacaacaaaactattttttttttaaaaaagacaaaatattaactgaaatagacttcaaatcaaatctaagattatttagaagaacatggatgaagaatagggacttttattg

SEQ ID NO: 143002 - DNA, 236 bp, Homo sapiens
agcaaatacaaaatttgctagagaatatattttagaaatcaaaattttaggagttctaatggtaagtaaagaattttaaatttacttttctgtaatgtagtgtaacttaatttctatgcagaatcttctactttaagagtgaatgttaaacatggcaaaataataaagtgacctctgtgaatttgaaatttgagataatatttcttttccatactgatattacaatttgaagaaat

SEQ ID NO: 143003 - DNA, 468 bp, Homo sapiens
gcaactggggagacagagcttctgccgtgaactgatgggttccagaaaatggtcttaagtccattggtcccttgaatcagcagaagtgacatgatccaggcttccctgacacgtcatggggtcaggaaaagtccttgtgtttttttcttggcctcctgctctttgtgcctatgacacagagaaggcagctggctttccccaaacagggagttacactcagaccttacgtcttttctaatcaatgtttaatgtgaatcactgatttttttctagtagactgatttctaatactttcaatctaggatgcttaggattcaactaattgtcaggaatcttacttttttccccctttgattgatctgagtgaaaactggtttttcattgttaatcagaacgtgtgtggcagttttctttgcatactgtgtggctgtgttctttgttatatgagcatctggccttggctaagta

SEQ ID NO: 143004 - DNA, 775 bp, Homo sapiens
gggatttttaaaggtagccagtccacaacaatgaaaaaaaaattaccaaaatgtatattttctttttttctctttgaaaatgtatattttctttttttctattttgaaaaatttggccgggcacggggagagcatgcatggtaaacacagacaacatatatgggagagccgagtgggaccagaattacaatcatgtaaccctgcacgctcaggtggttaagaaaaagcgactctggcacaacatggatgcaaacacccgatattaaccggataacaaatatggcggagccgcctattagcccagacgtactacggcacgctgacaaacatacgagaaaatagatttgaaaatccgcaaagtatggaagtttgaaggaggggaacgaaaacagacggacaaactgaacaatctacagtgcgtgaacgacaggaagatgagtaaattcaggtggtcgcaaaaaaaaacaacagcaaaccaaagaaagacaagagctgacaggatcaacgcaaacgcaagcataacaccatactaaaaacaccacacaggtgtagcacgcgcgggcgcacaacagacgagaaaggagagtagacaacaaagaagaccaacacagaacaaacacacgagtcaacacatacatggcaacaagaccaaatcaagaaccaaaactcggtgggcaacaagagtagacactagcaacaaccacgcaatcgacgggtaagaagccaaaatgaagaaaaaatcacgagcgtgtcgacgactacacctacaagtacc

SEQ ID NO: 143005 - DNA, 454 bp, Homo sapiens
atgtcatgcgtgaataacaccagcagcaaacactcacacatcacgcagacacggccggcagcatgctgacgcttttaggtatttttcactcatgcaattttcacatattttcactcatttcatttgcacggaaattctatgaggtagatgctgttatcaaatccacattacagatgagggacccagggtccaggaaggtgaactggcagaagtctcccagctggtagaacagggctgcaaggcatcgattcccaggtgtctcacagccctgagaagatggcgttttccctatcagtggctctgaggaagtcaagccttcagtctctacctctcccaccaattcttttggaaacagcaaaccaatgttacacacacttcctaatccagaggaagctagaacacgatttttaaatttatttagtaaaataaaactttttttgcagatgtaacgaat

SEQ ID NO: 143006 - DNA, 801 bp, Homo sapiens
acttgagcccagaagattgagaccagcctgggaaacataaggagactgtgtctctataaaaaaatattttttaaaaaattagccaggtgtgatagcgtgtacctgtagtcccagctacttgggaggctgagggttggaggatggcctgagcccaggaagtcgaggctacagtgagccatgatcatgccactgcactccatcgtgggctacagagggaaaccctgtctcaaaagaaaaaaaaaagagtgtggtggggtctgcaagctggtcagagaatgctaattggtccagacacactctaggagaacataaaatttggtctccatcttgaagcatatatagcactgaatagatggacagaaagacaggtgccacaaaagcagaaggaagaaggcagactgaagtctagtgtgcctgcgggacagtgaggggctggagtcgagagagagggaggagaggaaaaaaccaaggctgaaaatttggatgaagccagaccctggaggatcttcagcagtcaggaggaacatgcatgcaaagccagaaagaagatagttgatggtcagggtttcagggcttgctgaccaatgaaaccctggtcctgtaattctgtaagctccagaccatttcctccacagccacacctaccaacccatctaaattgacagccccggaggctgggggcacacggaggtcccactgcgcactattctgtgagtctggattgagtagcactgccacggggttcacctagcccaacacattcaggtcatccggccgcacacccacagtccacccttttct

SEQ ID NO: 143007 - DNA, 352 bp, Homo sapiens
cagggcgtacaaggactaaggatgacagatgaagaagagggcaggatctagtggcttgaattggaaaggtgactcatgtcatctattacccatgcctgatggcgtatcgcctcatgtactaactcatctctctgtcaatgcccggctctgagtgctttgggaattctatactagacacagtgggtgtcatgaggttaggtcagaccatggcagcctcttactggtggcgtagccttagttgagtaactcaccttcctgggcccaaattttctcttccaaactggggctgctagtgcctgcctcttagggtgtgaaggagccagtaaggcatggatatgcccagcatggctgt

SEQ ID NO: 143008 - DNA, 397 bp, Homo sapiens
cagcggggaggcaggaatagggatctgcagggcagagagacttctcaaccttcccagggagagaggagacatggaaaaatcccacagttaagctgtgattggtcggtctgtccaggagaacccagggatctcaagttcaagtctcacctaaaagcgttcacgttctttgaccctatacttccccttataggaaaacactgagctgttcactgcaatgttatttataataacaaaaaatcagaaatggcccaatgcccaataatagaggaatggttaaatatattagggcacacccagacaactgagtattacctagtcattaaactcatgttttcatagaatatttaataacataagtgaaaaatacaatacgaatttacataaagatcatgattct

SEQ ID NO: 143009 - DNA, 407 bp, Homo sapiens
gcactctgggaacaggcatcatccatttattagcgacttttgttggctgttagttcaacaacaggtgaacatatacttgttcagtagccagtagccactatgtgccaagagctgtgccgcatgtgcaggtttcaaagatgagcaaactgtggtgactgtccttgaggagcaatggtctgggaaggggaccaaggaacaggcaagtaatctcaatgaaattgccaaatatcagaagcggaagtcacagaagcacagggcccttccctagccttccagttcttctctctcttccttgagaaccgaagttctcacctgggccatctacaggtgctgagttcatttccccacccccatctggctgctgccccaccactccacacaagcagctggggacaccaatgtcctcg

SEQ ID NO: 143010 - DNA, 701 bp, Homo sapiens
cactaactttataaggatggacaaggcagatgagaaacaaagtggaattagataacagaatgtagactttgactctctcacttttaaggactgtgaagttgtggaaatagtagaaaggtcaaagaagggagacagtagaccattatatcaattttttaaaagactgcaaagaatattagattcattattaagactttagaggcctctacaactatatagagtcagaattatgaaggtaaagtcacattgcagggcaactttgaatagatagaatacttaagctaaggaaatcaggaattagaggtaggtaacagtacactcagaaggtatggggatactaaatatttctcttgaacacaaaacagaaattgtcctgacccccttccccataatgtcttgaaggagtaacttgaggccagtatgacaatcactctggaagccaagaagtggctgtcttctatctaaattaagatttgcattacttgctaatagaatggaacattaagcagtagtttggaatcttcctcacagagaaagtacaagccagtggtggctcatgcctgtaatcctagcactttgggaggccaaggccagcagatcacttgaggtcaggagttcgagaccagcctggccaacatagtaaaaccctgcctttactaaaaaatagaaaaattagccaggtgcagtggtacatgcctgta

SEQ ID NO: 143011 - DNA, 728 bp, Homo sapiens
gttctccttagcagaagataagatttcaagatttcagctaagactcatctctctgcaaatctttcttttgagagcatcttcaccaggaggagattccatctcaagagaccactttcactgctcatatgtaagaagcaactcttcatctgttcaagtttgatcatgagagtgcggcaattcagtcacaacttcaggctccacttctagttctagttctcttgctgtttccaccacatctacagcgacttcctccactgaagacgtgaacccctgaaagtcatctatgggggttggaatcaatgtctttcacactcctgttaatgttggtattttgacctcctcccatgaattacaaatgttcctaatggcatctagaataatgactactttccagaagcttttcaatttgctttgctcagatccatcaatggaatcactatcaatggtagctatataaactatataaggctatatatatatatatagctatttcttaatagccttatgaaatatatttcttaataagacttgaaagtcttggtccatggactgcagaatggatgtttgtgttagcagggatgaaaacaacatgaatattctcgtacatctccaacacagctcttgatcgacatggtgcagagcagtaatattttgaaaggaatctttttttctgagcaatagttctcaatagtgggcttgaaatattcagtaaaccatgctgtaaacag

SEQ ID NO: 143012 - DNA, 816 bp, Homo sapiens
tttataagtgtagttctttattatttttattgaggaagaacacacttagtggtacagcttggtgagttttgatatgcacacatgcatgtaactaccactccggatcaagatgataaggaacatccctatcacttcagaaggtgccttttgctccacccagagcatcttcaccaggaggagattccatctcaagagaccactttcactgctcatatgtaagaagcaactcttcatctgttcaagtttgatcatgagagtgcggcaattcagtcacaacttcaggctccacttctagttctagttctcttgctgtttccaccacatctacagcgacttcctccactgaagacgtgaacccctgaaagtcatctatgggggttggaatcaatgtctttcacactcctgttaatgttggtattttgacctcctcccatgaattacaaatgttcctaatggcatctagaataatgactactttccagaagcttttcaatttgctttgctcagatccatcaatggaatcactatcaatggtagctatataaactatataaggctatatatatatatatagctatttcttaatagccttatgaaatatatttcttaataagacttgaaagtcttggtccatggactgcagaatggatgtttgtgttagcagggatgaaaacaacatgaatattctcgtacatctccaacacagctcttgatcgacatggtgcagagcagtaatattttgaaaggaatctttttttctgagcaatagttctcaatagtgggcttgaaatattcagtaaaccatgctgtaaacag

SEQ ID NO: 143013 - DNA, 182 bp, Homo sapiens
acacacacacacacacacaaatatattactattaagttaaaaataaataaaagagttgatgtaaaagtctaggagaatcatttagtttacaacatttcagttacttgggtgggagttaccctggctgggatataaggggaaggcacataggataattatgggtgtagtattggccaaacagt

SEQ ID NO: 143014 - DNA, 203 bp, Homo sapiens
gaaagtataaatgaaaagaattaaaatatcagaatagttgctaaataaacaccagaaagctgctggtcaaagtcaggaaagttgtaggaaagttgttgtgataacaggcaaggctgaaaggatgcatattccaagctgagcaaatgttgtgagcatggcctcgaggtggggcacttctgggaatggcaagtggtttggttcaa

SEQ ID NO: 143015 - DNA, 205 bp, Homo sapiens
aatcctcagagccgccctgtgcggcaggcgtcatttttattctcattttacagatgaggatacagtggctgggagaggtcaagtcacttgtctgagatcacacagctagttagttacaaagctgagcctcaaaggcgggcctgaagcatggcctctcaccacccatggagacgggtccacctttcaagcgttcttgctccagatg

SEQ ID NO: 143016 - DNA, 350 bp, Homo sapiens
cattcaaacacaatgctgctgtttatccatgcagtagaaaaagaaatattttttttcttggttttaaaaagtacagcatttgggttacttttaaaacccataattgaataacattctgtattatatttgtgactcactctcaagtgaaatgtcaccgtatacccactcttcttttttaggtgataaataataaaatattagaacagaactttagttataaagttccttacaatttacagggaacaagtccttctaaaataataaaaattaagagactctgtcatcttgtttttacttttttacggtttagagcccaggaaaaattaactgggtctgaggaggtattaatc

SEQ ID NO: 143017 - DNA, 725 bp, Homo sapiens
taagacgaaatctcgctttgttgcccaggcttgcagtgagccaagatcatgctactgcgctccagccaggacgacagagtgagactcctctcaaaaaaagtaaaaactattcatagcttcagggccttgagaagccagatttgccaaccctgatacaaatgactgaaggctgtgctgccatttcctgtgctgtaagacagtatttaatatagtgccatggaaatttttttatttttattttgtttatttattttttttgagatggagtctccctcttgctcaggctggagtgcagtggtgcgatctcagctcactgcaacctccacctcctgggttcgtgccattctcctgcctcagcctcctgcgtcgtggaaatattcttcataatatagttgagtgaaaatgacacgttaagtcgctgggcgcggtggctcacacctgcaatcccggcactttgggaggccaaggagggtggatcacctgaggtcaggagttcgagatcagcctgaccaacatggtgaaaccccttctctactaaaaatacaaaaattagccgggcatggtaatgctcctgtaatcccagctactcaggaggctgaggcaggagaagtgcttgaacttgggaggcggaggttgcagtgagccaaggtcgcgccactgtagtccagcctgggtggcagagacagactccatctcaaaaataaataaataaataatacaaaatt

SEQ ID NO: 143018 - DNA, 116 bp, Homo sapiens
aggagtaatccttggcctactctctcttcaatctacattgcttggtgatctcccatctcatggctttcagtaccacgtatgcgctgaagactcccagatctccatctccagcatag

SEQ ID NO: 143019 - DNA, 309 bp, Homo sapiens
tcgcatttggtttgtttttaattttctttatatatatataatttttataaatcatagtattatcaccattttgcatgtaattttttgaatatggggccatttctttaggataaatccttccaaatgagatgtttttctcatttatttctttattcacttatttattgagatggggctcgctatgttgcccaggctgcatttgaattcgtgggctcaagcgatctcccgtcgcagcctcctcagctgggaccacaggcacgtgccagtgcacctgactccaagatggttttagagtttaaataaagttta

SEQ ID NO: 143020 - DNA, 253 bp, Homo sapiens
ttgggtgtctcccaggagcactgggagggacgacttggcctcagttctgctttctcagtccctctgtggctggagtggcagagccacacagaagcccggggttctgatgaagccacccccaggcagcccgaggaaacagctcccagaaacgggcagcctgtcccttgtcccttgtgccttttcttgtaccctggcctggccactccaacgtccaaagggccagcccgggaagccgccccaaggcctcctttga

SEQ ID NO: 143021 - DNA, 790 bp, Homo sapiens
gggttccaatcccaattttggagtagcagagggtgtttgttgacctcaatgccagtattccccaggggagactgagtgtccgtgcccatgttggtgagtggacgctaggtccagtctacatcgctgggtttgcagtgaatatgatcgaggtgctttgcttggaggctactgatgccaaagacccaagcactcagttctgagatcactgaggcagcaggctagagctgcgggtcagggggaggttggtactcaggccaaaggcctattctgaaggcaactggctacaggtctcaaattctggtgttgagttattgagatgctgagaccagaagcttccatctggggtgatcaagactagggtcccagggccggaggtggtggttcatgcctgtaattccagcactttggaaggccaagacgcttgagcccaggagttcaagatcagcctgggcaacatagtaagactccatcaaaaatatgaaaacctgccagatgcggtggctcatgcctgtaatcccagcaagttgggaggttgaggcaggcggatcacgaggttaggagtttgagaccagcctggccaacatggtgaaacccatctctacttaaaaaaaaaaaaaaaaaatattatccaggtgtggtggtgcacgcttgtaatcccagctacttgggaggctgaggcaggagaatggcttgaacccaggaggtggaggttgcagtgatccgagttcgcgccattgcactccagcctgggcgaaagagcaagactctgtctcgagaaaaaataaataaa

SEQ ID NO: 143022 - DNA, 140 bp, Homo sapiens
agaatggggagagggcttgattaaaccacccccagactcccgccacttcctgcccaagcttccccagggaagcttccccagggtgcccagttagcaaggggagaactgagtgcaaaggtggggacctggcacttcttatc

SEQ ID NO: 143023 - DNA, 415 bp, Homo sapiens
atttaaaataattaaaatgaaataaattgttttaaaaattcagctcctcagtcacattagccacatttcaactactcagcagccacatgtggctagtggctgctgcaatgaatgtttccatttctgccctcacagaaagctctggacaacgctactcagtgctttgctcctctcgctcctgccttgcaggccctgtctcttacaacccaattcctgtgccattttttaaagaaaggcacttgatcccatcagctaatgataatttcttctctcctgtatattcccagtaactgtatctgtaccattctatggcatttcaccttatgctagtgtaatatagagctgcactgtctttgctattagccccataatatttcttggagaaagaattgttgtctggcctgtttgtccccct

SEQ ID NO: 143024 - DNA, 120 bp, Homo sapiens
cttaaatccttttataagccaggttaactttgatataaaatcccaacagaagctgggcgtggtggctcacgcttgtaatcacagcattttgggaggctgaggggtggatcgcctgagccc

SEQ ID NO: 143025 - DNA, 502 bp, Homo sapiens
tgtattattctttagtttcggactgtagggtcatagagatgaatcctccaggggttgcttatttgttcccagttaatttttgtatttatttcttttgcttttgatagtcttctctaaaatttgtaggaatcatttattgtcataaatataatttgaaagtagtatagcttgatggctattaatatgaatgtatctggtggaaacaagctatctttttcagatcagaaaaaataatataaagaataaatatttttctttccaattcagttacctaacataatcagggtagaagtctggagtgggaaggcaaaagttattgactagattttctctcaaataattacatatatcaagttaatatagctgtttaaatcattaagttttttttttccacatgaagatcctaggaatataaaaatcttacctgaacgttaaaaaatactggttttatgtaagatttacataaagaaaataataacactttagggaagggtacaaagca

SEQ ID NO: 143026 - DNA, 405 bp, Homo sapiens
gatggcaccttctaagaggttccaagggcggaaacaaggggcagttccactgggtttcagacacagagatcccagcctggattgtcgtggaggatgaagctgctccatcttggatgctgatccgccatgttgtcctctggttaacccctgttctggaatgcctcctctaagattgccactttatctactgtgaccttaaatcctgctcttaggtagattcacatagcattctgcgcctttccctgaggggttgacttcagtggtgccacacatttctactgaggcatgtgtaccttttgcatcaggtatatcagccctgggactcggggataactgactgacggctgcctggcttctgtttctaagttgctattaaatgtttctttctgagaaactggatacatc

SEQ ID NO: 143027 - DNA, 1484 bp, Homo sapiens
tggcaacaatttgagaagtcttctggttttttcctacatttgtctcgtgtagtcatgtattatatcttaacaaaaaactataaaattagggagccaggcatggtaactcatgcctgtagtcccagaaactccagaggttgaggcagggggatggcttgagcccaggagttcaaggctgcagtgagctgtgattgtgccactgccctccagcctgggtaatagagcaagactgtctctttagaagaaaaaggctgggcatggtggctcgcacctataatcctaatattttgtaatgccaaggtaggaggatcacttgagcccaggaattcaagaccagcctaaacaacatagagagaccccatcactatttatttaaaaaaattaaaaaggtgaccgggcacggtggcccatgcctataatcccagcactttgggaggcccaggcaggtggatcacttgaggtcaggagttcgagaccagcctggccaacatggtgaaaccctgtgtctactaaaaatacaaaaattagctgggcgtggtggcggccacctgtaatcccggctactcaggaggctgaggcacgagaattgcttgaacctgggaggcggaggttgcagtgagccaagattgcaccattgtactccaggctgggcaacaagagtgaaactccatctcaaaaataaataactaaagtaaggaaaaaaaaattaagtggccaggcatggtggctcacatgtaatcccgacactttggaaggctacagcaggaggattgcttgagaccaggagttcaagaccatcctggacaaaaaagtgagaccctgtctctacaaaaaataaaaaaatcagctgggcatggtggctcatgcctgttgtcccagctccttgggagatggaggcagaagaatcatcttagcccagttggttgaggctgcagtgagacaaggttgtgcctctacactctagcctgggcagcagagcaagaccctttctctcaaaaaataaagataggctgggcacagtgactcacgcctgtaatccctgtctctacaaaaaaaaaaaaaaaaaaaagctgggcacagtgtagtcccagctactcagggggctgaggcaggagaatcacttgagcccaggaggtcgaggctacagtgagctgtgatggggcaactgtgctcgagcctaggtaacagcgagaccctatctcaaaaagtaaataatattttttaaatgttttaaaaatgaaaaattaagttataaaattttataatttataaccaagttcttccagagtttttagggtattttcattgggaaatgcctttaacaacctccaaagaatccagcagggagcaatttgtggcgggtagactggagagtctacagatgggatgggtctgaccccttgtgggatgaaagccaaacctttcccatcgtccgtattctggcactcctcttcctgttaaaaccatgagaattcacttgagag

SEQ ID NO: 143028 - DNA, 430 bp, Homo sapiens
tgacagtattagacagatcactgaagcagaaaactaacaaagatatttgggacctgaactcaacacttgaccaaatggatctaacagatatctacagagcactccacccaacaacagaatatacattctcctcatctgcacaaggcacatactctaaaactgcacatgacacataccaaatgctcagccataaagcaattctcaacaaattacgattctcaaaatcataccaaccacaccctcagaccacagcataaaaatttaaatcagtaccaggaagatctcttaaaggaaattaaacaatctgctcattactaactttggggtaaacaatgaaattaaggcagaaataaaaaaattctttgaaactaatgaaaacaaagccacaacatatcagaatctgtgagacatggctaaagcagtgttaaga

SEQ ID NO: 143029 - DNA, 166 bp, Homo sapiens
agctttggaggctttgagcttcattacccattttgaatttacaatatcagtgtgatgtagctctgttttttaagatatttcttttatctttccaattatttgggagacttttatctctagcactcttagttgctttaatcctgttgtaataatctatttgcttcct

SEQ ID NO: 143030 - DNA, 415 bp, Homo sapiens
atgcagtcgtggaaaaagctaataaactgactttagagactaaataccctaaaccaagctacactgctcctcatcaagtcagtgccaagaggcccccttcattgctgtgtggacttggtagataaagtgttctcaagccagagagatgtaccagatcggcccctcggggactcagacattgaatactctactgatggaagcaatttcatactaaagggagtccaccaagctgggtacgcagtggtgacttcggactcagtagtaaaggtgcagtctttgcctacagaaacttctgcttagaaatcagagctgatagctctgacaagaactccctggctaggaaaagaccaaaagacaaatatttacaaagattccaaatatgcttctgccactttgcatgttcatgaggctattt

SEQ ID NO: 143031 - DNA, 484 bp, Homo sapiens
gtctttcagatgtctatagtttgaaaagtatgcttattttgcactatgttacctaaagtgtaccccagactcaactatccctggggctgaatgctgatgcatgttgacatcctgagagggtctcaacaacactgctatgcagggattccacctctacccaacaggaccaacggcagcaaaggaaccatctgtaacttgccaacaatggggatgctgctaagtattaagtaactggtctctcatcaccccccttgagctaaacccagacctgcaaagaagctctagtgtgtctcaggaccaccagccaatgaagatatcacctgggtcctggaatctgggaaaaggaacaaaaaacttccttctttctttaccagaaaaattcccaagagcagatcctggcagcatgtatccatttatagctacaattgagctcagacagaagagtgtagaagaggttgggggaaatcaatactgtattagtcca

SEQ ID NO: 143032 - DNA, 1784 bp, Homo sapiens
ggagaatcacttgaacccgggaggaggctgcagtgagctgagattgcaccactgtactccagccttggcaacacagcgagactccatctcaagaaaaaaaaaaagtgggatgattacccaaaaaagtatagataagtggagcaggaatacaaacagaggggtcgtggggccactaagaatgacacaggtcctcaactggggagtataagctgtaacaatgcaaaaatataacatccaaacctctaagtgatccctcacattttacgtgtcagaccctagtggtaaccacaggaaaataaaaataaaaacaaacaaaaaaacaaaaaaaaaaaaaaaaaaaaaaaaaaaaaaaaaaaaaaaacaaacagaggggcgcggcgcgccccacaaaaaaacccccccgcggggcgccacacagaagaagacacaaacacacgacaattcgatgctagcaccagagaggaggccacacacaatacaggagggcaggacacaaaaaaaaacacaacagaagacagccgacagcgacatacacaaccacgaaagacgaggacaaaaacagcagcacacacacgagacacctgcgcgaaagaggacgcccacccaccactacgccggggcagcgaagcgagaccgatgaggcgcgaaacaccaccacagcccagaaagaaaaaacagaactcgacgcaggagtacaacatcaacacacccagcggggagtcgagagaagtggtggaaaacaaagcgcgccacaccgcgccgccgcccgggcacaaaattgccgccacacagacgcgcaatctcacgacgagaacaacactataactaacccggaggcccaacacacccactgacaacaacatccaaccgacggcagcgccgcaccgcgtacaagacgcgagcacacgcagaccgacgccacaccaacgccacccgccacgccacgcacgactgcaggctcaacacgaaaccgcatcacgcacgacgacaccagacacgagccgatcgacaaccaggccgccatcgcgcgagaccaacgacccgaaccaagcccacgccaaaaccacgaacgcagagaatggcagcaagaacaacagacacagtgaagcggaacacaaccgaaggacagcaaatcaccagacgaggacacgacccacgacacaagcacagcagcatcacagccgcagcgcaaccaccgacgctacacggcgaactgaccccaacacccgcacgcaagaacgagcactcacagaaagatgcacaccgagacgcaaccagcagtagcgacaccactcagcacacggccgacacccgaacgccggacacgccccacgacacccaccaacccccgcgccccaccgacgcgaccccgaccccgcaccgacgacacgcagcacgcgaccagcccgaccggagccgccacccagagcgcacgagggcggagcagcgaaggacggcaggacggcagagagagggcagaagccgcaggagccgcagcgagacagacgcagacacacggtgaacgaccgaggacggacagagcaggcacagcgcgagacgaccgcacgagccgagagagcacaagcaaggcagaggtcgcaaagcagagcgcaagacgacagcgcacgagcagcggacacacgaacaccgacaccgcgcaacacagaaagaacacagacaacaggagaaaacgagagagagagcgacgaacggagagacagtcacagcaggcagacacaaagaccacggaaagacacgaaacataaacaacgaggacatagaga

SEQ ID NO: 143033 - DNA, 507 bp, Homo sapiens
gggaacttgggatccaaggaatggcatggtgagttccctgttttttttttttcccttacatttcccaaattggggttgaagaagctggcaacctggaaatggaccattttgtccccctaaagcctgctttatttagccaaagggccagaaaagtggcatcctagcaagacagaaaccttttgattaataactgctctattccactcaaactctgtaggaaaaaatacagcccaatccccacccaggccagcagaggccgtgtggggactggcctctacttccacactaatgaggttataatgacgctctccaaatcccttgctggggtggtgtctcagaagggtgagtaaggatctgaggattttatccccactggctagggactagcccctaccttgtggcatcagagaagaccatgggcagagtctggacttcactctgccaggcagcagtcctctctctctccctattggagtgatcagaggaggccttgtagagagtcaggac

SEQ ID NO: 143034 - DNA, 277 bp, Homo sapiens
aggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccagtccatcccggtggccttctgagcctcacctcccctcccttcccctcccatttcctccctctccccatcccccgtcgac

SEQ ID NO: 143035 - DNA, 394 bp, Homo sapiens
caggaggatggtgggtgagttactgagaagggcagagtttgccgttatttattgatgggtcatggaaggcctggtcaataaggcaacatttgaaccaagagctgaaggaagcaagagagccatacagatatctaggggaagaatgtttcaaacagaaatattaagttcagaagccctgaagctggagttttttagtatcacccttgggagagcccatcaactaccatgcctcttccccaagagacacagctgtgtatatatcagtgtctcaaaaaagtgtttcctccaaactcccaccatagtaattcacccagtgtttatcaatctaaatctcttttgaatccattccttcctctctattcccattcagtctctcagttcagaccctcttcat

SEQ ID NO: 143036 - DNA, 440 bp, Homo sapiens
ccacttactgtttgataagaaagcctcttttgttgtaactacatattaattcccagcagtgcatgtccttgattctcaggaagaagggaagttgaaaaaaaccatataagcccatttaccatactctcattagtagtatgtactcacagaacaatccttcttaacatctacttgtcaatcataagacttaaggaaaaatctaaagtttcacagttagaaaatcaggccctgtgaagatggtggtgagggaaatgaagggactctgggtgtgggtctggctttctgctactgactcatgttggcagatatcttatttattaatttattctcaacttactttttacagatttgccatcatttgatttgtctgattaactttgatttttatcccaaataatttttttcatctgtttatcttcaatacaatattcagaatatca

SEQ ID NO: 143037 - DNA, 276 bp, Homo sapiens
tggcggtgaggggaatgtgcagcctggagaaaagggcagcaagtctgtaaacaaccagagaaatattagggcaaagaagaagtaggtgtattttggcttgacccaaaagtcagaactagagctgtactgtggaatttatacagaagcaaattttcatttagactaagaaaaactgcaaacaattagagctgcccatcgctggaaagggctggctgccaagaataagagctccattaccgaaggcattcttgcaaagactgaatggccaagcctggg

SEQ ID NO: 143038 - DNA, 156 bp, Homo sapiens
cgaacacttgacctcaagtgaacctcctgcctcagccccacaaatctctgcaattataggtgtgagccactgtggctggctacaatactatttatttatattttagaccaacagatattctagtatataagaaatgtgatgctctctgtacattga

SEQ ID NO: 143039 - DNA, 317 bp, Homo sapiens
gtcagctactgcattggttccgctgatcttggctgtactgcctcccatgtctgggttctgggctggaatggtgatcttggctccacgtggcctccacctctcattctccaggaggctaatgcagacttgttcatatagtggcaacagggttgcaaaagagggtagaagcctccacagcctcttgaagtacaggccagaacctgttaaatgtcatttctgccatactatgttggccaacataaatcaaaggctatctggggagattcaggaatcctggccattgaagagaaagtggtctacacaacttagttctcttc

SEQ ID NO: 143040 - DNA, 373 bp, Homo sapiens
ggcgttaggagatgaggtctcttcattgaatagttgaggcgtggcagcaggaagagttaggtagatacaaggaggcacatgactgaatccagtacaatctcagtatcactaagagtagaacagagagatatttatgtgtctcctggtgagttattatacagtaggaactgtgctgtacatatcttctacgaaagttaaaaaaacttcaaactcagaatttagtcagtcttttacatgagtagttctcaaatgtggctgcacaatagaatgacctggggagctgttaaaaaacccagatatccaatccaagtattgggtattaaatgatattaagaagttaattttgtgagatgaagtggcatggtggtgatta

SEQ ID NO: 143041 - DNA, 434 bp, Homo sapiens
ggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagta

SEQ ID NO: 143042 - DNA, 187 bp, Homo sapiens
ctacaagaaatgctagttattattgtactaacaattagaatcaaatcatcagacataggaaattattggcataaccattctacagatgaagaaactggagctcagagaagcttggatttcctaaggcagttgatagatggaaaatccaaggctccagcccaaggccatgtggtagtgcctctgtttg

SEQ ID NO: 143043 - DNA, 513 bp, Homo sapiens
ggtagactgtcgtcgtatgtacaatcagggcatcagctatgagtgtgagtagtcgtaagacacgatgaaggtgtgcccggcttcatttgtcaaaacgatcagagaaaagtactaacctaggaaacagtgtatcccgagcccatctttgggaatctcaattcctgcttctccctctcctccccaccccccactttttattaggggaattttaaaacatacacaaaagttgagggaatcaagagccccccaccacacagctttatcaatatgtggacaatgttatttatattttctttcctacctctccacccccaccagattatcttgaagcaaatctcagatataatatactcttagtatatttttagaacaaaaggaaatctcaaaagaccatttagtccccagtgtcacttctgaacagaaccagtggcttcataaaaaaagatggcacaacttctgctattgcagactcttccagaatttagtgataagacattaaccgttttcttaact

SEQ ID NO: 143044 - DNA, 264 bp, Homo sapiens
accgaacagggacaggctttgaatggacttttccctttatgtcactatatcaaaaagggagcaccctgcctttatgaaccccaaagaccacccactccgccatgcaggcagtcagtgagtattgactcaactgatacttttgacttagagaaagttttgatggtattcatggatacagcaaaattatctgaagttcatttactcaaatgcttacttgaaaaccatatcccatcctgaccacacctgaccctccccactcccatc

SEQ ID NO: 143045 - DNA, 359 bp, Homo sapiens
gacaggcttgcccatgatagttagaatcaatatatttccattctggtagccttcaagtatggaagttgtcccaaaatcaaactgcggatgtagtatgtcaccgtgcagcctggtgctgatggagcatatgtaaattaaattcattcgctacgatcatgcttcttccaaaggaactctcaatttcttcctaacagaaacaattcaagtatctaccctctccaaacactcttaacaatgaagttgagaggtgccattaagagatccatttctcagccaggcgtagtggctcatgcctgtaatcccagcactttgggagggtgaggcaggcggatcacccaaggtcagaaattcgagaccag

SEQ ID NO: 143046 - DNA, 213 bp, Homo sapiens
ctagtggctgtctctgttccagttgtgagtcctgtgcactaatatatttaaatccttaagtgttgaaattatactaggtcagatccactcactcagcgctctgaggagttgtccaggctactttctcatactggacatttactgtattaaatattggtttaaaggaatatattgcctggaattctacatatctagcactgaaatatttttgaa

SEQ ID NO: 143047 - DNA, 449 bp, Homo sapiens
tgcctcagcctcccacagtgctgggattacaggcgtgagccaccacacccggccagcaaactaattttaaactgattaacctttttgaatctgttatttccaatgtaggttctatctgccaaagaatcattttacaattaaaatgtgctgttttgatttgcatacttgttgctggaatattattatagtaactgttgggcccttatcctgtactatgaaactcacaggtattgaattcagtccttatctctgctttataggcgaggaaattgaggctcagagaggttaagtaatttgccaaaggttatagagctctgaagtggactttgaacttggctcctgctgttttcagaaaccatgctgcttcctgttacttttcttaatgccgaattctctaaattactcctttgtcagattgacctgggttcaagttcaggctctacagcttg

SEQ ID NO: 143048 - DNA, 1338 bp, Homo sapiens
  misc_feature (1300)..(1300): n is a, c, g, or t
  misc_feature (1304)..(1305): n is a, c, g, or t
ataattaattttatctgctttcagacttgttctcacttacgaggttgctaagtagatttcctgtaatgtcagggacttcattttatcaggaaataaaaggaacaataataagacaagagaagaacatatttcacagctgcacatttttgacagtcctttcataaatattttccttttgtttggaaataattctaaaagaaaagatagctatacctcatttgagatacagatgttagctgatactaaggttagctgatactaatgagattaaaacctttcactcttgacaaacagctcaatccaaaagatcatactttccccaaaaaaatcctaaattcaaacacagtatgtttttgaaactacatttgaaaaagggaactctaattccatttttaagcaacaaggggaaaaatatatttaacttcaattttagtgttatattttaggaaaggacaaaaactcatgatctttgcttagaagacgtatacacaattttacccgctaaaaaattactgtttttctttaagccttggccaacattccctaacaaattgctgctgtagtataggaaatggtgcctctaaatcagaaagtccaggtacaggtagttttcaaacttacagtgaagattttgctcacactcatcacacttttctaaaggtttaaatagcctcactaggagtcgagcttatgacattctctaccaatcctggtggttatcatgaaccagtacactcattaactattgcaaaggcaatttgtcagcacagtgaaaagacccaaggcgggtctgtaggcggaggtgagaggggaacaaaatatccaacgtgccaggataagaattagaactgtatgaaattgataaaccagaaaatccaagtttcataagataattaggagtactaaatatcctgagtatcttaaatctccaacattaaaatgtgctttagtacacataaagtgtctggaaggatacacgagaaattggtaaccatggctaatatatggggaagaatctaagtgttccgggctggggcagtattactttcttaagtatttttggacttcttgaattacgtatcatgtcaaatatctgatatattcaaagaaaaaaaattgaattgcatctcataaaacatatgggttgcgaagaactaccttaatttaaaaaattctgaattatttattagacatggggcctcactatgtttcccagactggccctgaatttctggcctcaattcctcctgcctcagtcttccaagtagatgggacttacaggtgtgtaccaccacacccnagtnnatttttattttccccatctattgctagagatat

SEQ ID NO: 143049 - DNA, 468 bp, Homo sapiens
atacaaagtggaaaagatgctattatgtttatgaagcaaaatagtaacttaacataatgaaggcattggaaatgactgtagagctcctctggtgtaatccatatttacagagatagctagtgatattcaaattggtgaaagggcattgaaatcatcatgagaatgtgcacagctatgaagggaagtcagccaggtgaaatcaaacagccctggacttggagctgggatccccagaggagtcctggatctgtcgcttagtgagtggctttggacaaaccacctgggctctctgggctttagttttcacttcagtgaaatgggacttctctgcctttctcactaggtgaagacagggtgcaagcaaaatgttggatatgaacaggaatgatgttaaagaccttaaaccatgggcccaatccagctcacagatgagtttggtttggctggcactgtgtttggtttggctgg

SEQ ID NO: 143050 - DNA, 753 bp, Homo sapiens
ggatcagacttggtttaacaggctctgtctgggtgttgtaatggctgagtggggcaaggatgggcctaggaggcccagaaggggctattgcacttgtctggctgagtgatgatgcggcctgaacaggaagggggtagtcaccagagggtgacctgaggaaactgtggtcaagcctctccatggtgtaaacagtaaacacgatactgattctaaggacttggtagtaacatggaaatggtgactgtgtataatgctatgtgaaaataggattagaaaattgtacattaaaaacacaccagcccagatgcaaaaggctgcagatcatatgattccattcatacgaaatgcccaggacaggcgaatccagagagacagacaggaggtgagcaattgccaggggctgggggtggggaaatggggggtgactgcctatgggaacaggtttctttttgggagggggatgaaaatgttctgaaattaggtagcagtgatagttgcacaacttcatgaatataccaaaaccctgagttgtcccctttaaaagggtgaattttatagtgagtgaattatacctcaaaaaaaaaattttttttaaggcatgtccagatttctaaccaaaattggatgcacatagaaaacattgcaaggagctgggcgtgatggtgcctgtggtccccactgcttgggaggccaaggcaggtgaatcacctaagcccaggagttcaagactagagcctgggtgatatagtgaga

SEQ ID NO: 143051 - DNA, 455 bp, Homo sapiens
gaatgtatcagtctcattgcagatgatccttgaaaatggtaacccaaatgtaggtttgtagcttagtagagaaatctgttagagataaatatatggaagttgcaggtatttggtaataaagacattagcttgaattaaaatacttatggagggtcagaaaggagaaaaaggggctgatgctgccgccaaggaactccagtgtataggaatgggcagaagaggagttgatagatgtggtcagaactgtaggaaaatggagagtgttgtgttagggtctgtagcctagagtacagcgagtttcaagaaggaatgatcagatgatagaggtgaaggagacttgttgaggtttaggaaaaaatgaagagatcattggatttgaaaacaggacagtttcatttgggtaatgtgagggcaggcagtgtattatagtagctgatgagtatttgggcagtaaa

SEQ ID NO: 143052 - DNA, 562 bp, Homo sapiens
attagccattctggcattttgtggctgatgatcagcgatacttcagacaggtgaaatagctggtttggatggtgatcaatgaagaattgaggtaaggttaggcagtttacatttcaaatctggtggaatattgaagcagaggttgcccaggagacagttgtaagttgagatatggaattcaggaaatagattagagctactgaatggattacggaattttcatttagggttgaaagttggaaattcgggactgaaaaagatctatagaaagagtgtagaggtaagaagaaagaagtacggagacacttgctttaagatcccatattaataggctaatatgtttaggagagatgacaccttcagctcttaagagttaacacctggctgggcacagtggctcacacctgtaatcccagcgctttgtgaagctgagccaggaggatcacttaaggccacaagttcaagaccatcctgggcaacacagcaagactccatctctacaaaaaaattaaaaattagctgggcatggtggcatgcacttgtagtcctagctactagagag

SEQ ID NO: 143053 - DNA, 206 bp, Homo sapiens
ttcactagcttcttgggtggggaagttgatgagccagtgaatatatagatttctttttgcttttggtatttggctatttttttctccccagggagaaatttccatggctttcatgagagtctcaaaagggtccttggatctgcctaaattaagaaccactgtcccttgatcagaaatttctcaactgttgaagctcttgtcccctt

SEQ ID NO: 143054 - DNA, 318 bp, Homo sapiens
ttgtattcacttaaagttaagaatgtactcatttaaatttaagtattcacttaaatttaagaatgaagttgtctgatatttccaagactactcaaagagtgcatggtcttctcatataacataatccatttgacataaatggtctaatgtctagtctaagtcccttctgtacaattttagttccagtcctctattttacttgtcaaaaacagttatcatcctagataatacctaattaaaggtagtaaaacatgtatttagagattccggggcttataaacaaaccactgaatatagttttcaatgttaagttaaata

SEQ ID NO: 143055 - DNA, 418 bp, Homo sapiens
ctctttttgcagatgacatgatcgtacctatagaaaacctaaacactcttcgaactgatgaatgatgtcaataaagttgcacaatatgaaatcagaaaaaaaaatcagtagtgtttctatatgccaataataactaggtgaaaaagaaatcaagaaagcaatcccatttataattggtacaaaaaagtatatgaataaacaaccccaaattaaatgttctctatgataaaaacaatgaaataaatagacgaggacacaaacaaatgaaaagacatcttatgttcatggagcaaaataatactgttgagatgaccatactgcccaaagcaatctacagattcactgcaatacctattaaaataccagtgatattctttataaaaatagacaaaatactcctagaattcataaggaacca

SEQ ID NO: 143056 - DNA, 514 bp, Homo sapiens
tccctgcgtccatgtgaggacaggtcatccttctcggtattgcttgtagccatctctgttctgtgtttccatttccttcccttttgcctggcctccatctgtatgtttctgccatttctttcttctccctgcagtgatcacacacactgaaaccagatcatctttctaacatcactttccctctctcaccagtcagcttggaggcctgcagtctctctctgttggtttggccagtgctcccgacagccctgggtcatctcccccagtgcctcagaggtcatctcagaggcagcagcctatcttagttttttaacatatcaggcttctgggccaggcttggaggttcatgcctgtaatcccagcacttttggaggccaaggtgagaggattgcttgaggccaggagtttgagatcagcctgggcaacaaagcgagacctctacagaagcactttaaaaatagccgggcatggtggcatgcacctgtagttccagctactcgggaggctgaggtgg

SEQ ID NO: 143057 - DNA, 372 bp, Homo sapiens
tcaggttgcgggtgtgtggggtcatgacctcatcctctgctcccatttccccaacagcacctaatgcacagcggacacgggcagacccttcacacgtgactatgtcccaatgatctttatgtgttggagaggcctgctttggaggtcacctggacccaaaaggcacggcttagctggcaccgtctgcataagcagatgaaacctcagacgtccctctgatccaaacacaatatgactatatgagagcaaagagattgctttaatgtcctctaacaggttaaaggccaacacagctaaagtaggggccacaggtgatggattcagaaagaaaagccactttcatgaccgaaatcggctaaggctgggccggta

SEQ ID NO: 143058 - DNA, 764 bp, Homo sapiens
tgtataaagaggcaaagtattaaattagggatatttttaagaaagcacagtataccataatctaagtacttgtacagaattccatgtttcaagtaacttgctagaatgcagcatcgtatagtgcaaaggacatgaattctggagtcagacaaatgggtaaaatactcatttttttcattaccagttgtgtgagtttgaaaaattattcattctttctgaacctcagtttcctcagtggcaaaatgaacattataatccctaacttatggtatatttcaagttttaaatgaaataatgtaaatcaagaatttagatagtaggtcttcattaatgacaccttatcccttggaatgaaatgaaagttaactgaggagatacctggtaaatacttaaacattatttctgaaattaaatattcacaaagcaataagcgctacatatgtatttattagataaatacagataaatatgaaaatataatattatttaaatattctaattagaatatttgaagtgtagtgtttaatatgacttaaggaaaattatgtctcctaagtaatgaaaagtgaaaagtgttctatggggaagaaggggctctagacattcccataaatttctttcatttgttatattgattttttaaaaaaattatttattggataaatttggtatgtcagaaaatgtgacctaattttaatctgtagtctgcttcattcacggtaaaacacttaaatgtaaatttccacccattgctgaagtgaggc

SEQ ID NO: 143059 - DNA, 362 bp, Homo sapiens
ggcagcaacagaggggtcagactccaagtctgactttgattctaattatgctagactatcccaatagcaccttgtccttttcttttccctttgaaatggccctgaaattctgttaccctttgactaatcaaagtctcactgttaatgtttctttagtagctcttataaaggcccaaaagtacttgatggaattttaaggcccataaaaatagatttttttttttctggactataaagaggaaccttgattgcttgtacatggaatgctctcatctgtggagtgagagcagcaaggccttcccagccccgctctgtcccaggtgctgaggccccctgaggcctgtgacttaatcctgctttca

SEQ ID NO: 143060 - DNA, 227 bp, Homo sapiens
ttaattagtcacatctagcccactatagcactcataattgatttttttgtattttgttgtttggaaatatattactacttagacactaagaaactaataggaaaagtactctttaccaacttttctgctagtgatgcacttccttctccttcacctcagcctctgctatctgtctgtgtctttcagcttccaaactgttttgcctgatcatgtccaatcgctgaagt

SEQ ID NO: 143061 - DNA, 126 bp, Homo sapiens
tcaaggattcccctggtggagacagctcttgccagcatctcagtacagccattgaatatagcgattttttcattcgaatgcttccagtgaaagtaatggcgtggaatcttactgatttggattggt

SEQ ID NO: 143062 - DNA, 339 bp, Homo sapiens
gttagaagaaaacatagggataaatcttcatgccctcagattagataatggtttctttagatatgataccaaagcacaagcaacaaaagaaaaaaaatgggtacattggattccatcataataaaatgttttgcacttcgagaaagtgcaaaagacaccatcaagaaagtgaaaaggctatagaagaaaatatttgtagagcatatatctgataaaggacttgtgtgtagaatacataaagaattcctacaactcaataataaaaggacaactcaattttaaaatgaaaattatgtctttatatctaagaaaatatatgaatggccaataaacacctga

SEQ ID NO: 143063 - DNA, 548 bp, Homo sapiens
tgtgatgaaatttatgccattacaagaactgcgagccatccctttgtccagcgtgtccatgctgtggatgctgccagcctgttacttagtagccaacgcagttatcagatcaactgtctcagtatcacagtgcttgtcttcaagtaaccctttatttattagaagggcccccaaagtgtaaggatagtgatgctggcaattcagatatgccaaagagaagccaaaaatgcttcctttaagtgaaacggcaaaagtctcaataaggaaaaaaaaagaggtaaggatgttaagatcttcggtaagaacgaatcttctacccatgaaattgtgaagaaaagtgaaattcgtgtgtagtatatacagggttcagtaccatctgtggtttcaggcattcattgggggtcttggaacgtatcaccaagaatacgcagcagggtagatgagagtgcagggggagatggttactatatttttaaaaatacaaccccaggcatggcactcctgggccaaatggtacgctgcccatgagataaaacctccacacaatc

SEQ ID NO: 143064 - DNA, 681 bp, Homo sapiens
ataccaacagaggtaagtttcaggcccacaagaaagttattgcttctacactcccagaaatgttaagaaccacgggagaatgccatttttcgcaaaatgaagatacttattcatgttttctgaaaaatcttgatgttaactccttttcctctttaatgagctgaatgccttgcttttatttttatgtatttaataattttagtaactatttaattgagattcttacttgcttccgaaacatcaggataaatagatacaagaggcacaatttaacatattttattggctgaacataaaggtcacaattaccaagctttatagacacaccattagaagtatacagtagatcctttgtagagaccatgaatgagagccagtgtaggcgatgtcaggaacagcaatacaaattttgagttgctgtctgtgacgaaagcccagcaattgtcaagagtttgactgggtcgcaaaagaatttaaagggccagcagctctttaagaatgcatgcgttagctttatccttatgtaacatttactgtgaggcaaggcatgccaaatattaagcaatctactgaattctgctgagtccctacccagtgattctattttcaaatgagataagtaggtgagatatacaaatgaaatcagaggcttgattaatgctgcccatccagaaatctaca

SEQ ID NO: 143065 - DNA, 283 bp, Homo sapiens
aaactgaagaggaggaagtgacatgggagcaaaacgaggggcggggaaggaccccctctcctcgtgccagataacaagctgctgtctctcagctccaagtctcgctcctatgcttagcctcggctgagctacacatctctccgttctcagccgactccttgttgaccttgcaaatgggaggttctagaaggaaacaagaaggcacttgctccttcccgtcgtgcccactgtcctgatggtggcatgtcagcaacagcccttcatgccaacaggggcggctggt

SEQ ID NO: 143066 - DNA, 444 bp, Homo sapiens
attttctgccagtgtgtataaacagcccacaccagggactttttgtagatactgttagtcatgttaagcagatgaacagggtgcatataaagtgtttgttgaacatgagagttggttgtaggaaaattcccactgagcccagtgctgcacacatattcagcactcgtgaaccaggccttctgctagattacaggaatagaaagataataaatcccagtttctgccctttaagggcttatgttctaggagagggtaagggtcatgaaatgaaataaatggagtagttttattagtgagcctggtttgtttccaaaggccagaaactggctcaaggaaaaaagagaattttttggttcatgtatctgaaaattccagaagtagcctttgactctttctgttttcctctctgttggcttcatccttaggttacatctttgtgtgtga

SEQ ID NO: 143067 - DNA, 196 bp, Homo sapiens
ggattacaggtgtgagccaccacatgtggccgccggcaaacattttctataaatggtcagagaattaaatattttcagctttaagggccagtctctgtcacaagtatttaactctgctgctattgcaggaaagcagccatagacaatctgttgatgtgtgaacatggcccctgttccaataaaactttgtttatac

SEQ ID NO: 143068 - DNA, 460 bp, Homo sapiens
gaaaacaaaagaggcaagaggcagccatccccagatagctgtgtggcaggccccaggctgtacgggacacagtggacagacaggcccagccatgccctgcagagctctcggagattccagggcaggaagcagactgtcaataaacagaaagcaaggcaaagaacatgctgggtccagactgaaccctgcagtgaagcaggtgaagcacgcaggccgccaagggcacagaccctgtccgctcagccttcacagccccaaaggggcggccctgctgtgcctggcccgaacatgctgccgtcacagccagccgacatctgtacggggctggagagcatcccctacggttcatgtccttcctggaacctcagaatgccaccttctttggaaataggatcacagcggatgtcatgagtgacgatgaggtcaccctggagtaaggtgggcccttaatccactgtga

SEQ ID NO: 143069 - DNA, 491 bp, Homo sapiens
ctgattctttccttagaataactccgagaagtggaattctggatagaagggcataaacatacttaatcctctagtcttacatagtcatactgacctttaaaactatttactaatttctctgaaaatgctcacgacatcacgtttaccaaaactgtgtattattgttaagggaaaggaaaaacacttggtcaatttcatagattaaacaacagcatctcttcattttaatttgctattgattttaaatattacttttaattttctatattttctatatgtttaatggtaatttggactttgacttttgtaaactttctttctgtgtccttggctcaaaccgaaacttcttgaaaggatgctctctctcctcacatctcgctctctgaaacctgggctctgtcctcaatccatccctcacagcacgtcaccagttggttccttgcatgctaaatcctgccagcttttcagcagttattagtagaccttcttag

SEQ ID NO: 143070 - DNA, 533 bp, Homo sapiens
ctcttgcttcctgatatccattctctctaaagcaatctctttggaaatcttggcctgtggcatgatcccgccgttgtttcctgaacacagaaggatgacagggccttatctcttggcttgtttcgtgctagtacagttgtgtgacctttagtagtaagtcttgctggacatacatcaatttgagaatcctttatagaagcacggtgtagtaggggagcttttaaactggcattgcaacaaactcatttttgaaagttgaataagtcagttggaagaattttctttcttccttttactcaaagttgtgaatgatagcgatcagagcaactgaaagctgtggctagtgatatttaaagccactactcctgctttatgccatgaacatcagatttaagaagagtaaaactggccgggcgcggtgtcacgcctgtaatcccaggactttgggaggccgaggcgggcggattacctgagctcaggagttcgcgaccagcctgggtaacacggtgaaaccccgtctctactaaaataca

SEQ ID NO: 143071 - DNA, 898 bp, Homo sapiens
gtgtgtgtgtgtacacagtggctcaattatggatcactacatcctcaacctcttgggttcgagcagtcctcccacctcagcctccgaaatagctgggactacaagcacacgccgtcacacctggctaattattttttgtagagaagggggttttgctacgttgcccaggttggtctcaaactcctggcctcaagcaatcctcgtgcctgggaggatcttaacccaagaagacaaggaatgcttcttgaaagacattatccaaatgaaatacagtgagagttgctaaatactttgttactagtcttccagttaggacttatccttccagggcaaatgttcagacctgggggccgcacattttcctgaatgcattccaggttggcagcacataagacttcaattgagggggaaggtgggctgttcacctgcccaggtgctttagcccaactctcctgccccaggtgcaccctggacagccaagtgctgtctgtggcactgtaatcagtggcgtatttctccttactctatatttaccaagttgatatactggaaggattccaagagcaagcgagtgatagcagacaactgaatgcagtcatgtctttccatgaaaactgcttttcttggctttcttccaacaatggtaggttgccaagagaaaatgcttttggctttacaaatgatctggccgtagtctggggtggttctggttctttatgtcattgaaaatgataaatatttctggctattcaattatttagcaaacttttgctcttgatgtactgaactgtgttgtttttttacaccttatatgaatttgtggttttacatgtataccaacttgtggagaaagatgctaaaaaaactccagcttgaaaaatatgtcaggttaggctga

SEQ ID NO: 143072 - DNA, 661 bp, Homo sapiens
tctctgccatctgcaaagtgtcacgtctcttagtaaccaccccttccccaaatgtcagacgacgaacacagcacggggcttcccaaagatgtgggtgttgggaggctggcactcatctgttccttgtcttggggagtagactctggtcccccctgggccacactgatatacagagttcaaaatagaaaagaaatgccccacttcccaccggcctactttccaattcagagctggcattagcaagggaggcaacgggaggcacagagactgggaggaaaaactcaacctgccgattcttcaactcagatttgtgcagatggcagattacttagaagtcatgatgcctcttacagaacacagtgaaatatggacacgtcaaatggaatttaaaaatggaagagtgtgtgtgaaagcaggttccatctaatactggactgaaagttttaagtaatatttgtgaggaaaaacacaagcaatttctacccactggtttttatctttcctgcccaccttctcagttcccaaaccagaatgggaccaccattcctaaagctgatcagtggccctgttcacagaacacacagtggcacagtgtgcaaaccgaatgcatcatgagtaacgtggatgtccacagattcaaatggaggggccgtgggagcag

SEQ ID NO: 143073 - DNA, 102 bp, Homo sapiens
ccccttactttcttctattgatttaaacagaaatttacttggatgtgacccatttgataaggaccagctgataaagtataccagctgattcaaataattgct

SEQ ID NO: 143074 - DNA, 945 bp, Homo sapiens
atctttatggtaggatgatttatattcctctgggtatatatccaataatgggattgctggatcgaatgatagttctacaaacaatacttatcaaaacttgtggttgcagctaaagttgtattaagagggaaattatagccttaaatactatattaaattaattaaattctggtaagattggtcaagaaaaacaacaaaaaagggatgaagataatgctaatgcaaattagaaaatgttataaattttaatcatatttaaataaacttatatgtaaaataatcagttatgagaaaagtatgggaccaaaacattcaaaaagaaatagaaaatctgaatggccctatggccattaaaaatgttggtttattagttaaaagttttccttccctcaatactcacctgagtttggacagatgctaattccagggttacataagctttttcaaaaaacgggggggaaaagtagcaattctcttttcattttctgagtcttatgtactacaatcttgttaaaaaaactagcaaggagagtaagaatgaaacttaaaagctagtctcacttaggaacctagcaaaacaaccccaaaatccagcaatgtataaaacagataacatgaccaaatttgacttattctagaaatgcaaggtttaattaatattagaaaattgtccaaaatatttacacattaatgaaattatgttactacacattataggcctttgcattattgatttagtatagtcttagttaaatctgagaatgccaggtggctggagagcatgttgaataactaaaattcagttttgagtggaatactgtggaccacagtagatggcacaattaatttgattaaagggagtcagatggtctctcagaggtggcaaaatgtgagttaggtcttgatgaataatatttttatcagcatgtttgagatttcaagtgg

SEQ ID NO: 143075 - DNA, 301 bp, Homo sapiens
gtaaaatggggatgataatgtttctctcatggagtttacattgaggacaaaataattatttgtagaaataccctataaactgaaaggtactttataaataataatttttaggccaggcacagtggctcacacctgtaatcccagcactttgggaggccaaggcgggcggatcacgaagtcaggagttcgagaccagcctggccaatatggtgaagccccatctctactagaaatacaaaaattagcccagcatggtggcgcatacccttagtcccagctacttgggaggcccttgaacccg

SEQ ID NO: 143076 - DNA, 300 bp, Homo sapiens
agtggctggaaatggcaccactgtttgatatccttcattttcctttattcttctttgctaaccatccttagctcttgtctctgagctttcatttctaagcggcaattaggaaatgccttggtggatcttctccttaacttgtctctctttctcatttcccttctcagaaccacagcattgtctcactgttctgaccttttatttatatatggtacaaattctctcatctctttcaactcttttatagtccatttttccccttggcaacaaggggcatcaaaaacttttctatctcctagg

SEQ ID NO: 143077 - DNA, 487 bp, Homo sapiens
ttgcatgagggttctgagaagagtatgggtaactatttgggcaaagaatttgagatctataggccaaagggaaaatataaaccccataaaatgtttatttacatatggagataatagttagaattatagcgtattactttttttcagcctaagggctaaaacataatactccccaggttacctacaaaaattgtttccttggaaagtggtaaggggtactggatataacaacatgcatctgccacttcacctagcacctaacaactgtgaagacatgtgtttgtttactttaaaagctctcagtgataggaagatttattaaagaaatgaaacatttcacctctaaaagctcacagaaccctgtttttgttacattagtcttgccaggagaattctgaatgtgtttgcattctatcagtcgacagtgtgagtcagtgtgtcccaaaccagttttctaaccagaaagctgagaagtttgatgacacat

SEQ ID NO: 143078 - DNA, 304 bp, Homo sapiens
acacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtca

SEQ ID NO: 143079 - DNA, 181 bp, Homo sapiens
aaagatcctacaatagtaggacttgacttagaggaaaggcttctatgagaaagtcatgattcagatctggaaaataagtagatattaataaggcaaaatgtatggaggtaagggagccagtagaacattctaataaaagaaatgacaaatggaaaggcctcatggtggaggaagcataatg

SEQ ID NO: 143080 - DNA, 134 bp, Homo sapiens
gaagttggatgagcttaaaaggaggttcgaaatattgatcctctagaatctgccttctcatcaacacttttccactgggactttgactccccaatcaggcttcacagaaaacatagctgaccaagctcccggag

SEQ ID NO: 143081 - DNA, 185 bp, Homo sapiens
ctgttgcgaggaatgctgagggcaagtacaaacctttatgggataagaaacttacaagtcacacataatttcttaaatgaaaaaagttctaattgatcatcatgattcttattattctattgacctgggttggaatctcagcgtggccacgttctactccctctgtgcctcagtttccctctctg

SEQ ID NO: 143082 - DNA, 376 bp, Homo sapiens
tgtcttctttctacttcttcttgaatatacttttcaaacaaaatttacatgaatcatctagggaaggaaaaatgatgcttttaactctaggtgaattctgtttcccaaaaagcttttcaaaactctacaacaattcaacaaacatttttgagacaattattatttcaggctttcgtgagcattattgcattgagcattgtttcaccattacacttctcttgagaaggcataaatgttttcattttgcagatgaaacagggaaactcagaaaggatcagttgggctgtatttcatgtaaaattagtaggtggcaaagattatatcagggctcaagactacgagccttgacataagatgtgtacttaatgcttatttt

SEQ ID NO: 143083 - DNA, 487 bp, Homo sapiens
tcggtaccctctggatgcaagtgtccagtgatagatggtgtttcaggaaatgacagggacatggaacaagccgtccccttcttgtcttccctcttgtaacttaaagagtgctaacacctgctgccaacccaccccctcaaaactgacaaaaacatttcagttcctcagaagcaggtgcctgaaaatttgaagtgttaattcagtcatgcaaatcaataccaggcgttgaacctaagaggattcaggtaagaattgaagaaatatttcaggtctttttccctaaatgcctttcacaattaggccacaattcagaggtcttattctatttactcattttatccatgagttcagaatgcagcaaaaattttcttcctaggcctctcagaaactattggagaaaaaaaaatagaagaaaggaaccgaatatcccccatctagcggccacaaaccagacatagtgacactttgcatccagagatttatcttc

SEQ ID NO: 143084 - DNA, 370 bp, Homo sapiens
agggctgtatacaatcgccttgcaagtgtgcaagctatgtcagtccctacgatatcagtgcctgaaaatttgaagtgttaattcagtcatgcaaatcaataccaggcgttgaacctaagaggattcaggtaagaattgaagaaatatttcaggtctttttccctaaatgcctttcacaattaggccacaattcagaggtcttattctatttactcattttatccatgagttcagaatgcagcaaaaattttcttcctaggcctctcagaaactattggagaaaaaaaaatagaagaaaggaaccgaatatcccccatctagcggccacaaaccagacatagtgacactttgcatccagagatttatcttc

SEQ ID NO: 143085 - DNA, 256 bp, Homo sapiens
tccgtcctgagagcaggcagtctggattttttaaaatgttaattccagataatccttaaacttgtaaacattaccactgagtttctagacagccatgagcttgaacagccttccgagtcaggtgctgagatgccctttctccaggctgagacattccggttttgtggtggaaaattggaagagaatgtaaaattcattggttcaggtagagagagaaaatatgtctggcctcaggcatcagggatggtggatggaa

SEQ ID NO: 143086 - DNA, 105 bp, Homo sapiens
caaccccctattttaatttgggatgtttcacagggcgagaggggtgcaggggatctccacagattgccattctccagccccaccacaagcccctgggcaccctct

SEQ ID NO: 143087 - DNA, 310 bp, Homo sapiens
gtttgcagagagtgaaaggagccaacgcaggatagaggcaagccagagcaaacagctctaggctggggtggaggtggactctggcaaatggagaagaacttgggatggaactaactctctgccccaccaagggcatggggaatagcaaagccaaaggggggccatcaattttaagcaagatatctcttgaggaagtactcgctgccaagggagtccatgtttcatcagccagtgggcagatttgactggattgccaaaagggctggctggcctccgggctgccaatcattccccaaaccctgcgtacggg

SEQ ID NO: 143088 - DNA, 756 bp, Homo sapiens
agagatcgcgccactgcactcaagcctgaatcgcaccactgcactccagcctgggtgacagagtgagactctgtctcagaaaaaaaaaaaaacaacagaggaaagaattagacaatcagacttgaagacagaacaataataaattacccaaactaaacaacagaaagacaacagactacgggaaaactacaacaaacagagcctcagggacctcttagactctaacaaaagatccaacactcatgtcatcagagttccaaaaggaagggagaaagaaggtagggctaaaaaggtattcaaagaaacaatgtccaaaagtttcccaggtttgccaaacaaagatggacccattcaggaggctaagtgagctccaaataagtaaactccaaaaaatccaagccaagcaagatacatcatagacaaacctaaaaaccaaagacaacgagaaaaagaaacaaaaaccaaaaaattttaaagcagccagagagaactaataccttatctttaggggaaaaacaattagaatgacaaagatgtctcatcaaaaatcaaggaatccagaaggaagtggcacaacattgaaagaactctcaacctggattctatatctggcaaaaatatcattcaggaataaaggggaaatcgagacaagctcagaaaaaggaatactaacaatttgttgctagcatacctatcctaaaagaatggctaaagaaagctcaagaaaaaaaaatcataaaagaagggactcaaaca

SEQ ID NO: 143089 - DNA, 630 bp, Homo sapiens
gtctgcgcggtgcgtgcggagctccctcccgggacgagactgggaagagcgaggcacgtggaggcggcgcgactgaggctgctggaggcgaagcggctccaggggcgggtaaggggggtggacactcgggactttgggggaaagggaggccggtgtggaaaggaccggagaggcagaaccgagagcatcggcaacagaagagacccagcacccatgcctcttttctgctgggcccttttcgagcctggaagggagagacctggaggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgaccaggaagcaggtctccagccacatccaggtgctggctcgtcgcaaagctcgcgaga

SEQ ID NO: 143090 - DNA, 398 bp, Homo sapiens
agacatttaccgatagtgacaattatttcacactctatttataattcattgaggtaagcacacagggacgaaggagtcagccagcttctaaaagctccctccccattttgattggcgttctctgggggcccagtggaacattccactttttcaaggtttcctcttgatcctcttggctggaataaatagggaatgctcaccaggaggcttaatcccgcctcttacttgactaggcagggagcctggttgggtcagacatgacaacagagacctgccaacccaaccttaagataacggggttatggcaaaagccaaacgctctgaacttttttccgcctatttttctgggcgtggggcaagatagatttcccttctaaggacctgctttaggtggatag

SEQ ID NO: 143091 - DNA, 344 bp, Homo sapiens
agatgaggttgataggtgagggatttatccagaaatgaacagggaaggaaggagaattaataccaatatgtgctattgagttggccattgcaaggggtgactgattgttcagtcctcaggagtttctgagaagccttgtgaagctctcaaaacccttcttctgaggaacagagaggaaaagcatttatctgtcagcttttgaagtctattgtcaaaagttgaccacaaggcattaattcactggtgttcctgtgttgagcatgcatctgtgcttggttcctggaggagtcctatgttgcatagtcaaagaagccctgaggcaaaagtgaggaaactaggtgcat

SEQ ID NO: 143092 - DNA, 282 bp, Homo sapiens
ctaggtattgaaactgctatacttacgtgagaaaatcggcagtttggcatgtacacatctgtgtacaccacacctgcatattcagtctgatacacacaaaccaccttattttaggtatatttcacctgtgtatttatatgctatggatgctagcatctatacactcacatgcccaaagttaatttaatacattcctttcctttatttcaacctttgttttttattgtgtaaactgtgtggctgaaatatctgttccatttgtctaaatatatggagggagtg

SEQ ID NO: 143093 - DNA, 226 bp, Homo sapiens
ccgaggggttaggtgacttggtctggacttaaaacggggacaggaaattagataccagcattcatttttctgatttacaaatcctttcctgtataaaactcttccaaggcacatatgtgaacatacacagttatgcttcagccggtccctcccatctagagaatccaaccaaggacacacagtgtgtctagggagaagaggttattctgtggcacaggtggctctg

SEQ ID NO: 143094 - DNA, 375 bp, Homo sapiens
ggccaggagtttgagaccagcctgggtaacatagcgagaccccatctctgtgtttttaaaaaaaaattaaaaaaagaagcatttccctcttaaaagctagaaatctggtacccttagtccttttcctccctgtctatttctctattccacacaatccaatctgccatcacatgttatacattgtatgaaagaaagaaaagctctccctttcaaacataaacaccttagggtaccaggcaattcatgtaaacacagcaagtcagctaataaaagacagtagggaggggtggggtctgtggctaactggagaatgctttctcagctctaggacttaagatgtgccagccaaaacctgtctgtcacccttgttgcatg

SEQ ID NO: 143095 - DNA, 718 bp, Homo sapiens
acgcgaagtccccgcggggggtccctatccaacgggttccattccggttaagcggttccttctccaggggtttttcgcctcgccgctgcctctccgcccctgcgagcggggctcagcgaacagccgactccggggccattaccattgttcttcgaggctgggccgcaggggaggactctcgcaagccagacctcgcctttggtctttccctccgccccgcacccgcgccgctgtaagccagcgaagcctccctcgccgatctttgccgaggaagcgagttagcccctgagccctcccgaacggcggccgaggacgcacccgagcgtctccgaagaatcccgacccctagcagtctccggaaagagccgaagaggcttcccaccctcggtttcccgagccattccgaaaaagtccgaagttttccgagcagccgtcctgccggactgctggaggcggcacagcgccatgttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggc

SEQ ID NO: 143096 - DNA, 694 bp, Homo sapiens
acgcgaagtccccgcggggggtccctatccaacgggttccattccggttaagcggttccttctccaggggtttttcgcctcgccgctgcctctccgcccctgcgagcggggctcagcgaacagccgactccggggccattaccattgttcttcgaggctgggccgcaggggaggactctcgcaagccagacctcgcctttggtctttccctccgccccgcacccgcgccgctgtaagccagcgaagcctccctcgccgatctttgccgaggaagcgagttagcccctgagccctcccgaacggcggccgaggacgcacccgagcgtctccgaagaatcccgacccctagcagtctccggaaagagccgaagaggcttcccaccctcggtttcccgagccattccgaaaaagtccgaagttttccgagcagccgtcctgccggactgctggaggcggcacagcgccatgttggatgctctgctcgttgagtgaagaaaatccaccggcatcgcctgagccccgctaccgagaagggcgccgcttcctccggggagggggataaagatcccccgccgccggcccatgaggatattgccgtgaaaggtccggtctctccgcctcctgcccccgccgggtccggccccccccctggggtcgcgttgtcacggagaccggcagccggtggtgctggccc

SEQ ID NO: 143097 - DNA, 744 bp, Homo sapiens
catgcagggctattctgtaaaatcaataggcaccaatgccagctgggggcttctccaccatcttgatcattcactgaaagacaccatttaaggttctaaacttggtcagcacagcctgacttcagaaggcaatatagcacagcagaaagaacagtggggtattagttagaaagcttgggtcaaagccagctctgcccctcaattacggaaagacctcagatgagtcacctaacttccttgagtgtcgatttctttaaaattgagctagtaatttataatttgtagtgtctgagtgagaatgagatgagaaaccattggcaaaccctcctattacatatgtgacactattaactttgtgtttgtgtgttttaccatcacaaaaggacatatatttcgagccaactaaatgtttgcaacctactttttacgtttcaaactgaagtggcttcagcatgaagggggctgcgctttggtccagtggatatgttttcttgtaagaaagcacagctaggtgtctatagaaatctagagagagaggagagaatatgtgctcttaatttattgttagcattagaaagggtaggattaagggggatatgtttttcattctgtcagcttgaattctctttccaaattccattctggttatatgatcaggctactgctgtatttatgggtggccacagtctgcctggaggggcatatttagtcagaaaggaagtgttttccttctaaaggcaggca

SEQ ID NO: 143098 - DNA, 209 bp, Homo sapiens
catggatttgctggtgcagtacaactaggcttaataggaccaagtggaatttatgcctgggatacaaggatagttcaacatacacaaatcaattgacacaatacatcagattaacagaataaaggataaaaatcatatgatcattttaactgatgctgaaaaagcactggataaaattcaacattcctttatgataaaaaccctcaaaa

SEQ ID NO: 143099 - DNA, 635 bp, Homo sapiens
ctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacgtgtatacatatgtaagtaacctgcacaatgtgcacatgtaccctaaaacttaaagtataaaaaaaaaaaaaaactaagatgctttattacttttccaaatattttttatgaatatctcatttaatctgtacatttactctttgaaagatgttttttcaccctctttttacaaatgaggaaactggaacccaaaaagaattaaattaggtgattaagaacacaccagtgttaggtggcatcatcattacatttttctacatcttccactctttggattttctactcctgcttcttccttactaattcccttttataatttgtacccatgttgctccacttgagaacagattttgtattaattgatttttctgtattgcgtttgtttttactttcattgatttttgctccattctacattctttaga

SEQ ID NO: 143100 - DNA, 522 bp, Homo sapiens
gttcaaccattacttcagaacttctattatgagacaaatagtgctggtcctcttgagaaaccaagggagtgggctcagctcagtgactgtctggatcagcccagaaacaatgtaggctgccatcttgatctgtgcttttccccagggacatgagcaagggcacttctaggccaagcaaaatcaatcgtgtttcatagatttggatttagagggcgctctaaaccagctcagaggaatggtatgttttagaatcctagggaaattgagttctccaatcatcacttcagtcagctaggaaagatacacttttggcagggtgcggtggctcacgcctgtaatcccagcactttgggaggtcgatcacaaggtccggagttcaagaccagcctggccaatatggtgaaaccctgtctctactaaaaaatacaaaaattagccaggtgtagtggcatgtgcttgtagtcccagctacttgggaggctgaggcaggagagtcgctggaaccagggaggcggagttgca

SEQ ID NO: 143101 - DNA, 472 bp, Homo sapiens
tggtaaagacagataccactaagccctttcaaatcactgagagaagctgaaattttaatgagacatgaaaagtcagaatcacagatatctgacaaccaaaaatgtggtcaacaaatttagaaatttagaaataaaatacaagaagttaaataaagggtcttaactttcacaaccttcctgtcaggataaaaggctgaacactattcataagttgctaacaatgcttttattattccagagctccatttaaataaccaaagctaaagaaaaattttaactatggggtaatacagtgcaggaaaattattaaaccattcaattgataaattctgtaaaccaaaaataaaatttgaagcccccccaaccaaccatctgaatgaacttcctcctctaggccagtgccctataaatttaacctgaaagaccggttcaggccatgacaaaaggcaggggttggacttgcctcatcatg

SEQ ID NO: 143102 - DNA, 133 bp, Homo sapiens
gcttgaaaaataattcattgatttccttggaataagatttttataactttctttattccatagaagtcaaggaaagatatagttataaaaaatcttctgcaggattgcattagtgcctctgaacgattcacat

SEQ ID NO: 143103 - DNA, 1300 bp, Homo sapiens
tcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccgggggcgggttcccactgtagctggagcgtggttgctccgaggccagcggaccctgcgaccgccctcctcccgtccctatggggccacattgtgcgtggcccgataggcccgggcaaattaggagagtgccaatatgggcggggcagatacaatgggagaaagccagacgcatgcccggacggacagagaagagcagcaattaccgtccggtgcgagagtgccgacagggacacgcaccttcccgtcagcagatacgctgccgtcggaggacggacaacgggcaggcccgtggcggagcagaccggcgcaggcggcaacgcaggacggagtgtcaatgccccggagacagcaaagagccccgaggatccaattaacacggggcgacttcaaccgacccacattgaacggagttcccccggaaatggtagataatacccggacacgccttgtccggtgcttcaattcgggccaatttcacaacccgacaaaaccccaggggatggatccgccggttggcctttttaaattccaatgacttttaatccggcggggatcacacaaaataaaagcaagggttagggcatggaaggcttgccctagacgaaacagtgaaaacagttgccggtccttacgagaccccgagagcccatcacagttagttacggaccgtcacctcaccgctaacaagttactgcagtgcgtgtacgccggccacactccagaaagcttccggagcagtgcatgcggtacggaagaaagggccttggtgcttggacaacaattcctaatccaacaatcaggggagacgtgatatagcgcccccacaactctccattgaaacaattgcctgtgcatccacttttggcagcgacaccacaggccttgcgcgcaattgaagtcaggtcacaatgtggagacacatagcatggacagaaagcatccacttacttccagccgctgaacatgctcgagcaggggtgtggatgaccgccagaagagtaggctcgtagacgagtactgaggcacaaccaaggccaccaaagagcccccgactgagaggcgaaatgatccaaagagcagacgagccacgacacaggtagggcgcagcagtgaccagacacgttgcag

SEQ ID NO: 143104 - DNA, 104 bp, Homo sapiens
ctcaatgtatgccataaagcaggggttttaacaacacatttgaacaattcttgaggattagaaaatgaggtctgttaaccagttcagaattttaagaaaacaaa

SEQ ID NO: 143105 - DNA, 564 bp, Homo sapiens
aaaaagatataccatgtaagtagtagtcaagaaaaatggtagaatggctatatttaggtcgaacagaatatacttagagtagaaatcagtactagaaacaaagacattttataatggtaaaagaatcaatagtgaaaagatacatcaattatcaacacacctcaaaacaaactttttgtagatatatgaaaagaaaatctgtgatatttaagggaaaaacagatattttgactgaagttgttgaaaaatactccacttttgatatttcatagaaaaactggacagaaaattggcagagttttagaagacttgaataacattgtcaatctgacataacagacatccaaagaccacttcagccaacagtagaagcatgcacattcttctcaagcaagtgttagtaacagtctccaggggacaccatatttaagactaaaaataagtcaataaatttaaaatgcttgaagacatacaaaacagttttctgtcaataaatttaaaatgattgaagacatacaaaacagttttctgaccaaaatggaattaaattaaaaatcaacaata

SEQ ID NO: 143106 - DNA, 468 bp, Homo sapiens
ttccaaaatactgggctgagaacgtgaggttctgaaaaaccttagcaatagttgggagacaataacaaaacagttgacaacacacctacacggctattggttcttctaagtgtgaccagatgctgataagctgcattaatattcaaacaaaatgggcagaaaagcaggctactgaacatgcaaatcagaaaagggctttaactggtggttttatgtgcagctctgccctagactatttatgtgactctgaagtcccctaattctcgaatgtttctattccattacatgggaaacaggatccatacaacaacaaatatctgagtacctttgtgccaaacacaattctaaatggttgattaaacatattataataaattatatggtatgttagcaggtgataaatactataaaaaaaacagagaagagtaaggatgattaagagtatatgtgggtatataatagaagtgt

SEQ ID NO: 143107 - DNA, 969 bp, Homo sapiens
acagtttaggaattcttgtttttataggaaaaaaatctgaattgtaaactattgactctgctttggaaaaacaaatttctgaaacaaaccttgtttgttagttgggggttatatatatgttgcatatttatgtatatatgtatatttatattttatcaaaaaggaaagagtttaaattttcttaatctggtaaactaggtacaactttgaatgggggaagaacattacaccccacaccccaaacaaaattatcagaaaattcatggtcatttaacttccttatctaactactaagaatgcttttcattgtgttccagatctctgattatatgacaaacaatactggttctgaatagaagtcttcctataggccaggcctggtggctcacgcctgtaatcccaacactttgggagaccaaggcgggcggatcacctaaggtcgggagtacaagaccagcctggccaacatggcaaaaccccatctctactaaaaatacaaaaattagctgggcgtggtggcacacacctgtagtcccagctgctcaggaggctgaggcaagagaattgcttgaacccaggaggcagaggttgtagtgagcctctgcagtgatcacaccactgcaatgcagcctgggtgacagagtgagactccgtctcaaaaaaaaaaaaacaaaaaaaaaaaaaaatttttgggcggctgggcccgaaaaatttttaaaaccatttgttggggccgcgcggggcgccccaaatgagtggaacgggaaaacctgggcgcacaaagggggggtccccagagaaaaatcccgggggcaaaagaacaaatgcgggggggatctcctaccccaagataaaaaaagcgcccgggcggcacaccagcgcttcctgcgaacaaactccacaaatgggttccagaggggcaacaggggccctcaaacagggatcccagggagcgcaaaacgaatagcc

SEQ ID NO: 143108 - DNA, 821 bp, Homo sapiens
gaagcccacggtgagtctggggacccaagatcttattttcctttctgtcacccccgcttggttttggattccgtgacagctggacccggcttctgcgtggacataattggagacactggttattttaccaaagctttgaccggaaggatgtacttttggatacaaacagactgctttaaggagtcaaagctgacttatgaagttggcctcatcccttgtctacacagtcactgtacagagttccttgcctgtagtatgtaaagaatgtcactttctgacaggctcaggagccccaaattatcctgggaccttgaggagaggacattgcccaatttatataggtattttcaggcaccaataaatcatggctgggctcaaggctttaaaaaaagtcaaatctgggattcgttatagaataaagttccagcaaagccaattttaagacaggcctatatggcaaataattattcgtgctgacattatgcaaacactcaggccaagtataagatgaaaaattattttaaataaatttgtcctactatgatttgtcttcagtaaaaacaggtactgggctgggcatggtggctcacagctgtaatcccagcacactgggaggccaaggcaggcagatcgcttgaggtcaggagtttgagaccagcctggccaacatggtggtgaaacaccatctctaccaaaaaatataaaaattagccaggtgtggtggcatgtgtctgtaatcctagctacccaggaggctgaggcatgagaattgcttgaacccaggaggtggagcttgcctgagtcctggtaaggcacagaca

SEQ ID NO: 143109 - DNA, 367 bp, Homo sapiens
aacctttgcctcctgagttcaaatgattctcctgccgctcagcctcccaaggagctgggattccaggcatgcgccacgacgcccaactaatatttgtatttttagtagagacagggtttcgctggtctcaaactcctgacctcaggtgatccacttgccttggcctcccaaagtgctgggattttaggcgtgagccaccaccacgcccagcccttgtatgtgtattgtaataatgtttactttttaaaaatcaatacattatttgttacttttcagttttttttcctcttagtatttattcttaggtatatgtgtggtttttgaaaagccatcttctgactttaaaaagcactaattttgtggatgc

SEQ ID NO: 143110 - DNA, 366 bp, Homo sapiens
tgacaagcctcttctgcaagaccagattctgaaaactcaaagcaattatttttatatagaggcatgctgcaatcattcagattatggggtgttctataggaatatgtctcctggtttgacacagactgcattttatgactttatttggacaaggaggaaatgcaaatgttaatatttattatgacaccaatatgttaatttgtaagtcctcttactttgtttttcgtttttgaaaactacctctctgattctgcttacttgttccgacaccacctttcaatgtgaaatcattttggtctgtttaataaatatttgtggatattaaagagggaagcccaaaagcaaataaagcttcccaggttgagt

SEQ ID NO: 143111 - DNA, 374 bp, Homo sapiens
caaactgaatgcactaaggttttgagcaggactcaacaatgattgagcaatgtcagaatggttgagaatcccaacctaagagtcccagacttcagagaagtcgtctgtgatttgcttaatgaaaagtcctggtgatcagagaattcaagcagtgtaggttccctctccaaagcagcccctaccccactgacactccactgataagttgataactaagcagtgactggtttatggcagctctccggattcatgtctctcagagcactgcaagcaccctggtggcattgggagggtacgatttgctaaagagaggcaccattccagtcaaggtaagaccaggccaaccatgccctgcctgccctgtttgggtctct

SEQ ID NO: 143112 - DNA, 400 bp, Homo sapiens
cctcttgcaaaagcagggcactgtgcaagggttggggtttaagtcatttatttgggaagtgatcctgacaagtacagtgaaggagtgggaaggaaggtgggaaggaaagcaaggaagagagggtttccactctgagccactgggcgcagtcctgctgtggagcaaatatgcagagagtatctgacaattgtctccccgcagcagggaagctgagacattatatatccaccaacctccgtcccttgttggttgggggctgctcctattaattccttagcatttcctgcatgtcccatgtgcaggataagcaatctgctgtggtcagagaaagacctatggtatataagaatttgacatcataatagaaataggcatctatccaaagcctcatttatttcag

SEQ ID NO: 143113 - DNA, 560 bp, Homo sapiens
tgccccccgagaccctgcacttctgccaggctgagggtgcatctctttcagcacctccatcagaccaggggccgtaacaaaggcggatctgaagcccctgcaagtgggaggggcggctcagtgcatggattgatgcacagatgagtaagagaccctcacacacttgcacccatggccagcatattccaagttgcccagagcacactttgggatacaatccagtgtttattacagatggaggctcagttttctggaaaagagtcaacttgtggtcagacacctgagtgtgttgaatccccaccacgatgctgggtgtgaaacatagaattcccattttacagatgaggaagctgtagcttagagaggttagtaactaggtcagtgtcgcacaggcttggcgagctccaagcctcattttccttacctgtaagatgaagataataacctttgtccaccgtgcaggggagctggggcgctgacccctcagattccctccagccggggctgtgccttgcctccacccatgcccagagtgtggggcagaatatggaaacatcctc

SEQ ID NO: 143114 - DNA, 168 bp, Homo sapiens
acatggtgtgcccatagataacccaggaagaacttccctccaaaatccaaattcctaggaaagcaacacattaataaatgaaggcaaaggtcattaaagtttcttttaagcacattgcctggtttccttgaggggcaatgttgatttatttttcttattttatttata

SEQ ID NO: 143115 - DNA, 525 bp, Homo sapiens
ttgcggtctgcacacagagtgaaggtaatattggattcttaaagctgaggataggtgttgggatacacctgctgtgaaagacgggccattgccactttgcaggcttttagattacccaaactgaggagttatttcttctggtaaacatttttcagatggggtgcggaatgcctcgatctaaccagcgaaggtatcagtaggcattagcaaatatttgaatctcctgcagaaaggtatctgagtaaattagagttgctagctctcacctgggtaggttcctcaatttttttttttggacaggtttacctggagaaggagaaaattgctgttggtttgggtcatgtcaggcacagagctcacagggctgagtcacctgctttcctgtctcaaaaagatttacccctataaacaaatgagacattaacagaagccaggaatcccttctagggtgaaaagaatcattaaagtgctgaattatattcctatgattggtacttggcattagtaatttattaccatcattca

SEQ ID NO: 143116 - DNA, 283 bp, Homo sapiens
ctgtaggaggccaaactggacaacgagaggaatggctgcagggaaggcctgctaggatagaaagcaacaagtagcaaacactggggatgattgagtcagagtggccgcttgtccctatttcctcacaccagcctggactttggaacacgaagccctgatcctgagggagactctgccggctcactcagtagcctgcctgggaggctgtgtcatctcctataaattaaaccttgtgctttctaccctggcaggccttccctgcagccattcctctcattgtcca

SEQ ID NO: 143117 - DNA, 271 bp, Homo sapiens
taatgcaaccgatgccgggtacacaaatggagatgaagagcacttcaaaaagtgcttgagtgcacaaatggctaccagaggattctgttcttagatggcatcagctggtaaactcagttacttaaaggataatgttaagctgtatgctcagttgcaatgtgggtcagttaaatttagagatgctccttggtcacaaatcatggttacattgtaatcatggcagttagggtaacattattatttgtttttgtttttgtttttctgagacaga

SEQ ID NO: 143118 - DNA, 485 bp, Homo sapiens
tcggagacagcaggggcagattcccccagcagggcaaagcaaccctgacctccaagttgcaagggaataggtgactcagggagtacctcctgcagccctgctggtctcaagactcccaccttccagggcctggtcctgtgctcagaaacccctctgcatagggtgctgatgagtcctctgcagctccctcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcattgctcagtaaaccttaggttatccaaactgcaaataaaatgttctctactttctagatttttataacttgctattttgagagaaag

SEQ ID NO: 143119 - DNA, 372 bp, Homo sapiens
gcattttataagtgacataatggcagagtaatgttactaatttttcatattaatttaggtcattagtaatactttatttcttatgtggtaaaacacattaatcatgaaaatattttctagcttagttttaaaaattctttgccatataacttttaaataaacaataatatttatcccattgtgtctgcaaatgaaaactacatcctttagtattgaactgataacgttttttgctctcagaaagttaccttgttcagtgctagcctataatggtgtttgaagtttaagagtggcattgttgtttgactcagcaaggaaatatataggaaatattgtaatgaaaatagaatttcgagtggtagtagattattt

SEQ ID NO: 143120 - DNA, 281 bp, Homo sapiens
tgagagtttagaaaaataaacgaagaatatgaaaaacgatgctggcaataaataacgtaaaacttagagtgggaatcccagtgtattattcatggactgctccgttaagactaagtattattttccgtattaggtctgctgtgtttttcagaatgatacagtaatctgaggattgagccaactgtcttccttgcagaaaggcaggctgaattgtgatcctacctttgaacttgaggaaatgattttggagtccaaacctctacataagaaaaaaaagcgtc

SEQ ID NO: 143121 - DNA, 455 bp, Homo sapiens
cccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcatcggcatctgatgaactcatatgtctgtgtcactgagtctggggacatgtgattatgcacttccctgagggagtgcatctcaagctgtgtgaccgacaccccgtaaccatgtgtggggtgggtattaacatgtgaccagctggggcaacccagtgaaaccccatctctacacaaaacatttaaaaattagccaggcatggtggcacatgactgtggtcccagct

SEQ ID NO: 143122 - DNA, 422 bp, Homo sapiens
ggtggaggaggtgctgagcactaggaagggagtttctgaggcgaggaacccttctctattttgactgtgatgatgtttcttaagacacacagagctgcacgccagaggggtgaatttttactgggtctgcaggtaagcagctgcacagacagatgtgcgggatggtctcactttaagtctgcactgagatctctcttctactctagacagactggaagggctgcgcagaaagcagcagggtggccccccagctgtgggctctgttcccagaagtcccagcggaggacccagggctcaaatggttgggtcagatgaaagtcagaatgggatgtgttagggaaggctggacaagaggggcccggtatcaggagcccacatctagagaaggaagacaggtgcttgactcatcccaccctgcccac

SEQ ID NO: 143123 - DNA, 378 bp, Homo sapiens
tagaaaattacacacttggtaaattcatcagcaagaggcaatcagtggaacactggaggtcaccttcagcatgccctcgctttgctttcataaataatcacctgaaatgcacggcttcagggtgactttttcatctgattcaaatatgagacattcactgctcttttatgtcacaccaggttagttttaaacttggttagcattttaaccaaatgcatggacatttgcaaagtcccctttaacactactctgggaccattttttccacattttcacaggcaaaaagcacaaatgctgaaatactcacatacaaatgctccttttacaatttggaataacctttgcattaaggtgaatatttacataatcatattccag

SEQ ID NO: 143124 - DNA, 360 bp, Homo sapiens
atgcatttcagtagaatcacaggttctccatgggtgagacctggaagaatcctggagcccatgcagtccacctcaaaggtcccatgctccatggctaggatgagaggaatggtgtctcagcaggacccggggacttaatgacacagtaggggaagggaatcctggatagctcgggccaggctcaggttggcccagactgctgggggtggaggaagctgagacagccagcgtcacaagtccccacctgagttccatgctgagccctgcatgtggccagatcacgcagcattcaaggagggcagaggggtggaatttatgcaaaataatgatgtgccagtcttcacccactgggccagggag

SEQ ID NO: 143125 - DNA, 254 bp, Homo sapiens
cagcaaaccagaaccctggcatcctaacctggctgaacagtgagaggaggctggtcttgctggaaacatcaggggctgaaggagtgttatggggagctcacaggtcacccaggggggtgcctcaggctgggtgtggtcagcaacacagggatttgggagcaatgagagggcctgggtcctaacctgccgtagagacccaagcatccctgaggcctcagaacttctgctccggagtcgatggtcttccaaagcca

SEQ ID NO: 143126 - DNA, 315 bp, Homo sapiens
  misc_feature (291)..(291): n is a, c, g, or t
gttgtgttccacttgacaagtgacataggaaacaatcaatggtatctcagcctcctattcccaggcaggcaattgtgccttgttggacagaatactgcatctgaatggggccaacattaaagtgggacccatgcattaatgatgaaatagtcaccgctttcatgacagctttccttgctctccaaactgtgtattattaccatctcttctgtattctaggagaggaggaagagaggtgtatatgcctctttatagcctgtgtaacattctgttttgtattacagccatgtntgtacttgggatggggccaacatt

SEQ ID NO: 143127 - DNA, 982 bp, Homo sapiens
gccaaattcaactcctgagtcctcagtctctagtcccgggaagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgacttttaatgagtgatgaggagatggccaccataactcagttcaagaaacggggggcttgacttaaggaatctctcatggggattcccttgatgcgatatggggtgattccggggagatacacgggatctctttcgggagggaagttcacagaaattagcagtttggataacgaattgctgggacaagggggtgaagattttttgaaaaaaaaggggaagcgcttttatgggacggggaaaaaaaaggttg

SEQ ID NO: 143128 - DNA, 1020 bp, Homo sapiens
agggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatatgtactgtcaccttattaccataattatcagttgaaggagtaaagagtcaaaaagatgcaaataaggagaagtgtttgaacgagatgacacaacatccaaggcatttagatggatggttttcttcatattgcttctgcctgcaggtgtcttcaaaaacattacccaggccgcctcccgactgccagcattgtcatttgcttctataatgaagaatgtaatgccttgtttcagaccatgtccagtgtcacgaacctcacgccacactattttcttgaagaaattattttggtagatg

SEQ ID NO: 143129 - DNA, 778 bp, Homo sapiens
agggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatggatgttctggtgttcctggacagcactgtgaggtgaacagagtatggctggagcccctgctgcatgccattgccaaggaccccaaaatggtggtgtgcgccctgatagatgtccttgatgatagaactctggaagtataaagcctctctcttgtaagg

SEQ ID NO: 143130 - DNA, 828 bp, Homo sapiens
agggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttgatgcaaccatggcatccggcaatagccatctaccttgcaatatttataattactcctccctgttcctcagtcaagcgcaccaaccagaaaattcctttccacctatattccatcctgattcacagccagtgagattttaacaagcacatatcagccacagtatgccaggggctttcagaacaccacctttccaccagcaatgggatgctcagggccagccgcctggagggtggcttagccctaaaatcccctttacagcccattttcctggaccattagcaaccatcatactaggtcaagttccccaggaagaagactattcgactaagatttgcatggaaaactttattcggagcagatctggggacaaacactgcaaggcagggacacaagtaggttcaatcagaggaagagcctagatggcagtgcagcttccagaagagactccacccaccccacaggcagcttgcgctctccagagtccccccagatagacaagggagctgcaccca

SEQ ID NO: 143131 - DNA, 771 bp, Homo sapiens
agggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccaggccgcctcccgactgccagcattgtcatttgcttctataatgaagaatgtaatgccttgtttcagaccatgtccagtgtcacgaacctcacgccacactattttcttgaagaaattattttggtagatg

SEQ ID NO: 143132 - DNA, 481 bp, Homo sapiens
tgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttctggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcgcaccattgcactccagcctgggcaacaagagcaaaactacatctc

SEQ ID NO: 143133 - DNA, 349 bp, Homo sapiens
ctggccacaggacaggagaagagcagcatggactaagttcaggcagtgtagctgaagggcgggtgtgtgtgtgtgtgtgtgtgtgtgcacgtgcacatatgtgcatgtgtgtgaagatgcagtaataataggaaactgaggactgattagtgccaggccctgttctatgtactctacataactcactgaatccttaccatgattctgtgaggcggggttctattatcatcacccccatttttcagatgaggaagctgaggcagagagaagcttgcccaaggtcacacaaccagcatgtgatggagccagctgggactcaatccaggccatctggccatgttggcttcca

SEQ ID NO: 143134 - DNA, 370 bp, Homo sapiens
aaaatgtgtagtggttttgtgtcagtatttcctgatgatgttgaacagggacagcgtaaaaagtgatatacattccaaaaaatcagttgataaagtagttttattttcaccttttatcagaaactttgcagatctgccaataagagatgtaatagatttgagttttacctaatcttgtttgtacaaggataagaattattgaaatatgttactagttagctttttcctttgtatttcaattctttttgaaatcttggaagtttggcttagtctttgattacaccaaggatacagggctttgaagacctggagaaactagtgagtattcatttcaaaagcaagtcttaagactggttcagaaccacaagca

SEQ ID NO: 143135 - DNA, 414 bp, Homo sapiens
gagccttcctctgaaccttttgcaatagtgacactgatatcatttataaaattaatgcaccctggttcagtggcatagttgctaagaaaagacaatctcttatggaatacatgagtgaaaaaacaatgaacatagactaacacaaagaataacttctgatgtaagttttttattaagcctggaatagctcttaagaaataagcaggattgacacttctcatttaatgtaggaatgacctactaagcaatgaacaaatcttgcaagttttgtcatttactatcctccagacatctgattcaagacttgatagctgtctgcaccaccctttcagaatctaacaaacaatttgtttgaaagcattggaatgaggtggtgatgccccaaacaaggtttttgcccatatatctttaaac

SEQ ID NO: 143136 - DNA, 144 bp, Homo sapiens
attcttacacatcagtttggcttcaagtttttagttaatgtcagggttcaggatcttcaattatctgagagcttcatagtcctgattgagtcaaattggacaaatttagcagttcaatggcgcaggatttgattggttaaatat

SEQ ID NO: 143137 - DNA, 566 bp, Homo sapiens
  misc_feature (190)..(190): n is a, c, g, or t
  misc_feature (226)..(226): n is a, c, g, or t
cataacacagtaatcattcttcctattgtcacgaaccatgtcttatatagatttcctgaactggacatttcctttcactttagatagctcagtgactttctgagtttttcatccacctgaagttaccgggttactttcttcgctgtctcattcttttcttttttaagacaggggctccctctgtagcccnggctggagtatggtggtgcgatactggctcgttgcnacctctgcttcccgggttcaagcgactctagtgcctcagccttccaagtagctgggactacaggtgcacgccaccatgacccactaattgttgtattttgagtaaatatctgtttattccatagtaaggatagatgctagacaggttatgatttgctttggttctactcccctactttggataggattttacctaggtggagcattggatcatgttcttgagctgtgtggaactttgatttgcttatgtgaatgcttcacactgctggccaccctttgttgcttaagcagtagagacataagctcatcctgggtacaccttttagtgtgcaaggttctgt

SEQ ID NO: 143138 - DNA, 581 bp, Homo sapiens
gaaagatggaacagcagatgtgcatattttcctctgtaatggtcattgatttaatataaaagatatgtctgaagaatgtatgcttggataagtaatatgctgaattctggtgtttggtgtgattgtattagcctagacctgtttagtagtaactttgaaatatgttgcagcaataataaggaatgtagtgggtgcctttctgctgttatcaaaatccattaacaggttttcctatgcttgactgcctttcattgttacgctttatggttcatactgagggggcatgtaaatgacatctcttctatggtttctcaaggtctttaaaacagtgttgtattttgagtaaatatctgtttattccatagtaaggatagatgctagacaggttatgatttgctttggttctactcccctactttggataggattttacctaggtggagcattggatcatgttcttgagctgtgtggaactttgatttgcttatgtgaatgcttcacactgctggccaccctttgttgcttaagcagtagagacataagctcatcctgggtacaccttttagtgtgcaaggttctgt

SEQ ID NO: 143139 - DNA, 676 bp, Homo sapiens
gttttgcttgttgttattaatggtgctagtttcatttctgaaaagagcccataacaatttagtgcttttaggtttaattgaatctgtccctcagatctctattcaacaaatagtggttctgataacatttactacgtgcctaatatattgggtgcctagtataagctttgtgcttggtctaggaagtcacagataaattaggtaaggaggccgggcacggtggctcacacctgtattcccagcaatttgggaggctgaggtgggtagatcacttgaggccaggagtttgagaccagcctggccaacatggaaaaaccctgtctcaactaaaaatacaactgtactccagcctgggtgagagtgacactttatctaaaaaataaatagataaacaaacaaataaataaataaattagataaggcttttatcctcaaggagtgtttagtgtaccttatgatgtcagttctttctggcctagtgttacctgatgggaactggttactatccatggtattgtgatttggtaactcataaccaccaggccactccctgtgctcttactttcatagacaggggagggctgtagaggtcttggtgaaaactgaaattttgtgaatctaaattgcatgtgcttttgattgagattttatagttatcactgcctcatagatgatg

SEQ ID NO: 143140 - DNA, 133 bp, Homo sapiens
caatggctacaaagtgggctttccacatagaaacctgtgtatcctaatggataaaaacccaaggataagaatgaaaaattggcgtcttagcctctgagtgacccagaaacagggcccgcctgagacaggtttg

SEQ ID NO: 143141 - DNA, 994 bp, Homo sapiens
cgcgggggcgcgggggacgcgccgggctgggctgtggggtcgaccccctgcctctcttctccgcgggtgtgcagatcgccgccggccgaggcttgccgccgccgccccgactgggggaatgagcaggcgccaggtcttgaattcctgtcagggccggtctgggggctccctgctgaagcccctgtccctgatcccgcaacctcccgcgtgcgttgggaaggggtcgcgggtagcggccgtcctttggatgcacgtgtgatggctttggcttaatttcacattgttttgtttgttttttgagacagggtctctttcgcccaggctggagtgtaatcacggctactgcagcctcgatctccagggctcaagtgattctctcacgtcggcctcgcagtaactgggaccacagacatgagctaccatgcctggcttttttttgttttgttttgttttgttttttgtagagacagggcggggtgtgagactctcatcttgttgcccaagctggtctcctgagctcaaggatctgccctcctcggcctcccaaagcgctgggattacagcttgataccctaccttgttttaacctgattgactcgctcttagctgagagagcgggacagactccattttggtttcttcgcttgcagcaccttgtccccctcccttaaggacataactggtgcagactgacaccaagcacatccaggaatgtgcttactgataagatactgaggcaagctgtaccagcagctcctgggaacgcgctcggttgatggtacccaaagcccctgcgtttatctctttgtgataatttaagccccatgcacctggaactgtttattttcctgtaactgtttctataaccatttatcttttaactctttgcctgttctgcttctgtaaaaattgcttcagctagactaccccttccctatttagaccaaggtataaaaagaaatctagccccttcttcagggccgagagaattttg

SEQ ID NO: 143142 - DNA, 176 bp, Homo sapiens
taatacactgtattcttaataccttctaagtctatcattatgtcctctttttacttctaacatgcattctctcaccagttttctgacttagacttgtccaagatttgcttattacactgacgtacttctagaactagttgaaaacattctactgtgtttatgttttcttttatctg

SEQ ID NO: 143143 - DNA, 315 bp, Homo sapiens
cgacgctatgagagataaagtattgtctagttgcacgtgggcaggacgaggctccatggaggtgatagacaagtaagaccaattctgatttcatgtgttaagacacaggcaactccaactctacaatctgccactcaccaccaagtagtccatgctccctggttaggaggtctttgggactgggactcaacctccacaaacccccttccaataggagcagctatgtgcagaccctacttcctccagtgtctccaattcctggccaggtgctgtccccagaaactcctgtaaacatgtggccctgagcaaaagttt

SEQ ID NO: 143144 - DNA, 775 bp, Homo sapiens
agacgacaaagggctaatttgggatggacactccttggtgtttggaaatttaaaagccaatgcaaatgctgtataaaacaattgatctttaacggttcagcgggatctataaattttctcctgagtaatgaaagattgctgtgtttttttttgaagtctccttaatgattgtctgtgtacttactccctgttgcaaaacaggtaatgagagtatattaggtgctattttaaaatacacccacaacattaaactaaattcaaataattaattggaaattgttatttctgcaaagtaatttccaccaaatcagtcattaagctatctactaaaaccagtatttagtggcttttagtcaagttggctaatggtagacttctcatggcacgtgggagaagtaagctgaagtagcagaaaatggtatttgcagtgagtgttcaaggcgaacttttaaaaatactttacagtaattacagcatgtggctgaaaataactatttggttctttttttaaaccactatagttagatggactataaacatcattcagtttccctgtgttgtgattcatttccacaaacatgtattgtgccaggcactgatttaggtgccacaaaaaatagataagaaatggcttgacaactgtccttaagtttaataggcatgagatttctagatactgctctactaatgtgtcattgcctacaactcacctgttctgaatgaccactttttttgttatcctatatcagaagtacttggaaaaaaataaccagca

SEQ ID NO: 143145 - DNA, 314 bp, Homo sapiens
ccctaatgtaaattaaaatcagttatttagttgcactagtcacctttcaatactcgatgtccacatatggctagtggccactgtacttgacagggcggttaagtaactaacttgctgaaggtcacatagcaagtaaatggcagaactaggatttcaaccttgtttctgacttcagagctcaagtgttttgaggtcttgcttttctgtttccatttgcaaaacagatttaggtgaactgctctagaacagcactgtcccagtaggactttctgttatgatagacctgttccttatctgccctgtccagtacagtg

SEQ ID NO: 143146 - DNA, 387 bp, Homo sapiens
acacggagctgtaaatattcacccctagacactgccatgaggtcggagcccacagcctgcccatctgtatgctcccccagaggtctgagcagcggggcactgaagaagcgagccactcccccatcgcacgccctgcgagggagacaagggaacttcccgtttcaaatgcatgatgtgttcaagagcagcaatgccagtgtggcagagcagagtgaaggagggggtggggtacaccacagggtcagcaggggagctcacccaggtcagtaggggtggacctcacagggcctgtaggctatggtgaggcctctgtttttcactctgtgatggaagccactgagtggctccgagcaaaaaaggaattgaatctggcatgggctcggctgc

SEQ ID NO: 143147 - DNA, 225 bp, Homo sapiens
atgttggtgttccttttgcatttctgaaaggtcagccccaagtctcaaagcgggagagttctcaaagggtctgaaataaggttcctcagactccacccctcggtggctgggaagctgtttgtggggcagtaggcgatggctgggactgcagacagctgacagaggaggcatcagatcattacagaggaatgcgaaatctggcctatgggctttccagagcaaaca

SEQ ID NO: 143148 - DNA, 373 bp, Homo sapiens
cactgcccctcacctgtctataatattttctatttctttattgatgttctgcatttgttgagacattgttctccttgtatcctttaactctttattcatcgtttcttttagctttttgagcagatttcagacagctgatttaaagtctttgtctagtactttcaatgtctgtgcttccttaaagacaatttgtttcttttgtgaatgggctgtactctcttaatgtcactgcatggtttgtaatttttttttgaaaattggagtcaggcacagtgactcacacctctaatcccttttccccaaaaaaagaaaaagtaaaattaaaaagaaaaaaagagtccaggcgtggtgcctcacgcctgtaatcccagca

SEQ ID NO: 143149 - DNA, 907 bp, Homo sapiens
gacagtttcatagaaacaactatgttttgcacccagatttcattggatagtataatctttaatggataattaattaaaataataagtacatcgtctataaataagtttgctaacacaaagaactgagtcttactcagcatataacttggaggaaagcgtgtgggtgttctagaggacaacctactggtcttgagcatttgtccttaccttagataataacagtataacttttggagacagtgatgcttaccagtattccaaagctcctgtacatttctcagtcttttccgctgttaggttggggacatttgactaacagtaaccaatggaacttgcaagtaggtgcatggtggtgtatgagatgctggaaactccataatctgagtcatttgaataacggtggaattaagtctccttattgagttaagtcactgagatctactttttactgtgggttaagatcttattgcagcataaccttgcccttcctgattatcatgaaatgtttaacttaaggaagaagagagtccttaagttaatagggtgaatcaactgagttaatggaagttaagagatgagtttttaaaacaattaaaaaaataaaaagaaaactttatttgaacaagaaaaagttaaggatgttacacttcaaaagaattttgaactcattaattatttttaattgacaaatcactgtggatttacagggtactgtatgatttttttgatacatgtgattaaaccaggctaattaacatatccatcacttcactttttggtggtatgaatatttaaaatctctctctgcaattttcaaatatacaatacagttggccctctatatctgtgggtttcacatcctctcattcattcaactgtgggttgaaaatatttagaaaaaaatgaa

SEQ ID NO: 143150 - DNA, 211 bp, Homo sapiens
taaggcacagggcaaggaatacaagaatgtgaccctgtcttcttttcctggctttgttttattggactttggcaaatcacctaattacccttcttcaatctccttatcataaaatgagagggaggtaaggaagagtgaactgtggaaggttagaactggttccttccagttctaacactatttccaatccatctagattctctgagaccat

SEQ ID NO: 143151 - DNA, 326 bp, Homo sapiens
ataagcctgggaagttttctcatgggttcctgggtgattgcattgtcggatttgggttggcttactgatatgcctaaaatagctcctggcttctttggtatatcgctgtcctttgcccctcctgagaatctttagtttcatgccagcttagcatctcttctccctgtgggcaggtcccatgcatttactgccattgtcacttctccctgttacccacagtgctgccaccatgcctgggatagacagcaggtaactgatgtgtcctagttgaggtccctatcctttcagaggaggtgacatgggttcagatattttcctatgttcat

SEQ ID NO: 143152 - DNA, 376 bp, Homo sapiens
cattcaacaagatatactacatatataaatcaaactttatcataaaacaaactttaaattaaaaaaaatcacaaagtatgttatctgactgtaatttacttaagccagaaatcaatatcagattatgtagattattctcaaatatgtggaaagcaaacaactcacttctaaatagtccaaaagtcaaagacaggcaagttagaaaacatcttgaattaactgaaataaaaatacaaagtaccaaaaatttgtggaatatagcttggagagaaatgtatgacattaagtgcttatatgagaaataagaaagatctaaaatcaaacatataacatttcacttcaagaaactagaaaaagaagagcaaatttaacccaa

SEQ ID NO: 143153 - DNA, 313 bp, Homo sapiens
ttttgatgtcaccaggtgaccttctgaggcaggtgctgcaatgtgtcccgtcgatagataaataaacaatttttttttttttgagatggagtttcactcttgttgcccaggctggagtgcagtggtgcgatgtcagctcactgcaacctccacctcccaggttcaagcgattctcctgcctcagcctcccgagtagctgggattacaggtgtgtgccaccacacctggctaatttttgtatttttagtagagatggggtttcaccatgttggccaggctggtcttgaactcccgacctcaggtgatctgcctg

SEQ ID NO: 143154 - DNA, 322 bp, Homo sapiens
tggcaagagctccatctttgacaactcagtgggcaaaacaaagtcctggggtgggcccaggaattggccctgcaccagaaattcagatgcgcacttgtgtttgagaattgctattttcatctgaggaaggaggtgcagcctgggataaagggatgtggggttcagtagagcaggaccctactaccagagagcccagcagttagtctgcagggggctttgctctgggaggaagcatgggggctggtatcgcatttgactcaagacactcacctcccccaactctgctttgatgtggtatcctgcaggcatagggagtgccatg

SEQ ID NO: 143155 - DNA, 260 bp, Homo sapiens
attttgaggttttcagtataaaaatcccatacatgttttgttagatttataagtgtttcagtttttttagtgattgcatatggtattacatttttagttttagtttcctttgtttactgccagtatagagaaatagaattgatttttgtaggttgatcttgcagcttgtaaactttctcttttttttttgagacagagtgtctctcttattgcccaggctggagtgcagtggcgcgatcttggctgactgcaccctccgc

SEQ ID NO: 143156 - DNA, 207 bp, Homo sapiens
cttttagataatttatcatttttagcaagaaagataaagtctaactcaggcaaggctttctctttctgagttaaatggtgtagaatatataatggatttctgcctctgcctaattattcaaggataagtcttgtgatctaaaaaggaacaacgtgctgttgtatccacggtaaggggattaacggtcttgtgcttgtaaaacagcag

SEQ ID NO: 143157 - DNA, 462 bp, Homo sapiens
ctggccgccttgcactctagtgggaactatgatgttgggcacaagtgccagcaggaaggtgggaagcttcccggggatgtttttcctggaggtcaagtccccccttgggctgtgaagtagccggtactggggttcatgggcatttcccttccctgactgttcgccagcgtctggcacagcaccagcagcccctggaagtctaggccagatatgccatgtccgagaatcttttgtaaacatttttcatcagtgactcacagctttgagaaaggattatttttatataaaacgatctttcaattttactttaaagacccaaaccattttcttagaatactgtctaaacaagttaatcatgcacagatccagtgaattctgtggcctggttcttataaaatttccaaataattttatactgtcatagacagagccagagctttttagaggtttgaggcatttttt

SEQ ID NO: 143158 - DNA, 156 bp, Homo sapiens
caacactcagctttggcgttagggagatgaatcggagagccttggccatttacagggcagcagctactacccggctccatccagttgttatccttgaggccctgtgttgccagatcctgttatttttaaagagaagccacattttgaaattataaa

SEQ ID NO: 143159 - DNA, 400 bp, Homo sapiens
caggcagcaggctagctactttgcatgcagtttcttagtcctctcgactctgaagtaggtgtctttggtcccactgtacagttgagaacactgaggcttaggagaggtaagtcctttactcagggtcacccagagcaagggcctccagggcagttacacccaggtctggctcatgatttttgttttatcctgataaacagtctcagctgggtgcaatggctcacacctgtaatcccagcactttgggaggctgaggcagaccaatcaattgaggtcagaagtttgtgaccagcctggacaacatggtgaaaccccatctctacaaaaaatacaaaaaaatttagctgggtgtggcagcacacacctgtagtcccagctactcgggaggctgaggcaggac

SEQ ID NO: 143160 - DNA, 222 bp, Homo sapiens
gctacttgggaggctgagatgagatgatcccctgagcccaggaggtcgaggctacagtgagccatgatcataccactgcactccagcctgggcagcagagtgagaccctgtctcaaaatataatcagaacagaagataatattctatgtgtgttctaaccagaagagtggttagtagaactaagaacctcccttctttatctctctgcctctagtaatccaa

SEQ ID NO: 143161 - DNA, 197 bp, Homo sapiens
gacattcaaagaatagacatattggatcaataggagaaaacaaggaagtctgcctgagagggatgatgtctgagttaaggacatcgaagagtggacagaatttaatagcatgagatttgaaattttcttttaaaccctagaggcaagaaaaggcagggcacggctgagacataccaacttgtccagcttggttgaag

SEQ ID NO: 143162 - DNA, 365 bp, Homo sapiens
gggcaggagccaggttaaagtggagacctggctattggtcactgggtactttggcagagggtttaaagcaactactggtgaagctctgccctgggggctaggactctacttttcgttgctgctgatgtagttcctaccctgccacagggcactcacttactccccacctcattttggggggtcatttgcagcaggaccttttcctttaccattgagataaacagataacccaaaggaagggtcaagaggctctaggtgggtggctggaaagggtttttattaagaaggcaatcagggactgagagtcctgtcctaagagtgcttaagaaagagaaagaccaggcgtggtggctcatgagcctgta

SEQ ID NO: 143163 - DNA, 334 bp, Homo sapiens
tcttgttccttgatgtatttgctcacttgcagccttatagaagaatataagctccctgagagcagaagtcttgcatgaagggagaccagatggaaggctgttgcacaaaggtctggcagttgcagacagaaaggcattggctatttagagacatgtgtaaggagggagaggttggtatttagtgattgattgactatgggggatgacaggatgaaggtggacactgggttgccagtccatctcagatcgaggactggcatgggactgagggtatgcatactttaggattgcctggcaaaggccacgctcagacctgtcctactggaggggtaag

SEQ ID NO: 143164 - DNA, 368 bp, Homo sapiens
taaagcggaggccagattggaaagaagaaaatcagggctgatgcagagaaataaggtagaaaaccatgagctaggctaggtaagaggcaatggtaacctgagttggagtggtaacagaggatgagaagtctaagaatgcagcccttgggccaagcactgtggctcacacctgtaataacagggctttgggaggctaaagcaggaggatcacttgaagccaggagtttgagactagctgggtcaacatagtgagaccctgtctctacaaaaaattaaaaatatcagccatgcatggtgacacacacctgtagtcccagctacttggggggctcaggtgggaggatcccttgagcccaggagttcaaggc

SEQ ID NO: 143165 - DNA, 204 bp, Homo sapiens
tctatcttggccacagctaaacctcaaaacgggcgctttccaaggtgcacgttgagaactgctcacactacccagagagcttcaccaccctgcagagaagtgaggactcccacctacccgagttccgcccagcggcagagctaaaagcccaccctgggactaccccagttctgcccagcggcagagctagaagcccaccctggg

SEQ ID NO: 143166 - DNA, 317 bp, Homo sapiens
  misc_feature (264)..(264): n is a, c, g, or t
  misc_feature (291)..(291): n is a, c, g, or t
tgaaaattgggaatgataataatatctacctcatggggttacagtgagaacatggcatatgacaagcacttaattgtttattaatttaaacatacagtgggccctccatatccatgggttcaaccaaccacacatcaaaaatattagggaaaaaataacaatacaattaaaaaatacaaaatatataaaatagaacaattatttactcagtatttacattgtattagatagtctaagtcaagattgtccaacccatgggcctgngatggctttgaaagcggcttaacacanattcataaactttcttaaaacattat

SEQ ID NO: 143167 - DNA, 411 bp, Homo sapiens
ccacttgtaagtgacaatgtgcagtagttagctttccgttccaggtggaattttgaaattgacaatttgtcagatccaaattagatattttgaaattagaattttcaagtaagagtatgggggtcatgtaatacttgtcttaaggtatttaacacattaaaagactatgtcatgaaggccagagggtctctgtcatttttatccttctatgtgatgcttaatggagtgtcaagcacatagtaagtgtgtgccaaatagaagtttattaaatacatgggtgaatgaatattgagttaaattgttctttagagctaatatccaaagtatattaagtttcatgccgataggacatccatgcaaattagcttcctgcacagggcagaattttatcagattattctgagtaccaaa

SEQ ID NO: 143168 - DNA, 110 bp, Homo sapiens
gccccattttataaagaacttagggaaataacaattaagtattttatctgcttaggtcacacaggtaggaaacagtagaatatatattattttgtaaatttataaattta

SEQ ID NO: 143169 - DNA, 146 bp, Homo sapiens
agcatccctcttatcccctcacattccttgttctcagagggatcccagactctgttagaaactcttcgtaccaggcaagacactcagaccacaaaccagactctaggctctgactcgctcaacccccgtccttcacacctaaagtg

SEQ ID NO: 143170 - DNA, 366 bp, Homo sapiens
gtccgtgggcacaggcctgggagtagagccctagtcagggaccacaacctcctctacccaacacttccctgcccgcttctgtatcactattccttcattaattagaaagtatgcattttttaaaattatgaagtgtctaggtgtctgccagcattactcaataggaaactccaatagaggagtaaagttatttctccaaggtcaacaaaattaataaatacaaagccttcatcaccagagccgtggtgaagagctctttgcactatgtgtaagcgaaacatgaaatcaacaatttatttaccttcagtgtaaattgttcattgaatgtcattatgttgtcgattattgattcctaccgcatgtgac

SEQ ID NO: 143171 - DNA, 340 bp, Homo sapiens
attttatgtattcatcacagattaaaaccacagtatttccaaccgtgcccagacaaagggtagctctgccacatcttcaatttttgagaaggatgcctagaaagcggcctcattgttcagtgagtaacaccattaacccatttatgctggaggttgtgattttttttttttaaatgagaccttggcgatgactttgagcaggatataaataactcccacaagcttagcgttccaataatggaacactgcgcataaatgggttaaaggcccaactccacaatttaattcgggaactggaactgaaatgattgccataaaccactagatggcacttccggtc

SEQ ID NO: 143172 - DNA, 647 bp, Homo sapiens
gggtaaatgtatgataatgtacttagtgaagaaacacctaccaaactacttatagtttatagactcttaggtgttaattttaactcatgaaagaaacctgggagtcataggtttctttcttaaatatgggtaaatatatgataatgtacttagtgaagaaacacctaccaaactacttatagtttatagactcttaggtgttaattttaactcatgaaagaaacctgggagtataggctctctcagcatgattattgtctcttccctacagtcaattcaggagggtttattgaggacctactttgtgtgaggataaatatagtgttcttgtacttaaagaacttacatcttttccttccttctggccgggcgcagtggctcacgcctgtaatcccaacactttgggaggccaaggcgggcggatcacaagttcaggagatcgagaccatcctggctaacacggtgaaaccccatctctactaaaaatacaaaaaattagccgggcgaggtggcacacacctgtaatcccagctactcgggaggctgaggcaggggaatggcatgaacccaggaggtggaggttgcagtgagctgagatcatgccactgcactccagcctgggtgacagagtgagactctgtctaaac

SEQ ID NO: 143173 - DNA, 137 bp, Homo sapiens
taaatatctttgctttctaatatacacaatatgatgacatttttaacttaaatgatatgcagcactttttgaacctagaaacttatttaataatgaagctttataactctttgctatagattaataactttccaaac

SEQ ID NO: 143174 - DNA, 389 bp, Homo sapiens
cgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacagg

SEQ ID NO: 143175 - DNA, 541 bp, Homo sapiens
tggcagcagatacttacaggtcatggaaacgtgtgggaggaactgttcgaagcagcattaactctgcagtccccaaaaccccatgttcatgatttccatcacagtacaggtgtggaatctgggacatagagaggctaagtgacctgcccaaggtcctgccactcagtagtcagttcacaccataccccaagtccatgttcctaacagctgcacttcactgctgggtttctgagccacaagcatatcatgtaaaacctcaatcatttcttttcccccttgaaaagtgtcattcatgagtaacaaaattctgaaacctgagagttaatttttgtttaacctatttgacataactcaatccaaacttgctttcagaattattctttaaccctaatttcatagaatttttttttttttaagagacagggtcttgttttgtcagccaggttggagtgcagtggtgcaatcatggctcagtatagcctcaaacacctgggctcaagcaatcctcccgcctcggcctcccgagtagctgggactgcag

SEQ ID NO: 143176 - DNA, 209 bp, Homo sapiens
ctagtttatctatcattcccaaatatactgtgactctgctaccaagcacttgctaatttagctctttctacatctatcagagtcctactctgttcatattgtttcctctgtgatgttttgttttttcattgccctcagcccttgataattgctattaaacatcagatgcctgcaatgccaagaaggcattctacagaattttttaaaat

SEQ ID NO: 143177 - DNA, 532 bp, Homo sapiens
tcctgggacctggtgtgcggggccccagggctgtgctcccaggctgctgcttgtgaacttgctgagagctgccccccaggcatgttgccctaggctggcctcccaacctagtggatacttttgatcattgttcactgtaacctcaagcccctgggctcaagcattcctcctacctcagcctccagagtggctaggactacaggtgtgtgccactgtgcccagccaattaaatttttttttttttgtgtggagagaaggtctcactatgttgcccaggctggtctcgaacatttgggctcaagagatccccctgcctcagcctcccaaagcgctggtattataggcatgagccaccatgcctggcttgaagttaatttcttattaacgttttcagtatcattagaatatagtaatgcagtagatttttgactgtttattggtattgtacatcttgcacctctaatgtgctagcttactgtcttcagtcaatgtaggattggagttctaattgtgtaaaactctgtatataagg

SEQ ID NO: 143178 - DNA, 131 bp, Homo sapiens
actggaggtcgctgtgggggtgaagggtgaggcctgcagtgagtgcagcagtgagtgtgtgtgcacagaggcgcaggccgtggtgttggaggctgtggctgggctctgcctccgggcctgtgctggcagcc

SEQ ID NO: 143179 - DNA, 495 bp, Homo sapiens
gggagcaagacctagaaaaatactggagccacagactttatctgaatgtctgaaatgacctctcttcacattatgggcagcctgaaggccatcggctcccaagttttatgtcctagagctttcaccagtgccaggaaatggaaacttccagttctaaaaaaaatctggggaggggacctttttttcccctgagcttgtgggaaggtgcttaaccacacactaaccttgataaaaatggcacctcccaaggtagccacaagaggagcaggtaggaacagagtttcctggagaagaaggggtcagggatgggtgccaaaaaccaaccccacagctgcatgtttacagtttagaccatctctgtgaattgcatccttatgttctgtattttaaaaggccattttcagctcctacttagcttccactcagaaataccattcacatcaggtctctgtgcatgcatgtggttttttaatccacacattgtcgggaccggcc

SEQ ID NO: 143180 - DNA, 388 bp, Homo sapiens
aggcatcaggtgggttaaaagaggcttgccaaggggcaggactcaggtgatccaaacccccaggcagggccccagacagaggaagtggcctgccaggaactgtgagcctggctgacggtatcctccacagcgaaggtgccacaggtggggtgagaccaggctggagagcaggcagggccacggcaaagggcctgggagcccagcgaggcaactccatttccatttctttacttcctccatgactccttctaaaaaggcttaagggtgaggccaaggaacttcaacttcattctaaaagccctagtgagctatttaaaggcttaagcaggttgaggtctgggtaaatttatattttgggatctatttatgggttaacccgagcgcaaac

SEQ ID NO: 143181 - DNA, 256 bp, Homo sapiens
agtgcctggctataggctccagatcctgttccctctccctctctgaggccctcactgcggccctcactgcatcatgcttaggccctggtgcaaacctttgagttctcatccatgtggtcttgggcaggtttctgcaagcttcagttttctcatctgtaaaatggggaccatattgtcctcattgttgtgaagacttacagagatagtacgtatgaaacacttagaacagtgtttagtacctcatatgcacttaata

SEQ ID NO: 143182 - DNA, 163 bp, Homo sapiens
ggatttgctggtgcagtacaactaggcttaatagggatcatggtactgggaaataatgctaactattaccaaaggaacctcattgcattacctttacttgccattctgagcattagatctgagcacggaaaataaccagggtgtcctaggtgtactttcagga

SEQ ID NO: 143183 - DNA, 563 bp, Homo sapiens
catgacaccatggtaagacaccgaacctaattaccaactctagttacaactgaattcacactataccttcaagtttgaggaaatacttaactaaaaaatagctcaaatgaagttgtttggttacaaaaacatttgcttcctatccactgataaatttagtactttacctttaaaatcctagatttccttgtgcactatgagctttttcttaaaatagataatttaacaaaatgaaaaagtggagagaacaccacacattttttgccttaaaaaacacaaaccctgtgttataaaactatctactacttaattctaactgaaaaggaatgggagacaaaaatgtaaggaaatgagaaaatcaatggctgtcttccttgtaatgaaaaagctgcaaaactgtttataacaatttagctgtgttttgaaaatatgacttccacatcatatgctggtaataaaattatataccactgtcatttttttcctgcccagaaatattaaaggatttacaagcctcaactttcagaccaacaatgttatagattctaaggggcaccatgtgt

SEQ ID NO: 143184 - DNA, 331 bp, Homo sapiens
ctaagtggaaggatcactagatttgctgggttgaataaataatcatgggtggtcacagaagtttcttgccagaaaacattacaaagtcttccaaaggatggacctgtgcctttgatggagggctagggctactccagaggtctcagggtgctatgaacagctcatctggggccttggcccagcactgagcctcagcaggggcacaataacaggagaagaatgtccctattggagaggctgagccatcgctggagaaatcaagccagaattataaatgctcacaaaggaaacaaaacgaacaggacttgaaaaatggaagctgacacttgaa

SEQ ID NO: 143185 - DNA, 431 bp, Homo sapiens
tttccagcacacctcatccacttagaaaaaccaaagtggtatgtagacaatcacactttgaatacattacccaacagggaacacagggttcaacagaaaaagtgaaaggaaactccaaaatctgggaatgagaagaaaagcagacagcctgtcgtggtcaagaccggctgggaactggcaatgaatccctaagagagagtgagtgagtatctttctgcagtccactttcccactggggaatcatacagtccaggccacagcagagcaccctgacccacccaaatcctgaatctgatttagggagcatccaagagactgtgagaaggaactgcttcaaggaggcaacatgccctgggtcccacacaattcctgagaactaagtagccacagtaagatgcgattcttaatcctagctcttagcaaactatgag

SEQ ID NO: 143186 - DNA, 672 bp, Homo sapiens
aaattacttgttggagatggagttgcagacaaaacaaatatttaccactgctttaaaatacgtttattgtactcaggagaagagtctggaactgtggtttcagaatgagcttatccaacagtaagaagaggactggggcataccttttaaaataataatgatatatttataatcatcctagtgtgatttatttaccttttagtaaatcaagttctcagaaaactaaagtaaaaaaatcttaacattacatatgcaggacttaatctgaataatcataaattttcataaacttaatttacataccacaccatagtagctgtgatatagtaaattaataagttttttgtactatggtgtaactctttcatcctaagaataaaaaagattctattatgtcaaaagacatgtatctggatggttaaaaaaatccaatcatacataactgaagaaaatgtaggtattttagtggaataagaatgtgatatatgaaaacagaaaaataaatatcttcaatgttacttaaagaaacagaattaacaaagatgtatcatggaagagaggatagttctgtaaaaacacataaaataactttcaaagatgaaaattttacatatgtaaaagcatttgtcaatgaaagtaataataattccattcatgcatttgttcatgtat

SEQ ID NO: 143187 - DNA, 342 bp, Homo sapiens
caggacactttacaaaatgcagatgcccaggctgggccccccaggtccttctgatccatgatgggcctgagaccctctggctagtcggtccagccccaagcagacatcaggactctgtcacatctatctcccacctattccactccaccttttgctttgcaggtcatgctctggccaaattaaatcaaatatcatcatcgaagcaaacacgcacttgaagcctctgtgcctgcgcttccctgcctgagagaaagctccgccaggcctggaggatgcagctggatggcccacaggcccagctcaagtctcccaacaccactggcagggtaagtcagccctcct

SEQ ID NO: 143188 - DNA, 467 bp, Homo sapiens
tagcagtcattctacattcaccacgtccactccgcctcaagtcctagacaattgctagtatactttctgtctgtatagccttgccaattcgcacgtttgatataaatgaaatcatacagtgcagctggcttctttcattaagtataatgtcaatgtttttgtgactagcttctttcatgacttttgttctttttttaaacggagtctcatgactctcactctgtagcccagatcgcgccactgcactccagcctggaagacagagcaagacaacgtacccaaaaataaataataaagggtaacattaagggtttttttgttgttgttgacagaattgtgcatctattactgtgatctcattttagaatactttcatcactccaaagaaaaatcctgcctccagtagcagtcattctacattcaccacgtccactccagcctgggtgacagagcaggctctgtctcaa

SEQ ID NO: 143189 - DNA, 307 bp, Homo sapiens
tagcatcacctgtactcctattgtcaacttctactggagttgacaataaccagggagaatgaggaaaggaagttgaggttaggaaaactaattgttccaagccctttcccaactttctgcatccatgttcttcaattgtgttgcttgccctagctctcccctttcccatagatgccatgattagaaaacacttgcagggactttggacctttggtcttgctccatagtcttcatgacttctcagactttgtcatttaccaggccattgcagcatgagtgttctgatgcttgcatttggtctgccctg

SEQ ID NO: 143190 - DNA, 444 bp, Homo sapiens
tctacctcccagattcaacaagagttggaatcagataccctactgtatagcccttgctgcttctgagtcttgatgaattatatgttcataatatttactgaacatttattatgaaccaaggcaatgacgatatagcagtgaacttggcatattcaaagttcatgcccttgtgaagcttatattctaagtggggagacaaaagatacctaagaactttaggagttgtggtaagcggtattgaaaaaattaatatagtggcatagagaggaagtggataaaggagaatttaacttcgagaagattatcaaggaagacatctgaagaggtgacatttagaagaggccaaagaatgagaatgagccagctgtcaaaaggtgaggcagaaccttccaggcagcttctctttctttgaggatagcacatacaaaggccctgaggtaggta

SEQ ID NO: 143191 - DNA, 250 bp, Homo sapiens
caaacagggaacccaaaaacaatgggaggggttttgtaaacttacgtagactcagactgaagcctggtgctttgggccattgccgctgccctaggcgactctggccttggggtgcagtcctgtgtgatgcatgtgctgtggctttccagttagcttctccaccctggttaagagtctgctttcaggtcagagactgcagccctgaggtcgtgtgtgtgtagagagctcaatgcctgtcctgggggctccc

SEQ ID NO: 143192 - DNA, 161 bp, Homo sapiens
cagtgaacacacgcaccagcacgcaaagtcggagccctgcagtgtctgcaatgacagcccaagtcctgcggcacagagaggaggggacaccgcctctccactcacgctcactacacagtgggacccactctggcagggactggccttcataaaccatgctg

SEQ ID NO: 143193 - DNA, 262 bp, Homo sapiens
atcagacctccggtataaaataaaataaagcagaatcgttaacagttgaagttagggaagggcgctgaagaccctcccagatcctcagccttcccctagtccaacacacacataggcacacatagacacacacacatatgccagttcctatgtttgttttgtgcagaccatagatgctatctagtctgccccacctgaatacacaggaaggtcctctgtcacgtccctggtaacatccatcatctgttggatacttccaaat

SEQ ID NO: 143194 - DNA, 712 bp, Homo sapiens
atttgctattgattaagaggcattttgtgatatgtttgctttgatgcccagatagtatgtgtacatgaataaagaaaaaaaattataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaagaaaaaaaagagatgacagacagaagcacacaaaaaaatcgaagagcagagacgcacctccatccaacaacagaaaggagaaccaacaggcggccccacaaacaacacactagaaaaaacaacccaacagatagtaaacaccacaaagaaaagagaacacgccgagccaccgaaaccaaaagaaagacacaaccaaacaccccgcgcccacgaaccaggaggcgacaaaacccacacgaacaagagaaaaagaaaagacacataaacagcagacacaaacgaaaaaaaaacagacagagaagaaccagcagcagagaataaccagaacagacagcacacaacaggagaatgaactaacacaaaaaactgcaaacagcaagaagacatagaacacgaaagagaatcaaacagtatacacagcacgccacccacgcaaagcaacaacacaacacgaacgaaaggcgaagcaaacagaaacaaccaagacaaacaacaacgcaagacaacacaaaatgagcatgcgaaag

SEQ ID NO: 143195 - DNA, 389 bp, Homo sapiens
tgagttccgcctcgctgcctgcttcttggcacaggcctttgattcctgaaatgctcagagcaaaccaagaaaaaaaaagtgtttctcaggtgagcctgtccaagaagtttttttccttaaagaataatttcttttcctgctgttcttcctccccacacttcaccaaaaagggtgaagacagacagaacccagaccctcccatagttttccttcagtgtccccttgggaatgatgtcaccttggtctggttgcccccacccatgggcgaggttgtgggtgataactccatgggccatgcagagcatgagggcagcctgcatgaagccggaactcccatccaccttctcgtccccagcctgtgccttggttctgatgccttcccctcgtgc

SEQ ID NO: 143196 - DNA, 338 bp, Homo sapiens
tcggtagaacattttgcaacttgcagtttgttttttgtttttttgccagttcacttgtttgtttttgctgtctcctaactttggaagaggaaccaagacagtctttaatcttgttcatcactgtgcccctagtacttgacacactgagactcaatacattattgttgcttaaaatgcaattcagttttatatataaatatataaaaggtataaaaaggagaatcaagactaaacagatgtttacctcatgcatgctcatttaaatgggaaaaatgaaatattctttaaaactcttaattttacatgtagttccacagtattttttcttaaagcttggc

SEQ ID NO: 143197 - DNA, 269 bp, Homo sapiens
acgcagggccggcctccaggcgcttccccatcaggctcctgcccgcacagcctagctctgatcccaactcgagtgccacttaacaaacgttaggtaacgagggggttttcagaacacgagagagtcttagtcccctgcttgagactgcatggccccggaaggaacccaaacgctgccccgtctccccgccctggcgatcttcactggcacctgccgctttcctgcgccagggcccccgcactggctgctgccctgtgggggacaccccg

SEQ ID NO: 143198 - DNA, 453 bp, Homo sapiens
ctgggagtatgctgatgattgacgctttccagagagttacccgaacaggcagcccatctgcctgagagtttccctgagagaacctccaaggtgatgtttattaggggaagccctagatttttcttggagaatcaccgagaatcacagaatattaacatcagaagagatctcagagctttcagagctgagggccggaatagttacctgacttgttcaaggtaacgtctaaggaatagtcaaagaaagactataatacaggtcttgtcttcagccagcataaatgctcgatcagagaaacctgtgacctctctgttaaggtccgtctcattccacaccattcagcttaaacttgcactgaggtgggcagattttgattcttggtctaatcaaagtccaagaggatgtaatatatatatacacaaaagacgaaagctccccttaaccggcttggga

SEQ ID NO: 143199 - DNA, 951 bp, Homo sapiens
acttgcaaaaaaagctcaagaatattgataaccagcacccaactggtaaaatcagaatgtctggcaaccaataaaaaaataccaaacattcaaagaagcaggaaaatacaactcaaaataaaggaaaaaaaatcaatccatggaaacggagccagaacttatacaagaagttagaattactaaaggcattacaatagttattatattgtattctacatgtacaaaatgttaagcagagacataaaagatcttaaaagacccaagtataacttcaagagatgaaaatcaaagtatttgattgagattgtttaaaagattgatagaattaacagcagcttaaaccaaaataaaagattagtgaaattgagagcacagcaataaaattcatcctaaatgaaaacaagagacaaaaaagactgaaaaagaaataaaaagaacattagtaagacgtgaaacaatttcaagcagcctgatatatatgtaattggagtaatctccttcagggagagaaggggatgaacagaaaaaatatcagatgaaaactataaacccatagattcaaaaagctcaatgaaccccaagtacgggaaacatgaaaactacactatggcacattataatcaatttgcttcaaacttgtaattttaaaaagcttttgaaactagccagagaaggtcaggcacagtggctcatgcatgtaatcccaatactttgggaggctgaggtggaaggatagcttgagcccaggagttggagaccagtctgagaaacactgcgaggccttgtctgtataaaaaataaacaaaattagctgggcatagcggcacgtacctgtagtcccagctacttggtaggccaaggtcggggggatcacctgagccctgtgggtcaagggtgcagtgagccgtgattgtgccactgcactccagcctgggcaacagagtgagaccc

SEQ ID NO: 143200 - DNA, 324 bp, Homo sapiens
ctcctaaatctatacccaagagaaatgatgtgtcgtgtctgcacaaaaactcagacatgaacactcaccgcagcattatccctactagccagaaagtggacacaactcaaacgtccatcaacacatacatagataaacaaagtgtagcatatccatccaatgcagcattattcagtcataaaaggaaatgaactacagaccctcctcaactcacgatggagttacagatgataaacccataaaatgtaagtaccagaagtcaaaaatgaggtcacacacagtggctcatgcctgtaatcccaacacttcaggagactaaggcca

SEQ ID NO: 143201 - DNA, 434 bp, Homo sapiens
ccaagccatactcctaagccacagaagctataagataatcaatgggcattgttgaaagcactaggtttacggtcattgttacatagcaatcagtaactaatacaccaggcgaaacctgactcctgctctacacctgctagaaaagactcattcaggctggcgcagtggctcacgcttgtaatcccagcactgagggaggccgaggcgggcggatcacgaggtcaggagatcgagaccatcgtggctaacacggtgaaaccccgtctctactaaaaatacaaaaaattagccaggcgtggtggcgggcacttgtagtcccagctactcgggaggctgaggcaagagaatggtgtgaacccgggtggtggagcttgcagtgagccgagattgcgccactgcagtccagcctgggggacagatggacactctgtctc

SEQ ID NO: 143202 - DNA, 495 bp, Homo sapiens
cattctgagtgagaaatttcagtcagagcttgtaatgtgtaggacgtgacattagggagtgaagagctttcctcttcactgattcaagatagccagtgccgggtgaggggagcgggacacttgcttcttcagaagagtggatccaaaagttgacctcttccccagactgagtcagcatgggaagagaattgtgctttcacaaaagcagagatgcttttctgtagctttcactgtttcttctttgctctggaaaatggaggacgaaggagttctcaggtcctcagtcactggagtaaagtgacatgcacgtcccagcgtgagtgcctgaatgggtctctcaggtctgaacagaacagccctgtggctgccgcgagctggtgcaggaggaagtacagaggagggtccggttcagagtggcgtgagaccagggttagatgactgttgccagtttagggccagtgagagatttttaatggtaaatatgtaacctctttt

SEQ ID NO: 143203 - DNA, 396 bp, Homo sapiens
tttatttttctagtgctgatgctcatcacagacaatgctgtcacaaaaccacctgatgtgtgtcctgtactatgcactacgggattggggaagttaattaatcagagttctctagagggacagaactataggttgatgcaaaagtaattgctgtttttgccattaaaagcaatggcaaaataaaaggatagacatacatatgaagggtagtttattaaggagtattgactcacacgatcacaaggtgaagtcccacaataggccgtctgcaagctgaggagcaaggaagccagtccgagtcccaaaacctcaaaagtaggggagccaacagtgcagccttcagtctgtggccgaaggcccaagagcccctgacaaagcactggtgtaagcccaaga

SEQ ID NO: 143204 - DNA, 1493 bp, Homo sapiens
tttttttttgtagagatgaggttttgccatgttacccaggctggtcttcaactcctggactcaagcgatccacctgcctcggcctcctaaagtgctgggatttcaggtgtgagccactgtgcccagcccgaagaagctttatctgatctgaacctgatttagataaggaggtcctggactttgttccaatgctgcagagagtgagacttctgtggggagaggagtgtcctttgcatttgggaaagatgtgaactactgtggccagagggtgaactatggtagattgcttctaaagatgggagcagcaatgtttcttcccaagcaacattctcctttgaaatgtgactttgccacccatcgcatcaagaggtaaggtctattctccctccttctgaatctgtccctgtgacttgctttcaccaatagattgtggcagaagtgacagtgtgcaagtatgaatggggtctgccagtaccatgtggagcaaagggaagcatcctcatggatgatgcctgaattcttgatccacagaatagtgagcaataaaatgtttttttctttttaagcagctaagctttgaggtcatttgttacacagcaatagatagctaatacaccatcaaagagttctggggtcatttcaaaacaactcaggaggcaaattgaggagtttctcactaaaagtggggaacttgcacatgcctgtaatcccagctactcggaggctgaggcaggagaatcgcttgcacccaggaggaggaggttgcagtgagtcaagatgacgccactgcactccggcctgggtgacagagtgagactctgtctcaaaaaaaaaaaaaaaaaaaaaaaaagaaaaagtgggcaactcaagcatcaataaaggtattaactgcaatggtttgtagcatgctacgtatatttaaatatgtgggttcaagataattaaattaaaaaatccctggttacctttagaggatattgggacatcaattcattattttgaacattgctaaataaaaaaacaagcatttatcctattttttgtacaacctgtatttcaaggtaaccgaatactgttaaagagaagctatttgcagaataattctgaccaataattatgtaaaaaaaaacctgaatctcatcattttgcaacctctgatgatatcacggatttaggtattgctaaaaccatcaggtgatagatgatcaggctgataacacgtgcacctgctgccaaccttaacataaaaaataatactaaattcccctgtgaagcctgcatgtgccccaaaacccccaaatcaaaacaaacccctcaaaacctgagttaaagcaagcttctagatctaacttctagcttacaaaaaatgagaggaagagaggactataccactaagaaaatgcaaccagaaaattccagattgcaaaaaatgtaataggaccaaaaccctgagttcttcaataaatacatgacaatttatagcttaaaagaga

SEQ ID NO: 143205 - DNA, 1153 bp, Homo sapiens
tccagataaaagacacaacaccaattaaatgtgaatttcagataaatactgaataattttttagtatccatatgcccccagtgtgacatggggcatactgatactcaaaaatctgttacttggccaagtgcagtggctcacacctggaatcctaggactttgggaggctgaggtggggggattgttgatcccaggagtacaagaccagcctaggcaacatggtgaaaccctgtctctacaaaaatacaaaaattagctgagcgaaatggtgcacacctgtagtccaactactcaggaggctgaggtgtggggatcgcctgagcccgaagaggtagaggctgcagtgagccgtaatcacaccactgtactccagcctgggccacagagtgagaccctgtctcaaaaaataaaaataaaaaagtagaataaatataattaaaatttaaaacattttaaaatgtgttatctgaaatttaaatttattacaatttttatttgctaaatgtggccactccaagtgtatggagtatttattctaccatgcagtttttaacacttgcatctctgcatctgcttctgttccaggacagagaaaaactaacacatttctgctgtatctaagaatatgtagatatacctgtgttttgattctttctgatttcagtactaaacatccctcattatcattctcagggaaaagatgaatgtagaatctctgctgagctagtatttcctgacaccctgtttatgtgccttgtgaattgtgggcattgccatgtgggttatttcatttcatcttcacaatcaccctccaaaagtaaaaaacaaagactgcctcactcaaatgtccactgccatcagtgccccatgagtatatatacggtgccaagctctgccatgatctctccagagaagaggagtaaaaccaaagaagtgaagacgtgtctgactggaagggaacatctgtgacaccttcttttccaaatgttctttaaagtttaagcagattattgtaaaggaaatatgaaagagttagtacttaaaaaaaaacctccttgtatcaaaatgtcccattcccagcctctattcaatttcaatcttttaaatgtttgttttcatatttacaatcatggtgctatgtaatattcttaca

SEQ ID NO: 143206 - DNA, 277 bp, Homo sapiens
tgtgatcagcggtacctcaaacgtatcagaaccatatattttttgttttttgtttttttttttgagacggagtctcgctctgtcgcccaggctggagtgcagtggtgcggtctcggctcactgcaagttccacctcctgggttcatgccattctcctgcctcagcctcccgagtagtggaattacaggtgtgagccaccgcgcctggcaagtccatgaacttttaatgtgattactgatctatttggatctcaatctaccatagtattttattgtct

SEQ ID NO: 143207 - DNA, 408 bp, Homo sapiens
aatctggatcagggcctacaactacccactcagtaacgggaaaggactgaccaggaggttagacggagcccatccactttcctttttccacaggggactaaagctgggctgtcaaacacacagaaaacgggaattctaatgcctctgcctacattcaggccacaagttacagtcccaaagattgcttccaggcagcacaatagtctgacagtcaaagcaagtgctaccaagggaggtataagtctgtaaagagacttcagagccctttactgtgccgcagtcattttgtcagacttgaggatcaggcagctatagactcttacaatgtcaaagagttgaccaagtttgggagcaagcaaactggatgattaactgagtgagcctcagcagggcccacaggctcccagt

SEQ ID NO: 143208 - DNA, 720 bp, Homo sapiens
taaaacaaaaatgaagaaagttataaagcatatgaaatatgtataaagcaaatctaaatattatttaggtatatttatagattaacattttttaaggaaggaaatgaaaaacatgagacttaggatagtggttgcctgtgggggtaaagagaagtaaagaagcaagggaatagaattagaaatacagaagaacaaaagagagaggagggctctgagcacccaagtagctatcacatcattaaagccttatgtctacctcttgagttcttatttagatccatactcttatttaaaatttcttcaagttttgctatagtttctgctggccagtcactgagctgagagtgtagaaattaatgatatatataaaatctcccctcattcttgtcaggaaggtgtatgataaacaaattaatatattagataaaatctctggggcccagcagtgcaatagagtgcgatacaccgggaatctattttagagggggagggtggtcaaagaaggtcttttgcgtaggagatagggacagagcatcctaagattcaggagagcattctagtcacagggagcagtgaattcagaggccccaaggtaggagggagtttggtctgtccaaggaaagcaagaaggtcagtgcagctgaggcagagtaagtaggaaggagagaggtcagggctgagatcagggaggtagtctgaggcccctctgtgggggacctg

SEQ ID NO: 143209 - DNA, 383 bp, Homo sapiens
cagagaagcaccttataggaatatagaactttgacatttacaaagttctttcacatgcattgttttatttatcctcacaataactcagcaaagtaagcaggagccacagaaagatgaaatgctttggccaaaggagcacagctagtaagcggcagcactgcggctagagtccggattgtcggcctgtggattgagtctgccaaatgaatagtgatgcaccctaaacctacctcaggttaaagtttgagtaatgggtctaagatatgattaaataacactgaagttaggaaaataattcggcctaggtcgattccacaagaagaggatgaagggctttggttattttgaaaactgcccaacttttaggtaagttaggacaagaa

SEQ ID NO: 143210 - DNA, 285 bp, Homo sapiens
atgaaggttaaagacactgtaccggtagctaatacaggatcatctgaaaccatgttgtacccttcatgaaaatgaagggtaggctctaatgaaccccaggcattatgccagggctcatgaggtcagcacactgtactaagggacaatgacacatcagtgtggcagggatggggctaataccacgatggagacaaaaccactttagtggtggctaatcagcagagtgactaagggctaatgtggggagagcagacaggctgattttttatgaagattgaagacact

SEQ ID NO: 143211 - DNA, 210 bp, Homo sapiens
cgtgccttccctggagtgaggagtccgagctctcctctccgtctctgctcatgatgggggccatgctcccccgtgcccttcccagcaaagatggggcctccagggctccactcccactcccgagccccttcagtgtggacacatctcactgttaccctggtatccgttcacagtcactgagacttggccagcagctttgctgcctttgtg

SEQ ID NO: 143212 - DNA, 252 bp, Homo sapiens
gttgtcataagagaaagaaggaaggaagaatgaattatggagacagcgatggtcaggtttttaattcagtaaaaaccacaaaaaacctttatttctaaactgaaagtttcttaccttaataactaatcagagtgtacattttatttaatctatagggattgtagtagtaatttcctataagaaactagaaagtattctttatttgacatgcatattaatatgtcatatgccttccttccttctcttattgga

SEQ ID NO: 143213 - DNA, 376 bp, Homo sapiens
tcctgagtggctgggactacaggtgcgcgccaccatgcccagctaattttttgtatttttagtagagacggggtttcattgttagccgggatggtttcaatctcttgaccttgtgatctgcccgccttggcctcccacagtgctgggattacagactaactttctgaaggactcactgctagagaattaggtaggtttgttttctcccaaatatatggaatatagcaaagaaataagggaaaatggtggtttctcatccatcctgttttgcctgaggtacctgaagagtagactcagtgtgaccagactggaaggattcctccacagaaacagtcccagcagacaacgatgtggatgttcagatgccacaggggaa

SEQ ID NO: 143214 - DNA, 320 bp, Homo sapiens
ttattcagcaaaagcccaagcaacacacaagggaaaaagttaaatatttcaagaacctctgactcaggacatctgtaagtacatttattctgactttgttcattgactttttttacttactgttaggtacaatgccaaattagatttcctaaaatggagtgatcctagctgctaccatcatatttcagggaatttgcttgctgacgtgttaattctgcttataaaatagtaagagttttaggcttggcattcaaagatctaagttttgcttctttaccacttattgactggggcatccatagatttcctgtagcacttct

SEQ ID NO: 143215 - DNA, 811 bp, Homo sapiens
tgaagcagacccatgcatgtgaagggtggacacctcaggtgacatgctttatagttggcctgagccttgacccagtggttcaacctgagtttggtcttggtaccattcaggtgtttgtgagctgagactgatgagtaggaacaggtgttttatatctcgtcttttgtcaaaagtaaagactcattcctttggtaacccaaccaaatcaggatcagaaactttacaactgaataaatgaatggatataactgtatttgaagttatttatattaataccatgaaatatatttctccagttggccacaagcagtcaattgtcctcttgttctcaaatatctagttactaggctttctaaataattttttgttattgttgttttactttagctctcttcctgccttcttccctggcctcttggagaaggaaatggaaacatgggctgtgtttcatgagagttaaaaactttcaccccagttacctttttatcttggaaggctgatctctgcatctccctccttcctgtcgctcgggggattgaaacctcagtggacactgggcgcagtggctcttgcttcttatcccagcactttgggaggctgaggcaggcagattacttgaggttgggagtttgagaccagcctggccaacatggagaaaccccatctctactaaaaatactaaaattatccgggcgtggtgacacatgcctgtaatcccagctactagggaggctgaggcaggagaatcacttgaacctgggaggcagaggttgcggtgagccgagatcacgccattgcactccagcctggg

SEQ ID NO: 143216 - DNA, 549 bp, Homo sapiens
accttggtctcccgaatgctgggattacaggcataagccaccgtgcctggcctcaaattgctttaaatcagtgaaaaatcttaaaagcagctgtacacacacacacacacacacacaagacattgtgtacagaggaacaaagataagaatgattacaggccaggcgcggtggctcacgcctgtaatcccagcactttgggaggctgaggcgggcggatcacaaggtcaggagatcgagtccatcctggtaaacatggtgaaatcccatctctactaaaaataaaaaaaaatagctgggtgtggtggcacaggcctgtaatcccaggtaactcaggaggctgaggcacgagaaccgcttgaacctgggaggtggaggttgcagtgagccaagatcacgccactgccctccagcctagtgacagagcgagagactccttctaaaaaaataaatgaaaagattgcagtgattgcagacatttcttcaggaataatgcaagtcagaacagagtggaatcacacctttgaagtgctgagggcaagggagaagct

SEQ ID NO: 143217 - DNA, 321 bp, Homo sapiens
gaatttaacaatgtaaaagatggcttctaagaagaaatgggaaagcttcataaattattgatcaatcctcttagaaatgcattctcacagtatacaatgattaaaaatttttactctaaacagctcaaaatatttatatattatttcagttatctttgtaacatatcttttaaaataagactattattattattatgattttgagacagagtttcgctcttgttgcccaggctggagtgtgatggcgcaatctcagctgaccgcaacctccgcctcccaggttcaagggattctcctgcctcagcctcctgagtagctggg

SEQ ID NO: 143218 - DNA, 645 bp, Homo sapiens
aagagattggtaggtagcagaaatattactgaaacccaggtgtcctgcctctgaatcctaacctcactcaggctgctgctttacaacgttcctgataagccactctcacatctgtgcctcccccacttcctgctgatcctctctcaggaacagagctcagaagtagaaacactttttgttcaggcatcctctgaaaagctgggagtggaggtctggtgaccattaaacacaatagggatgaaacattcttggtctgttttccatttcccgcccaaactcaacatgggactgaatttaagctggctttagtgtgtgtgtgtgtgtgtgtgtgtgtgtgtgtgtgtgtgtgtgtgtttagtatgatacatcttctcatttccaactatagtactgctttcaccatctgtttgtgatttctctgtggcaaacctctcagatccccctgagaaggggcgttgtttaccactcctttgttggtcttctcctctgttgacatctactctgcttaaatcccagagggttaaattccacaaatatttacagaaaaactcctttgttcagggtactgggctggacccagcagggaatttaggggtaagagacattcttgctttgccaaaagcttaagatctagttaaaaaaaaa

SEQ ID NO: 143219 - DNA, 255 bp, Homo sapiens
tgcatgagtgtgagtgtattgggggtggttgccctgctggggttgtgtgagtgttgggtggttgccttgctgtgtatgaatgtgagtgtgagggttggttgccttatgggtatgagtgtgagtgtggggtggttgccttgcagagtgtgagtgtgagtgtgaggggtggttgccctgctgggtgtgcgtgaatgtggggtggttgccttgctgtgagtgagtgtggggggtggttgccttctgggtatgagtggg

SEQ ID NO: 143220 - DNA, 527 bp, Homo sapiens
gttaaacagaattaccatgtgacccagcaagtccactcctaggtgtcgacactggaaattggaacagggggactcaggtactcagatgttcattgcagcactattcatgatagccggaaggtggaaacagccccagtgtccttcagctaatgatggataagcaaaaggtggtccatccatacaacaaaatactaatcagccataaaaaggagtggaatgctgacccgcgctacaacataggtgggcctcaaaaacacgatgctaaatgaaaagagacaatcacatggccactcaataccttgagtggccatgtgacaaccaaaaactgcttactgttttattttctaatgaaatgttccaatgtttaagtctatctcctatagcggaaaggcaataaatacaaggacttgaaaagagcaacagacttgtaagatatgagttcgctttgggctagctctgttaccttgtggttagtacttaggtcaccaatttcttcacttataataaggacttaacaccatctgctc

SEQ ID NO: 143221 - DNA, 624 bp, Homo sapiens
gcttagaggatccccatccgcgtgctgatggatagattttcagctttctgtgaaagacagtaaacccactgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaattggctacacagtccctaagtcagctatgggaagtagcctccatgctcatca

SEQ ID NO: 143222 - DNA, 397 bp, Homo sapiens
cattctaactggtgtgagatggtatctcactgtggttttgatttgcatttctgtaaggattcccagggttctaactaactacaaggttggaattccaatatacaacccaccttgtttgtcaggaaatagaagggaactgtcacagcaaggataccaggtacagaagtctaacttgaaaaagtctagagaatgtaaaaaagaatcaactcaggaagccagtaaaatgacaacttttgaaattcttttagtactctactagacaattagtatccagagtcaaatgtcagtaccccagggatacagagattatacacagcaaggcaatccactagggtaaggggaaaaataacagaattcgtatttaaaatttctggttagaaaaccaaacaccacatgt

SEQ ID NO: 143223 - DNA, 162 bp, Homo sapiens
aagaaatagaagttaataaacaggaagcaacatataaaaacattgagtcaaagagatggcacacaaaagctgaaatttccattgctgccaatattccaatctgtagatgggtctttaacagtccccaaagtagggagcccatgagcccatgttctcaggcct

SEQ ID NO: 143224 - DNA, 868 bp, Homo sapiens
gaaacatattttacagctatcaagtgagcagagacctgacttaaactaaagcagttctctacctcatggcattagtcaagtagaccaagctacttctatatattagaaaataaagagtcacagaccgggcacggtgactcgtgcctgtaatcttagcaatttgggaggctgaagcaggtggatcacctgaggtcaggagttccagactagcctggccaacatggtgaaaccctgtctccactaaaaatacaaaaaaattagccaggcatggtggtgtgtgcctgtagtcccagctacttgagaggctgaggcaggagaatcacttgaacctgggaggcagaggttgcagtgagctgagatcatgctgctatagctccagcctgggtgacagagtgacctcgtctcagaaaaaaaaaaaaagatagtcacagagaactttatgctagttattccaactttataagctctatctaacaaaacttacatggattattaaaggcagatgaaatctggcttagaaacttttccctcagatattttgttatattagtatttattatattagtaaacatttcttttttaaaatagtatttatgactacttaaattctgccctggtatattttaggaatgtgggattatttagtgtactgtttagtcaagtttgagctttgtggtgttgatagaagccaacaagatggcttttattattttatgcacatggactccaggaatgtgtcaatactccctgggatcatgttcctcacttaacttttaaaaaattatacagtaattcactcatacactcacattgtagaaatcaacacattaccagcaaagctgaagatcccttgaccactacccacaat

SEQ ID NO: 143225 - DNA, 257 bp, Homo sapiens
atgttagagcttttcatgatccctttaaagttccttttgatgatattgtttccaaagatgcagagtggtaggtattagaaatggatatacattcaccttttgggggctccgagagtgattaattttagagacgtcgccagtaaatatttggcaatgacatgtacgtctttaccctcctggcgctgacttttgtcacagagaagtgtggggccacctgcacaggagatgcatgtcttcataaatgagagaggcaggtt

SEQ ID NO: 143226 - DNA, 268 bp, Homo sapiens
aaaagccttggagcttgagatttatttaacttcttccctaagatggaaggaaatgtaatccatacaacatacttcctaaaactgaatatgaaaaaataaatgtgaaaagttaaatagaaaagatctgatgaattatgcttcaaattattccctttgcaagcttactttaacctgaagcattgacaatgtgacacttaaaatgaagccacagaacacatacctctctgtttcatcgttagcaccacaagctatacagaaaaccttctca

SEQ ID NO: 143227 - DNA, 440 bp, Homo sapiens
ctggatcctagctgggccaggctggggagctggatcccggaatgctcgaggggaccaaaagtagggggtgggggaggctggatgcctccgttccataacataatcatgactgccaaccaagacttacacagtaccaggcaccattctaggagcttctcgtggattaattcatttaatcctcacaacagcccaaggtggacgtccttctgagaccactgtatgggagtgaacagtgtggtccaaggtcgcagagctagaaccgacttcaccgtcctgctgctagctaacgcaggtccctggtagctgtgtcaccccctgcatggctctcttgctgtcttcttctcccagcacacacctgcccagggttaaaggatgccttgcctccactctgaggagggaccaagaaatgctggactggctgtaggcagagatgctcaggg

SEQ ID NO: 143228 - DNA, 325 bp, Homo sapiens
aattccctcagtatcacgagaacagcatgggggcaccgcccccattatccaatcacctcccatgtggtccctcccccaataggtagcgattacaattcgcataacaattcaagatgagatttgggtgggaacacagaaccaggccatatcagaagtgcctcattaagtccaagccacactcaggagagggaattaagatgcacctctggaagggaacagtatcaaatgttttgaatatatgttaaaagcaaaattataactattgtttcaggtttttgaaaatcaaagacttcttttatctaattatttttcattaactctttca

SEQ ID NO: 143229 - DNA, 701 bp, Homo sapiens
cggacgcgtgggtcgacccacgcgtccgggcaccactgcattccagcctgggcgacagagcaaggccttgtctttctttttaaaaaattaaaaaatctgggtttggaggcctagagttgggtgggggagtgtcaatcccaaccccactctaacccctcctgaaagccacaggaagcatctactaaatgtcctcaaacagggttctgcaagcctttaaaagaatctttcttttttttttttttccagactgtgtctcactctgtcacccaggctggagcacagtggcacgatcttggctcattgcaacctcggcctcccgggttgaagcgattctcctgcctcagcctcctgagtagctgggattacaggcacctgccaccgcgccaggctgatttttgtatttttagtagagacggggtttcaccatattggccaggctggtctggaactcctgacctcagttgatccaccctcctcggcctcccaaagtgctgtgattacaggcgtgagccaccacgcccagcccagaatctttctttagagtcaagaatcaggtcacaggcacccatgtcccatggcaggagctggctcctgtggcctaggtcagaaaggtttttcggtagcaaaacccaaaatcgaaaagtcacagccccttttatctagaataaactgagactcttgtttgttgagcattttgcttt

SEQ ID NO: 143230 - DNA, 512 bp, Homo sapiens
ttgtgagtgtacaatgcaatatgccaacatttggaagctctgcaacactcagcaaatggtttccaaacaatccatgcatgatatcacaaaatccattcaaagtacaacagagactgatgtgttttagtgaaacaatgttcaaaaagtcacagacatggcttcagattccacatcatactaataaccttgaagaaagtaacacttgtcaagttttggtgtagtatcgaagaatgttcagatttatctgaaaaagcaattaaacatactctccccttttccaactacatatctgtggtgacagcagtttttcttcatatgcattcaccaaaagaacacatcctaacagactaaatgcagaagcagatatgagcatccagcctgtcttctattgaaacagacactaaagaaatgtgcagcagggcgcagtggctcacgcctgtaatcccagcactttgggaggccgaggcgggtggatcacctgaggtcaagagttccagaccagcctcgccaac

SEQ ID NO: 143231 - DNA, 277 bp, Homo sapiens
agaacaggttattgtgtctggcacttaggaggtcaattgagacccacgagagagcagtttcagtaaatattgaagttggaagccacacttcaatttcaacaatgaatagaatatgtggaagttggggcggctagggtagcctactcttctatgaaatttggtggtgaacaggagagatatggactgtaatttgagaaggaggcagagttaaggaaagaggagatctgactatgcttaggatgaggaagcatgaagacatttgtaggcagcagggaag

SEQ ID NO: 143232 - DNA, 452 bp, Homo sapiens
aaaaccactgacagatgacagactctacttagaagtgaaaaaaatatacatatggtaaaagcagaacaaagtagaataggaaaccctgtcaacaagattaaaaggcgaacaaaaatctagcaaacacttttgctatgtacatatgacaaagggttacaaaaaagttatgtttcatcaacagggaaaagaatatcctgagatataaataggcaaaagaaatagataatctacaaaataataaatataaatggtcagtaaacacatgaaaagatggccagtctcatgagtaatcagaagaatgcaagttaaaatactgaattttgtttacctattagccagctaaaattaaaaagattgacaatacactagggtttgaaaggggatagacaatggaagtcttatgcactattagtgagagaataaactagtatgtttccgagagttggtttggc

SEQ ID NO: 143233 - DNA, 442 bp, Homo sapiens
tcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgt

SEQ ID NO: 143234 - DNA, 440 bp, Homo sapiens
tggggcaataaaaccaatggctgcccctgagatacttaatattgtcgggaaagatggcacacaaacaggtaattttaacaggatgtggtaactgctgtaacatagggatgcatcaggttatgaggcagcccagacaagtggtatgtaatgacatcccttatcactgccatttttttgtcacagctcatcacaggtgtctgttcctggtcttcagatgggttactgggatcctctttagggaaggagccatgctgaagattcagtgaaatggagaatacagggattctgagagaatcaatgggacagaatgtgaggggagatgagtggtctctttttgaccactgagaaaacatttcctgagagctcctctgtagacctgattggtgctgtgctgtgtgctgtggatacagatatgaagaaaacattatcccagcgctcca

SEQ ID NO: 143235 - DNA, 214 bp, Homo sapiens
ttttttacgagctgaatggatgtaccacaatttacctcaccagttcaggagaggctgtttttcagatgtaggactccaaccctttattggtaatttcctaacccaaaaagcagtttgatgccaaaactaactgagtaggaaaaccagagccgagtaggaatggggttctttgtggtcttggttcatctcacttagtgtgaatggctacatattt

SEQ ID NO: 143236 - DNA, 117 bp, Homo sapiens
caaactgcatccagcaaaggactagtatctaaaatctacaaggaacttaaacaagtcagcaagaaaaagtcaaataatcctatcaacaactggacaaatgacataaataggcatttc

SEQ ID NO: 143237 - DNA, 445 bp, Homo sapiens
taccaaattatttgcctgttaggaatgggttcagctacaagttacagaacacccacctataaaatggcttaatcaaaggtggcttctcacttatggactacagtagggcaagaatggaagcaggacggtcagttaggaagctctctctcaagtagtccagcagcatcatctactactggactagatggtttagtggaggtggaaagaagtcaaagactcaggatacattttgatagcatcaacaggctttgctgaaggatttaaaggtaaagggatgagataaatcaaaaacagctcgtagaattttagcttgaacaacagaatgagtaccagtgacatttactaaaatgcacaagactgagagaggtgcaggtttgggggtgaaaatcaagattttggggggacacattaagtttgagatgccagtctgacattcatatggaga

SEQ ID NO: 143238 - DNA, 301 bp, Homo sapiens
aggtctgagtactacacgcctcaactttctctgtctctgtggtctgtttctcacccatttctctctctctctctctctctctctggattcaggacttccataaggaaaagttccctttgtgtcactttgtagaagctctaccttctctggattcagacatgtgaataataaatgcttctgaagctgacccagcaagccacaattgcttggagaaagaaaattgcaaggaaatggccaacccccttcaatgtctttggcattagttgtaatgacagccaggcaggttcaagcatcctcaggg

SEQ ID NO: 143239 - DNA, 539 bp, Homo sapiens
ctggagcctcatacttgctcttcctagcctaaattgtgggcaagatggaaactgccagacttaaatgtttcactcctctctgccctgcacagattgagtctctgtgctgcctctgtgacccccagtcagagtgcgccatgcatgccttcccatctcccttacaataaagcccatacccttggccagtcttgcctcagctcttctcatggctgtcttgtggcctggccacaaggaaatgatttccatgctttcgcctgtaagccttggccatgcttacctactgcctgaggcaccattcctcttctcccttgcactggctttctcctcctccattctcaggtgtcacttctgagaggcattgctggaactgagggccactcccacggtaccatttgcctccaattctggacggcttggctacatgcccctttcatagcatccttcggttctcttacaatgacagttctccagttacttagttttatctttgttgcagttgtcttgagggtgggataccagggtaagatcctctagagcga

SEQ ID NO: 143240 - DNA, 389 bp, Homo sapiens
caatacatatttagagagaaagagagggagagagagaccacattcacataagtcttattagagtatattcttataattcttctattagctattgttgttaacctgctacgatgctaattttcaatcacaccttgtcatagatatgtatgtatagaaaaaactaaagtatatattgagttctgtactctctacagttgcagacatctacggggggtcttaagacatactccctgtggataagggggaactactgtattccagttgctaaaatatgattaggttgatattgagtgttattgttaccgagtgcttgcaggaaaatgtaatttatcctagtttgacatatataaaacctgttttacaaatacaatctcatctaaaaataaaaa

SEQ ID NO: 143241 - DNA, 117 bp, Homo sapiens
atcccagccttttgctcatcttaattgagtagaactagtgatcactattcttgcattttgtttttctaagaaaatatgatttaagactcctcaagctacagatttgacattttgtta

SEQ ID NO: 143242 - DNA, 284 bp, Homo sapiens
ctgtccagagtgactgtcttcctgcttttctgtgttttgcaattgggctggtgctgcagcttccccagccagagggactgcctttccaatggcctgaggagggcaaggggtggcccctgaggctctcagatgccccatccccatgctggggtccagtgggggaacatggatgatgctctcagttgggtgcaggctctgggccccctcgctggctggcactggactcgggtcagccgggggctcccaccgcagactgtgcaggccactcaggtctcctttatcta

SEQ ID NO: 143243 - DNA, 172 bp, Homo sapiens
cttgaagcccagtagtattttaacaaatctatgaattttagattttaaaggcagaagtggctcttgctccccattggctttttctgcctttctgggggtttttttctccttgtcaggggcaacctgaagccctacctgggagcagagaaagagcaaggcacccggggtttca

SEQ ID NO: 143244 - DNA, 296 bp, Homo sapiens
tatttttttgcatgctacttaatttaattcaaaatatacagagttaatatgcttttattttaatgccatcctctgcaagttagtaagaaatatgctgagttcaaaaatgcaatggcaaatccttttggctgatccatgtgctgaagcaattctaatcatgtaaacttaatctactgcctaaaaattctacagaaatctcttataaaacagttttaactcagtatcattataggtgtattggaagatggtttgctgttgtgttggttgtttttctcatatagttagtgaaatactta

SEQ ID NO: 143245 - DNA, 371 bp, Homo sapiens
cttggtaacaatgccaataaaaggagtatttgtgattcttcagtcaagccagaaaggatgacaccagaaattgctttgactcattatcacaatttgcagagataagagtgcattcaggaaggcttgagaagttatacatagggagtgtccaagtactcagagattaaatgaatgcctcaggaaacagtaagtctcacatcatcagtgggatattcaagctagactgccccttggcacatatcatggagagaacatgtggcaagaaatgaggatgaactagatcagatatccagtttcttctcatctaaggtctgtgaattaaaataaataatgctaatgatcttagtgtttgtaacaacttaaggtgggtt

SEQ ID NO: 143246 - DNA, 566 bp, Homo sapiens
ataggccagctttagtgacaaagctcagagaccaatttcaactttcacagctaatagaggaaatggatctgtggggatagttgcaggtatggttggatctaggagctcaagcaagatcatgaaggttctttttcccttttttctcctttctactttttgtttctccatttcttctcctgctctaagccctgtgtgtcactgccttgctttgggtctggcctcattctcttcatgcattgggtaagacggattctagcattgtcctatttgttctgtgcctctcttccttcctcagaaaagagaagcaataccttccccctccccatctatctatcaaaaatagcggcagggcactgattgtccttactcggttaatgaagccatccccttacctacaaattgagaggggatagtacatatttgacagttcaggtttatgtgacatactcactcccacaggccaggaagcagaatgctgttgctatctacttcatccaggaatttttaaaatagttttttctgtctatttctatctgctgacctccttctaaatagaccatctgcca

SEQ ID NO: 143247 - DNA, 327 bp, Homo sapiens
tgtgtgtgtgtgtgtgtgtatgtgtgtatacatacacaatggaataatattcagcagtaaaaggaatgaactattgatacatgcaacaacatggtgttctgtgaaagggccatatgtgcaaaacgacccccaaatggtgaaggagctgaaaaaccaaagaaggaggcagacaaatccaatttgtgggtatgggatgatttattgggggaacttacagacgggaatgtcgtattgggtggctgcaatacaggtagatctccacaccacaaccagacagacccaatatgtcttatatcttggggaaagtatacatgctctggaaggaat

SEQ ID NO: 143248 - DNA, 313 bp, Homo sapiens
gcaacccttgataagttttccaaaatttgtaagatcatatgttataagcactcctgttttgttttgatgattacacttttaaaacagctttcagtatgctttagctgtttgaacagtgagacatctttttcatagatagtaaacagtataaaagattgtttttttaaaaaaatgcattgttagacatttaaagattgtgccaaaaggaaggtttattataaaaaactgttaaatgtgcttattggccctcagtttctacctaatcgaatgacctatacccaaaataccgtttaaaggtaaaactggtgaagta

SEQ ID NO: 143249 - DNA, 435 bp, Homo sapiens
actttatttattaccattgagagggatcttaaacattaaattactttaaacttctgttttagagttgggaaattaaagccttgataaattaaggtattttaagcaatgtttattagtccagatgagattaaaacctggatctcttattccccagtgtcttagcttgggctggcataaccaattaccatcaactagatagcttataaacaacaaaaatgtatttctcttagttctgctggaagtcagagatcagagtgccagcatgattgagttcaggtgaggcccctcttctggtttgcagactgaaggcttctcattgtatcctcacatggcgaagagtagagcacagaaagcaagctctcttgtgactcttataagggtcactattcccattcatgagtgcttcactcttatgatcgtatcttattctaatta

SEQ ID NO: 143250 - DNA, 121 bp, Homo sapiens
gaggaaagcgagacttaagcagagacggttcctctccaaactagctcagagcttgcagcttttccttagggaagagaaatggaagactgacaccagaagctggtctgcatcgtttctggtg

SEQ ID NO: 143251 - DNA, 238 bp, Homo sapiens
caaatgactgtgagctggattccaaggtcctccaggaaagaagagagggcccagggggctgggaggcagaaagtgcaggagctgggtggggggcaaactcattttagtcctttgtggtctattgagatgactaaggcctttaatggagcatttccacagtatgggatgcctgtcctctgacctgtgtgagctacaagtctccaggtcacgtgaaggtctgtgtacaccagtgggcagg

SEQ ID NO: 143252 - DNA, 444 bp, Homo sapiens
cttctcattctcttgacagtaacttttgcagagcagagtttttaattttaacaaaatctagctcatcaattatttctttcattattgtgcttttggtgttgtatctgaaaagtcattagacctatccaaggtcatctagatattttcctatgttctaggagtgttctagttttgtgttttacatttaggtgtatggttcatcttgatttttgtgaagagtgtaagatctgttcctagattcaaattttttttttttaatttttcgagacgaagtctcgctctgtcaccaggctggagtgcagtggcgcaatcttggctcactgcaccctccgcctcccaggttcaagtgattctcctgcctcagcctcctgagtagctggaactacaggtgtgcgccactacgcccagctaatttttttatttttagtagagatggggtttcac

SEQ ID NO: 143253 - DNA, 711 bp, Homo sapiens
taactgttctcatagggattgagtattcccacccatccctttaccgtatgtttctgatttatggccctgatgtgagttcagtatttttacatatatcagtgatgttaagagtttgtcttttagatagaatttctaccacgtaataagccttgtgtctgtagttattgaaaatatctattgaacaagttataaaaagaggaagaatccaatagtaatacgtatcctcaagctgctttaaagtataattttctgactttttattatgtagatctgtcaatcatttccttgtttttataagttcagctttagtctttgcctaaatcaatggcaactggaattaatgccaatttgatttagttatctgatgcttactattacagcttgctttaattttgcatgagcagcttcggtgtcagtatggcccagattagaatcgtctcttccgagatggtatctgttaactaaagatagcataacagacttagtagtagcagggatggttaatagccctctttctcttacttttgttttttgctttaaatatatgcaaaatatcatcttcacagagtttattctttccctgccatatcttaacctattttcctcttggaggctaatatagtaattttactgtcagttaccaccacataggatgtcaaaagtgtattagtattttttaaataaaatcaaacaaaattgtaaaaaaaaaaa

SEQ ID NO: 143254 - DNA, 249 bp, Homo sapiens
gcacaggggcagggggcacgccctgcagtcacacgtggaaagtttggcagcagtgatgctcccatttgagaggctgggccacccaggggataggagagagcgaggccacagtgtgaaggaagtggcaaggccattgccaaggtcccattgtagggggtggggtaggtggtggccaagcacaccagggaggcggaaaccggagacacaatgacacagagagacaggatcttcctgaaggcctcattccac

SEQ ID NO: 143255 - DNA, 312 bp, Homo sapiens
cacggcacgcgggcttccggaaaactcccgcttatgaagatgtgcaaccggatctgacccagagtctaaaaagatgatttatctgaagccgagctgcacaggggctcaaataagatgaacaacctaataaggccccaagatgtcctttggagggctcttgtctgcagctggagagccgtgggggagcaaagccaggagctggcggggtggtggggggcgggtggcttggttaagccactaattgtttaccaagcttagttactacatttttgggccagtagccctcgaggttgctgtgagcgacggaagggc

SEQ ID NO: 143256 - DNA, 324 bp, Homo sapiens
tctaaatctctttttcctgactgttggctctgatgcacactgatgattccaggcccaccaccagacacagacgcagcatccttccatagatagactttcctgcctgctccactggacgctcccttccacttgggaagtggggagtgcttgacttcatgggtttccctgccaactccaacctgtccatgcatcccattgcatcggagtgccgatcagtgactttgttctaatcctccaaatccccttcctgtaccttattttcccagctcttcttgcaattatgtaaggttcaatttctataataaattacttttattacatagt

SEQ ID NO: 143257 - DNA, 417 bp, Homo sapiens
tgctgtttattattgatgtgttggacttccttgtattctgtaaactaatccttcattggaaatatgttgtaaatatcttctttgaatttgttccttgtcttttaatttttttcttatgtcttttgataaatgcaagatctcttatttttaatataatggatttttaaaatgttttattactaccatttttatatctttttaaaacaagttcttcaataaacataaaaatatttccttctgatttaatctgtgtatgcaaaaatgctgtaaacatttccaaatatctgtgatgtaaccttaaaaaggtttattttttacacatgttaagagtccagtgcagactggggggaagggaaaggacacacagggatttctgctccacacagtcattcaggtacccagtctccttccatccca

SEQ ID NO: 143258 - DNA, 353 bp, Homo sapiens
tctgctatgacctcagtactacgtgtccaaaatctaattaatcttcttcttcatcagacatcccccatatcccaaataacaaataaaccaaaaacctagtttcttgtctcaatctagcatttctgtctgaccctatcttaaatgaaatcttttagaatagaacatttgaattaaaatttcctcttttttcttttaagtatttacacttctttctttgaaatatcttttagattttccttttccatttccccaagtaggaatcaatgtagaccttatttttgcaaagtttcctttcaggctcttctatttcagtttatcctgcttagtgatatggtagtactaataaatatacc

SEQ ID NO: 143259 - DNA, 274 bp, Homo sapiens
atttttaaaacacatggaaagacatgcagttaggtgagaaaatgggcttcagtatagcatgtataaattcatctctgtgaatctttatgatgtgggcatgtagtgtagatgttctctgagtagtgattaaggttaatttttttgactttttgctcatgtatttcatcaatttcctagaatgaacacaaattgtataagaaaacaaatttttttttttttttaagacagagtcttgctctgtcgcccaggctggagtgcagtggcacaatcccag

SEQ ID NO: 143260 - DNA, 558 bp, Homo sapiens
aaaaaacaaaaaaaaagctttcctattcagcttatctaaactttccccactcccatcagtgtttctgtgcagataattgtattctgttaggcctgatagaaggtgatgctgaatgcaaggtgtcctgtcagtctcacactgcacacacagcaacccgagatggcacttggtcagccgtctctgtttttctttgttattgcatcattgtcttttaaaactctgttgtatgtcggcttttctctgcagacaaaataacttttcttatatacctctgccatttcaaacactagccctctctatacttagagcatagtgtctgtaggattcacaatgcccagttcacccatgggaggttagagaaagctttttagtattgagatgaggtacagatgtgtgcccctccccctcttcaactttacttctgtccatcccagctgagatgacgaacctattcagagtttatcctcatgtcccatctgggctcagtatgaaacactggtgtttgcctttagttaccactaaatccaaagagttaaataaagatcttggcatcttttc

SEQ ID NO: 143261 - DNA, 263 bp, Homo sapiens
ccttgtaaaaccatcagatctcatgagaactcactcactatcataagaacagcatgagagaactgcccccatgatctaatcacctcccacgaggtccctcccccaacacgtggggattacaattcagattacaattcaagatgagatttgggtgtggacacagagccagaccatatcattctgcccttagacccttctaaatcttgtctttctgacatttcaaaacacaattatgccttctcaacagttccgcaaagccttaa

SEQ ID NO: 143262 - DNA, 610 bp, Homo sapiens
gctgaatggataaagaaaatatgatataaatagacaataaaatattactcagccatacaaaagaatgaaattggccaggtgtggtggctcacgcctgtaatcccagcactttgggaggctgagacaggcagatcacctgaggtcaggagttcgagaccagtctggccaatatggtgaaaccccatctctaccaaaaatacaaaaattagccaggcgtagtagcatgtgcctgtaatcccagctactcaggaggctgaggcaggagaattgtttgaacccaggaggcggaggttgcagtgagctgagatcatgccactgcactccagcctgggcaacagagcgagactgtcttaaaaaaaaaaaaagtgaaatcctgttatttcaacaggatatgttgatatatgatacacacatatatattcatgtgacatatgatatacacacatatatatacatatgcacacatacatacatacatacatataaatgacacattccaggtaagcttcatactaaaaaagagaaaattataaaatgataatattataactgtattacagttgggcactggggaatatagcgtttaaatgaccaacctcagttcatacta

SEQ ID NO: 143263 - DNA, 321 bp, Homo sapiens
atcatgccttgatgttgtattattaatcttaatagttcccaaaggatttttgggaaccctttaggaactggattcagtgcttaactaacaatggctgaaatttgctaccctgtgtaacttcagtgataccacatatcatgctaaatgaccaaaggatatagaagaatcagcttgaatgctgaaaaaaaggatagaagaagaacagctgaaggaaatctggataaggttatgtaaagtatacatctagacactatatgtaacaaatctatgcacgagttttaaaaattgagtttaaacggaagtagaacatacttccagaaa

SEQ ID NO: 143264 - DNA, 201 bp, Homo sapiens
aaacagtagatttctataatttttatttaacgtgaaagcccattgtggctaagtgtagacagcaaggatgtatggaaaaagatgaagttaaggagaacagaaaatgctaggccttagaccatgttaagaatatttggtctttaaaagctgtgggaattcattgaaaattcattaaattcattttgagcagaggatgtgggc

SEQ ID NO: 143265 - DNA, 390 bp, Homo sapiens
tttcttcaaatttgcattgtaaaaccatccttcaacttccttgaaataaattttactattttattagtgcaaacaaaatggtaataaaacactaatacagcgtcttgtatccaggggaagagctaaaattaacatagagcgagcagtgtttgctattacattcaattacctttttacttgagatttacattctcatccccttaatctccatagtagtggcttcaaaatcattcctcccaggctctgcccttcccaagcccccacagctggaagccaggcctcctgcccagatggcgctcaccccgggcatggagcctgcccctttctccacagctgcctcttgtcacagggtaccacttctctcccctgcttgtaattgtctcacgtctt

SEQ ID NO: 143266 - DNA, 1150 bp, Homo sapiens
agcggaaaagattaactgtgaactatgtgccaaattaaagtcaccttaaagtttctagatttaagggtttgttgtacaaggaatcagaagaaattattctctgcagtttgtcaattaccacaaccaaatttaaaatcaaatttagtttatttggaatggtttactttacttggttgaaatcatccttatcttctagaacagttgtggtaaatcaatctgtaataatttttattccaatatcttattctaactgtaaaattacttgagtgaatgaaaccctgccttctttagaactatatatggtttaaaatatgctgatttttaaaaacctctctcttagagacagtagagtaataaccggctacttgatgagaaaattctcttaatcaaacccttgttcttcatgctacacctaaagccaccctttcctgacaaatgtgtcatattttggggtagaacaaagatacctgaggcatgatgcatggcctacctcaacagatgacactgctgacagtcactttattcatctttcagtggctctctcaaataactgtctataattaaatatgctcattaatcttaaatagaggacctcctgggcaaatcaaatttcttgtctgatccatttttgtctagtctcataacacaaaaaaatcagatacaaaataatattttatttcagaaggaaattttgaatcttgaaatgatttatttatggtataagtggtattaattttttgcaacgtgttgatcttcagcatctagtttctcactgaaatagattcaagttgtgatcacatagttaagtgagacaatgacagatttttaggtttttagggtaaaagaaaacttcatcaccaaaatcaatttaaagggatgcttaagctgctgattgtgaagtgaaacaactcaagagtatcctggatgttcggataaatttactagtttttcatggacttgaaaaaataaaataaacattcgttttatccttataaagatggagaagaaaaatacaaaaatcagctgggtgtggtggcaggcacctgtagtcccagctactggggaggctgaggcaagagaatcgcttgaaccctggaggtggaggttgtggtgagccgagatgttgccattgcactccagcctgagcaac

SEQ ID NO: 143267 - DNA, 350 bp, Homo sapiens
gatgggctccagtggctgcgcagcctggggcggccgggaggctcctggcggcagtctccgcccgctcccgccccagatctttggaaacattcggggaggcctgcgggggatgggaggagaagctcagctctctggggaccaacccaccggcagccccagcccctctcctgcgcctccccgtgcgcccctcttgctctctcccaccctctcccgccccggcccccgcagggcgccttccgccgcgcgtggctgagccggggccgcgtgcaccgcagccgaggccgccgggtctgagcgcgtgcgcgcaggtggcgggggcgtcccggccgggggcccgcggactcaccgcc

SEQ ID NO: 143268 - DNA, 282 bp, Homo sapiens
ccctttactctccccatctctgtgtgcctgttctgctcttttcttcttctatctctgtctctccttcactcttggtctgtctctgtattttccagtctctttttattttctctcttctcctttcattctccctttccccccaattttttatagtgataaaacacatataacataaaataccatcttacccattttaagtgtgcaggttagtggtattaagtacattcatattgttgtgcagccattaccactctccatcttcagaatgactttcatctcgca

SEQ ID NO: 143269 - DNA, 785 bp, Homo sapiens
tttactagatgtgtatagagatgacacggatgggttgctgggtgaataattagatagcaaacctatttcattgttcttttgcagtgtaatgtcatccttaactctaaaatactaaatatttttggaaagtaaaagtgttctttcatcaagggaaagtttccagaggatattagaaaagtattttttaaaagttgtttacttataaaattcctagaagaatacagtgacctgctactattaaaaaatacttttcttccacttgagttgtttgtgctattattttcaattaatttatatttatgtattttaactccattgtcttttttatttttgtatcaagtgaaaatgttttgaaaatgactctggttaacaaattaattaaacattcaataaaatcacctttatgcctacatcagtaatttaaatgaatcatgttttgaaagttttttaaaaaagaaaaggtagtaggtttcagagcttgaattgaatacccaacaaaattctaaacccttatttagcaactgcttaataagaaattgtaaaataatcaagaataaatccaaatactgtaaaatggattggtaggcttatagataagaggaattctatagatatgctgtttatgaactgaaggtcatttgatgtcattattgaaaaaaatgaggccgggtgcggtggctcacgcctgtaatcccagcactttgggaggctgaagcaggcggatcaagaggtcaggagtttgagaccaacctggccaacatggtgaaaccctgtctgtactaaaa

SEQ ID NO: 143270 - DNA, 173 bp, Homo sapiens
tgaaaaacttaacgctatgtgaatattgctattaaaaatgaatctatggccacacattttacagttaaaaaaaatctcagtgaaacttagattcccactaacaaagaacctaaagaaccactgcctaaagacatttgctagatccgtactgagacctccctggggtgttgttg

SEQ ID NO: 143271 - DNA, 780 bp, Homo sapiens
attatgttcaaatcttgtatttccttatggatttttttttctagttattttatcaactgttgtggcaaggtgttaattcgaactaggattatggaattgccaatttctccatcgagttctgtcaatttttgcttcacgtattttgaagcattgttattataaggtgcatacatatttatctttgttatatcttcctgatgaattgactgttttattttcatgaaacatccctttgtatctctggtaacactttctcttgaaatgtagtttatctgatagtaatatagccatttcagtcttgttatgtttactctttgcatgttatctcttttctcattcattttctttcaactgacctatgtctttatatttaaagtctttatattgtagacaacatatggttaggtcttgcttttttttttttaatctattctgataatctgtgccttttttatttatttttagagacgatgttttgctgtgttgcccaggctattctccaactcgtgggcttaagcaatcctcctgtctcagcctcccaaagtgctgggattacaggcatgagccaccgtgcccagccagtctgtgccttttaattggaatgcgtatttcatgtaattactgatacaattagattaggtctcttttactgtttgtttttttatttgcctcctgttttttttcttcccctgttcctatttctgccttctttgggccaattgaatttttttttttttttagcattctaatttaacttaattcaatataacttaattgcca

SEQ ID NO: 143272 - DNA, 301 bp, Homo sapiens
ttgattcagagtgcttttagtgctgctttcatctgaaggaacatccttcttgtaagccttgcttttcctcctgtaggctggcagaggacagtggagcagccaacacacaaaactacagtttgtgcatggctaaagaccatggtgattttatagcatcctgggcattccacatccatgaagtaggaattggggctctgaaccaggcatttcttcttgtgtttcctcttctcctcttctggagagggatgaaggagatcctttgcaagaggcatgttcttgtgggaaggtcatcaccaccaga

SEQ ID NO: 143273 - DNA, 190 bp, Homo sapiens
agaaaggatggcaggccagtaggggaaggtgcttttgatctgggaaatgtgcaacacctcttggttaattagaccatagaaggagctgtggaaggggcaccctattgcttaacaccctgtggcacagactcattagctttgtgaatttccttggattgattgttagagttataaccttaagttattccct

SEQ ID NO: 143274 - DNA, 262 bp, Homo sapiens
agtctgggcttggactaccctgatccagtctccctcaattgccaatttccccaagaaatggtgttgcccagccaagagaggagagatctgtccacgagaaccttgtcagcagccttctcacatgaggagtgacgagaactgagagacccaaacaattccccgcaaggttttatttttggtatttttcgactgaaatgacagcggacaggtccacctgagaaagcagctgcatctgcctgccttttacagaaactggggtcac

SEQ ID NO: 143275 - DNA, 736 bp, Homo sapiens
gttggggaagcacacagaagggttggcatgaggagctgacacaaccagaacaccagctcccccaggggcagatgagagcacgactgtttcctgcagagccaggtgggaaaggtcagggtcacagaagggctggggtggtacggtgagctagatggagccctaccatgtggtctaaatggcccatgcatgggtcataaggggaaaccaggcacagaggaagagggtctcgcccacggccttccagggagtgagtgagttagcagaactgggggcttgaggccaggtttcctgggtcctatcagtgagtgaattgaagagctcagacctggagctcattctctgctcaagctcaccaatgcttgaggatggtggaatttgtggattcctatcttggtctgccttgcagttaggggttacctgtaccccacctatctgttagactgagccctaggagaggccagagcttggatcttatcagccctgcccccaccatataagaggcttagtaaatgtttgccgagtagaggcatcatcatgagccatggaacccactgagccaaccggaactcccttgggggttttgttaaggaggccacctccttcacagctcccgcgcctcatgtgccaaccgcactgggccccaagaatcctttgtcctagaatgtacccaccaactcccctgctcaggttagtgtcagcttcttagctggccgctaggacctgggcacagatctgg

SEQ ID NO: 143276 - DNA, 710 bp, Homo sapiens
gtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtctttttataggcaggcactagtaactaaaactgaaaactaagtaagtttatttttgaggaatgttgttaaaaatgtctttaggaagtcactaaaacttattggaagaaaaaatcat

SEQ ID NO: 143277 - DNA, 322 bp, Homo sapiens
gtcataatcaaatgaaactgagatccaagtgtattgcttaaaattaattcaagtttcagcaagtccaagtggttaccacctacttcgcacacctgcgtatctcaacagttgactctgctacatatacaatgtgatcctcacacacagattcatttatgtaccatccattcccaacaaacatggctggacgctaaccctcttccccaccccaagctgtgatcaaggctgcagttgttctccccaagccctctctctctcactcccatttttcctttcagtttctgatctctcaccagagaggctcaggagcaagatcttcagc

SEQ ID NO: 143278 - DNA, 858 bp, Homo sapiens
attgaaatgtggagacttggaagaaacattgataaccccaagaacccctggtgtgatataaatgttactgctggtgacagaaagttaaatgaatttgaaataaaaataattaatttcattgcttcctggttaaagggaccaggggcgcagaagctccatggaacactgtgagatttgtgatttagttgtaacagatttccataaatgggatttagaactggatttcatccattaaaaattgattgctctggataaagaacagttctaatttcaattacttggccctcatggtccaatgtggtaaatatttcatggcttggtgtacagggctgttttccaggtgtcatatattcacttaacttgcctggctgtgtcccttgggtgtctttttcttcctattgaaaatcttgtttagagcacagactctcctgttgtccccaaagtctggttttcctggtcactgagactggcatttcgcatgaattggttacggcaaagacgtttcttgcctgcgtgaagagatgtggtgcttctgggtattggtgtttcaaattaaatagtggactgttgactgctctgagcgtaattcttccaggaatgtgtatgctactgggcattgttcatctttttctgttgctgtctcttctctttcgttagactgcaagctttaaaaaataaatcccagtgcaaatagctttagaatttttctgattataaaaataatgtttttatggttttgaggtttacatttaagtctttgataggtgcagtaaaccaccatggcacatgtatacctgtgtaacaaacctgcacgttctacacatgtatcccagaatttaaagtaaaataaaaaaaagt

SEQ ID NO: 143279 - DNA, 429 bp, Homo sapiens
cccccctcctatcatgcagtgtctggatgtctgagtgtaaccctgaaagacaaatagggattaacttggtgtgtagctgggagaggaggaagggagagattccaagcagagagactaacatgagcaaacattgagggggtaaaatacctgaggaccaccatccaagtagttttctgtgtaaaccatgtgtggaagacatatagaaggtatcagaaatggagaaaatgaaagatgagggtcagattttggagttcctcgtttgtcaggcctgaagaatgaagactttatcaaggtgatcacagggaggattttaaacaggggaatgacacagtccaagttgtggtttcattagtatggaagatcaattttagcagcatttataatgatttaggtgatagatgaagagggtctggattaaagtagtgcaat

SEQ ID NO: 143280 - DNA, 320 bp, Homo sapiens
tttcctgccacccaaggaagctcacctacaagacaaaaagatctctggacctggtgtggtggctcttgcctgtcaacccagaactttccgatgttgaggtgggaggatcacttgagaccagaagtttgaggccagcctggccaacataatgacacctgtctcttaaaaaaaattaaaaattagccaggcacagtggtgtatacctgcattcccagctacttgggaggctgagatgggaggatcactcgagcccaggctgcagtcagccatgttcacgccactgtactcccgcctgggtgacagagcaaaaccttgtctca

SEQ ID NO: 143281 - DNA, 272 bp, Homo sapiens
atatttggaaaggccaaaaagagatttcctgccaactggcaatacaaaaaagaccccaacctgccaacacgttttgccaggaaatcggtgagtgttttcaaatgccctgtcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaactt

SEQ ID NO: 143282 - DNA, 329 bp, Homo sapiens
gcccgttccacaacaggttcttacttggaaaaacctgcggatcataagagaaggagacattactactcctcccagggcaggattatcatttttcaaagctcacatttatagcaaaatttcgagtctgcttacgcagcctgacctctctgagactcccttctgggctcaacctctcctgacttgtaccccttttgtagccccgactacctcccaatgtgactttccactcagcatccttcccctgcaagtcgaggagctaactgtggttgggaccatttattttcctggtacgcaggcctaaagtatcacatcatgaaaatgcattcaat

SEQ ID NO: 143283 - DNA, 691 bp, Homo sapiens
tgtgacaagcagagacacccaatcagaggatgatttttacggcggcgacagcagtgaagaggtacactgcttgataagtgaagtagtcttgaagcacagttgtttccttagctccaataagcactaaaacaagttgaaatgaaagagggaaaatcaactgctatttataaaaatgcaacagattgccatgtcagtccacagttgcatcaggttgttatggtaactttaaactgtcttttttttttttaattaacagtcagccaatttcacttttacttatagaaaccagttttgggtttctttctgttttttcattttaatctttgaatcacaggatgagaaacgatatgcagtttagtgctatgatagcaagaccagtaaaacactgagaatatactgttctagatctctggagaaattgtgttgcagttgctaagcattctaaattgatggttttctggcttccttactcccctgccatcttttcaccttagacctattaggactcattattttccatatggtcccagaatttgaagagttgtgccaattaaagtttagataatgagtcgtggattagtgctgggacttgccttacaggagattttctgtttgcaattatttagaatatggatatatcctataaattagcaaattcgtaaaaagttttaaaatgtttcaaatcaaactg

SEQ ID NO: 143284 - DNA, 450 bp, Homo sapiens
ggaatgagacgatgagattttgttttgggaactcctgggctcaattgatcctcccacctcagcctccctagtagctaggactacaggagtgcaccaccatgcccggctaactttttgctttttaattttttgtagagatgggtctcactgtgttgcccaggctgttctcgaactcctggcctcaagcaagcctcccaccttgcctttcaaagtgcagggattacaggcatgagtcaccgtgcctggccctgagctccttatctttaaaattgttgtaggacatcaggtggagcttttcagcactctgtgggacatcaggtggagctatgggaggacagaatcaaatggggaggaagaaaagaaaaattcctggagaatgccaccacttgaaagttaggtgacagaagaaaagccaggacgaagattgagcaggagcagtaagagataaag

SEQ ID NO: 143285 - DNA, 497 bp, Homo sapiens
caacctccgcctcccggtttcaagcaattctcctgcgtcagcctcctgagtagctgggattacaggtgcacagcccagctaatttttgtatttttaacagagacaggatttcatcatattgcccaggctggtcttgaactcatgagctcatgcaattcacccaccttggcttcccatagtgctgggattacaagtgtgagccatcgtggctgccctagtagaaagtcttaaagaagtattaaacatatactagcacctaactgagactttttccttatatcagttttagtttatatcttgtatacatatctcttataatcattttgtaaaccatgaatagtatatatcccctgctttgggaaacactgtggtgctatactattttattaatgttgttcagctacctggagtatctgaagacctagcacaggttttaccattcacctcctccaaaggggagaggatatacttaaaggggctaactttgaaaatatggg

SEQ ID NO: 143286 - DNA, 396 bp, Homo sapiens
aatgggttcttttctatgcggatgtgactgtgttccaataaagcttcatttaccaaaactggtgcaggctggttgtagcctgaggggcattgtttgcagacggctgctctagtgtataaacctaacagcacggtttctggtgcagggtgagcgctcacccagtaaatagctgtgtctggataatggaggctgagggggcaggaagcactgggcattcctggtggtgggtgggcaggtggcctttttcagggataagggggctagaggcctcttagagagtaggacagcccctgaccccaccaaccccacacttctgggcctcccagaccagccaaggatgagggcacaggtctggaggtgcttggcctgggattggggtgctgggtgagcagggtt

SEQ ID NO: 143287 - DNA, 904 bp, Homo sapiens
gcggcggcgcccttcgtactccgttcctttcccctttcggctgcctccggcctgacccttcccgcaatttctttctttctgactggcaagcgaagccaccgtggcggcttgcgtggactcacggaggccgctgcttctggggaatgatgcccatcccagaacccggtgggagccgccttcgcgcgctcttcggtaacgggaccctgggccccctccgtcagcagcccagcctctgaggtctgaggtctgagggctggcgtgcgggtagtgcctggggctctggctgctgtgtgtccacagcctggcttctgtttcgggggacgctgagaacattccttcctcctggagcatcgcttgtgaacgtgtgcgttgagaaaccacacctccttggaggacccccagttcctgtttcctctgaccgagagccgtttcttagaagagaaactacattccagtcatagcatttttaattactcagttcctggcacattaagaactctggtagagaacatctctagaagatagtgaggaaaagtggatttactcccacactgctactccttgctttatctgtagctggtagaatatccttactcttgtttttacaacttaacggcattttcgttatgatagagcccagagatctgcattttaaaattcacacccctgctgattctgatgcatgttttcagagatcacactttgagaaatagtgatctacagttaattataataacagacattaaagtataaaaaaaaaaaggggggggtaaaaatcccagggcaagttacgtaccggttttggaagggccatgggggattaaagggggggtaaagggggaagttggtcttgggactttgggggaggaaccggaaaggaataatgggtgtgggggtgaaaaat

SEQ ID NO: 143288 - DNA, 253 bp, Homo sapiens
ggacttacagagtgaccttgagaaattccattcccaggctgagctgcagtttgaaagctggagaaagaaatctgcattgatcaaatgtccactgtgagccagattctcttctggaaacttcacatcctcccagggctttgggccaaaaacctggacattgcacgtgatccctgttgctcccttccctgtcacattggccactcagtcgtaccgtagctcgatattcgtatatcatggctcatagcgtgtttcc

SEQ ID NO: 143289 - DNA, 380 bp, Homo sapiens
ggaactttgcattggaactcagtgagtcctttcacaccacaagcaacacagggcagaattcagctggtgcccacagaaggagcatttagatgagccctagccagagaggaatcgcccatcccagtggtcagaacctgagttctggctagtcccaccactgcaagctaaagagctctagggtcttcaataaactagttcttgtggcctagactgcaattactgggcaagtcctggtgctgggctgggctcagagtcagtggacttgggatgcacatgatccagtgggacaccagcttgggtagccaagggagtgcttgtactgccccttctgcaatcccaggcagcacagctcacagctccaggaaaagagggaagagtga

SEQ ID NO: 143290 - DNA, 565 bp, Homo sapiens
taagccactgtgcctggccaccacctgctttcttctattaaaatcttagcataaaacaaaggaaatagaaacaaaaattccaactctttttgtcagaggtagatctcatcagttaccttaaaccataaaatctgaaacagaaagcatatgatacagtaacttagtaccagaagggcaaaaccaaagcacctgcagaggagacgacagtgatatcaggaggttgaaggaggaagggaggcatggtgctaaaaacagatgttcagctgaaagtctgtgaaaggaccagctgaactcccaggtcttcacctcactccagctggacagcaatgttccccaactccacgagatgaggggtttgttctctgaaaaaattggaactacagagaatctagaccaggactcggggacagtggagggtagagttaactgaatgtctggtctgatcttagagcagcaggcaaaacaaatgtcaaaaaaaaagtgctttgaataagaacaaataagacttttaaatatcagtactcaaattgatagcagggtttgcagaatgtttgctttttttttt

SEQ ID NO: 143291 - DNA, 196 bp, Homo sapiens
gagtggaagatgggtactcatgtgcccaggtggatgcaggaggagaagctcaaccctatcctcacttagcctttgccattggtgaggccggagggaaagcagcgttgacagtgtcagtgtgtgtgagtgtgtgtgtgtgcacgcacttgccagcacatgctgaggtgcagtttgaaagatgtgtaaggggaagaag

SEQ ID NO: 143292 - DNA, 741 bp, Homo sapiens
ggaggggatacatctgatattgattttattggtcatttttcttagtgctagtttttctcatgtgctttggaattgcagcttagagcttcatctagagattgttttccatgtattctttctctgcgctcaccctgacccatctagggatttgctgttgccaacttcctacctcccaggaccccagtgcagagtcaagtctaatatttgcagcaagggccttctgttccatgatgatgatggacccagcaccaggccccagacagcatagcccagcgcctggctgtgaggctgtgtctcccttctcacctctccctgggcaagcagatctttaaagctctctttcattgtggtgtgggggcttccccctccacagtttcagatttccagtagtgagcctggctcaggtcccagccttttcctgatgacatttttctcctcattagccctcagaaacaggctaatggacacctttgtctacagtatacttcacatttctatttggttctgatccatggagatacttaatcttttttttgccacattattctttttttttcaggtttgttgagctaataaatgacaaatgaaagttgtatatatttatggtgtataatgtgatgtgttgatacatgtacactttaggaagtgattacccattatcaagctaatatacccatcaccccccatagttatttgtgtgtgtgtgtgtggtaagaacatttaagatctacttttatagcc

SEQ ID NO: 143293 - DNA, 508 bp, Homo sapiens
agtgaaggcaatgacacctgagtaagcatgtatctttatggtttagctaccccattcaaacagttttggtagaaaccaaaatatgactcctaatgggaactgtcactgcctaagcttgggctatataaagtgcacccatggaatgtaactttaacaaacaccctggcccatgactggaccgtcagccgcaaatcccccttcagctaggactccaagaacgcctgctaggcctcacattattctcaggacacctgcacacaggaaggggcacagatgcatgccaaattaaccttacttcctcaacctcacgaggaatcataaagtggccaaactgtttcaatgggacagttaaaaccaaaaagatatatgtccactcggcactatttccttcttcactgcacctgttatttatagtgctgctaaaattaacttgaatttcatctctaaggactaaaagaaccccatggcaattgtatgtgaaggaacacacacaaccgacagctgagac

SEQ ID NO: 143294 - DNA, 696 bp, Homo sapiens
gaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaatttt

SEQ ID NO: 143295 - DNA, 418 bp, Homo sapiens
gggtctagcatcatcctggcccagagtagatgtttataagcttcaggttcccccttgtttgtaaatacaagagttatcgcaaggcaaaacaggtcccccagttggcgcagtgcatggtacatagaagacatgaatgtcactgggtgtggtggcttacgcctgtaatcccaacactttgggaagtcaaagtgggtggattgcgtgagcctgggagctcgagaccagcctggacaacgtggtgaaacctgtctctaccaaaaaaatttacccaggcatgatggtgtgtgcctgcagtcctagctactggggaagctgaggtgggaagatcacctgagcccaagaggtcgaggctgcagtgagccgagatcttgccactgcactccagcctgtgtgatggagtgagaccctgtctcaaaaa

SEQ ID NO: 143296 - DNA, 376 bp, Homo sapiens
cgagtgtaagggaattctaagaattagttaaatggtggcattaggaggtagtgaactcagtaagtaaaggctgaatggccacatgttgtaaagaggttaaggtcgtgttggagtttgtgttgtgtgctgtttgggaatcttgaaggtcccttccaagtcatatcatggttttttaccaaggcatcgtggcgactactagtttgtcctcagttcagtaggaaggaacagagcccacagccagggctaccagaagtctttgaggcccaagaagaacacaaaattgtctcttgcacagagtagcattttttgtgagaggagcaagttggtaacatctgtcagggaaatgggttagatgcagctcagtcattcactctcc

SEQ ID NO: 143297 - DNA, 371 bp, Homo sapiens
ctttgtcatgtggaaacagccagggatggcatcaatcaatatctctcgaacacacgtcctccttcctctcccagtgatgcccctcactgcagccattgtcaagaatggatgtccgccccaggtgacttagaaggccacagaccaacaacaaggcagccaaagttcccaggaaggccccaggaacagtagaagtagccagaagaggtgccagcaggtggctttaatgagtctttctgctgtctggagtcttcgaaagcatttgtgttttgtgtgttggttcgttttgcttttggaaatttatcctattgcagtgttttatgggaaatgtttttaatgcttaaacagtttttgaaaggcaatacccttgaaca

SEQ ID NO: 143298 - DNA, 393 bp, Homo sapiens
gggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagttt

SEQ ID NO: 143299 - DNA, 666 bp, Homo sapiens
gagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaaggtagtgtgtttactcattgacagatgcatgcagaggtcacacagagaccaaatgggagggaggtgattcttgctgggtgtcacccgtaacagctgctggaatgcatcccgcatgtgtccgttctgcagctgaccagtgatgccatgacctatggagatttattgggttaaatccactacctcagagttatttttgcattcagagatctgatactcaaagattgtatcaatatatttattgattgtacgtatctgtcaatcaatgaagaccttttctgatgcgtgagccaggtatttggatcctccaggtaaaatcttgctggcatcaggatcccatatctttcccatattgaggcttcccttcatcttctggtacctaaggctagaaactgacctatggtaaattgaaaatgacatatcatatttataagaaaataagttctagttaaca

SEQ ID NO: 143300 - DNA, 337 bp, Homo sapiens
ctaaatgtatcgagcaacacactttgcagataagaaagctaacacactatggtgatttctgtaacactgaacactgctattaggaattggaccaatgccaggagccatttctcattgacaattaaacacccatcaactggtaatgatgactcctcgtaacttgtgacacagaccagacagaagggctatgatctgtatggaaaaggtattttatctcattactcatccgtggagccattcactgcctcagaatgttgaatgactggagccctccctgaagagaaagctacaaattataggggggtttatgagaaatatagatattctattgtaaata

SEQ ID NO: 143301 - DNA, 563 bp, Homo sapiens
ccagaaaaatccttgtttccttcttaatgactctggtaccttagaaactgggaccctgctaagtccttgactaggctatctaccagctcctggtcggattaaagaaaaaacacactttgtgttttttaatcaccaaggcaccctgcagagatatcttcttcttgcaacttcacatctttatcagtaatgtcctctttcctttaaaaattcaagttttaagaacagcattttcatgtaaaaacttgatttgtgttttttccagactgaatacttttcctccctaactctcatcgtctcattgcgcgcaatgcctgattgagcttctgtttgactaaatatcacctactatgtaaaaaatgagcatattggcctcttttctagcatctaataaaggcttaatacactgtactcttttgaaaccatatgattccagtccaactattagccttgatttctaactgatgttcttttcatgagaataactgattattgtgtgatctttgaaaatgtaatagcagcactaaattataaatccttaaaaaacacacatacacatgcaacca

SEQ ID NO: 143302 - DNA, 713 bp, Homo sapiens
ggaatttgtttgcctgttggacactgacagcctttcaaaccttggaatcagcactgtcactttttcatgtcttgttttatattgattttcatactatactttcttttactttttatcacagcagccaccaaaacccagtttcacaaagacacgatattctcgaaaggaatgtagtgtgacttaatgttgaaagtgaattatcttgagctattaaaaatattccaatgcaggccaggctcagtgactcatgcctgtaatcccagcactttgggaggcctaggcaggcggatcacctgaggtcaggagttcaagactagcctggccaatatggcgaaactccatctctactaaaaataaaaaaattagctgggtgtggtggtgcatgcctgtaatcccagctactcgggaggctgaggcagggattatcacttgaacctgggaggtggaggttgtggtgagccaagatcatgcccttgcacttcagcctgggtgacagagtgagattctgtctcaaaaaaaaaaaaatcccaatgcatccctatgagtttgctggcttgctgtggtgccccaggatgcctcaacatacatttagtatttcaggcccaacttgactattcgctctgacatcctagtttagtttctttaatctgcacctcagtttcctccacctcaatactttaatactggatggacatggtggctcacacctataa

SEQ ID NO: 143303 - DNA, 617 bp, Homo sapiens
tgataaattacaatgagagagagccctcaatctaattctgccataccaaaaatgtgttactataatatgttaacaagtgggcacaaacacagtcagacactgaagtatagggagattccattctgcgcctcaggcattccaactaatcccttgcacagaaagtgcaggaaggtaggcatgactactgtctagtggccagagtccatacttataaatgaatctgacgattggacctccatcgattggagggatgcagggactctgaatgtagaaggctacaaatgatggtcttaaaacctccatgtttgctggacttttatttcattccatgggtgaaaagtaatcatgcctgacagtgttaatttctgctgaaagcaaactttatgctatttaacactcctactctctggagtttctgattgggcttcttcaaatattaactgacatttgcagccaaacaccacaccatttatccagaagtattattaaaataaaccatttcacaaacaaaataaggacattttttattatcactattttaaccctgtgttattctcctatccatctgcacctcactttaattcatgaacaaaaagaatctttggtatcaaggataa

SEQ ID NO: 143304 - DNA, 722 bp, Homo sapiens
aaaaattaatttctctctgaaagcacctttttaactctcctcaacggatattgatttttcagttgttacagttttttgcacttgaatattattctccattttggaatattttccaggtatacattataacaaatgcttttggttagtgatcaaaatgctgttaatcacaattgctatttctgtgatggatatccatggcaggaaatcaaaaacaattgagcctgtcaagattaaatggcttgctctgtccataaaggaaacctcacagccctacactggaccatcattcctcctttgagagtcctaaagtagtctgaaaatattataataagtggatagtcagctaattctttgaaatcataaaactaatttgctttttagttttgccgcctttaagaaagctcttcagctgattatccctttatgaaaagaattataaataattcatttgctgggagaaggaagaagaggtcagagcagtatttgaaggcatatatgtaaatgacagatttggaaatgatctgtattcaaagttttaacatgaatgaatataaatcaaaggtttttacagggaaaatatgcaatctgcagaacaatatcccaggtatgctccttatttgggtatgggtttttaatctgttctattacacattctatgcaaccagtaatgtccatagtataagtcttcctcaaaagtttgttatatggcacttccttgaacc

SEQ ID NO: 143305 - DNA, 785 bp, Homo sapiens
gcggaactcctgtttttaagtcctagctccaacactagccttgtcagcctgtaattctgaattactgggcgcctctgaggcttcttgtctcatctgcaaatcaggaacaacggcatagagtggtgaatgcatcaagtgggatgatgtctgcaagtacgcaacccgcttacacaaagaattatctttccataaccttccctggacccctagggccagcagggaatcatagcctccctttgtttctagagcccggaaatcactgggttttccctctgtctggagcagagctgggtgcgaatttgaccaacgggtggcaggaacagccggagcaggatattaaggagcgggcgagcttgccaagcatgcgcagtagcggcgggttggtttgagaagccgccagggagccagcgcggcgacctagctggctggggcaggggaggggcccgccttatatgggagctgcgtggggacaaactgttcgggcccaacgcgcgggtctgagagacagccacgcctgctccgggtcactccggccacctggggggcgtcggcgcgcagactctggccagttcagtattcaaactcttcaggagtgctaacttactcatgacagcgattttctgtatcggggtttcattggtcggtggtttagaaggttttgctcattcattcgttaatgtaattccaacaacctacacgtgtttataagccccctttccatccacgactttgctgtctgacacaaaacggaccatcgcagcccggcagacgctttagacaacaaa

SEQ ID NO: 143306 - DNA, 614 bp, Homo sapiens
ctgtctgggtcaattttcccttctctcttaacttattcattcaatgtaattctttatattcctacgacttcatatatctcagtgactcccaactttgtgtccttcccagagctcttgctttatagttaccgctttatatagatgccctagctatagcttaaattcagaatgttcaagcccagatgtatgagagataccagtcactacctctctctccacatgtagttcctgcagaatgggcactgttaggagatggtgttttgagccaaggtagcctccattcatttctgcctctatcatttattatcatttagtcatacgattttaggcaagtcagttaacttctctaggccttggcttcccttctgtaagtgaggataataatgcatgtttctgaatgactatgagacttcagtaatatattagcatgggacttattgcatagtaagcaccaataaatggtgactttggtttatactacagcacgacctctctgagtaactgattggaccggggtggacacttgagtagcccatttattgctatacatttgaaattggccagatttaaagtgacgacctgggccagtcagttcccccaggaagaaattatgc

SEQ ID NO: 143307 - DNA, 391 bp, Homo sapiens
agagtgagtgatggcccaattacaatcaaggaaaagttcagtctcccaagactacaaacaaacataaaccaacttaggacaagtcaccaaaggaagaccaaattctgtctcagaggttacagcactgaactagttatccaaagacctgaactctaatccaaatactgatcttggtaaaacactaatattctgtctcttgtttccatacaaataacagagtatcatcttcttttccttctcttaagataaatataaaacacagtggagcagtccaaaaatgcaagaagaaattattacgtttcagataaaatagagctgaaggttttaacctacattctgcttcatctggaacacagttatactttttttttttttcctttttttgagacag

SEQ ID NO: 143308 - DNA, 253 bp, Homo sapiens
ttcttggaaatccaggtgtcctacggggaatgggggtgtgtggtctgacaaagtccctggctgctcggcttctaggacctccttcccctgtgacctgtcacctctcttccttcctctccaagcattacaaggaaagggatggggacagaacacacctactgtgcctcaggcttccttcctgtgacaatggaggaggaattctcaaaggcctcctgtccacctggagtctggagcacaggctctttctcctctt

SEQ ID NO: 143309 - DNA, 513 bp, Homo sapiens
ctgtaatcccagctactcgggaggctgaggcaggagaatcactttaacccgggaggtggaggttgcagtgagccgagatcacgccactgtactccagcctggcgacagagtgagactctgtcacaaaaaaaacaggactgcctattgggcctcatatgcttgactgtttgatggcagaaacaactcattggctacaggctttgctttgaatggacccttcttccaggtgaccggtatgatgagaagtagagaggtaggggcaggtgtcagcgtctggatcttctctgggatcccaacagaagacattttcgtcctgctgtgctgaagacgggaccggaaggccattgctcaggtattcactctaccagacggggctttacgctcccaccacttcctcgaatcccccgtgaggtagatattattatcctgactttacctgtgaggacaggaacgcagtggcggggtgggttctcactgtgcgtggaggcagcaggacgcagaaatcgacctccc

SEQ ID NO: 143310 - DNA, 558 bp, Homo sapiens
gagggagaagcagctggtgatgaagcctagaaacgaatcaggtctgcttccttgcttggcattcggtgccattgacagcagcctcccctcagcaagcaaaacttgctccaaattgagctgcgagtttcttgcagggtggagctgccctcggctgagtggagccaggagggtgaagcaggagtgtgaacggtgtgaagcacccattacaaatttctggccgccatcctaattttagaggcttcatgtttcaatatgaaatgctgttgttcgtgccacaaaaggaggaaacaaacagaatcgtgccaggagaaaccccctcccccaccaagtttgatgctgtaaaaatgtctaatggggaaatcttttcagtggtaaattaccccactgccttcttttcctctcattttgcatcggaagctctcctcagttcctactggaagatgttcaaggctgggccaggagaattctagagactttttcccctaataggcaccgtgtttgtggagaagtccactaagaatcccagacttgacatagccctggcattcagcggccgcc

SEQ ID NO: 143311 - DNA, 285 bp, Homo sapiens
aagggagcagctccagggatggctgctctggaaatgtgctttggcagtggccttggggaatctccagtggccctttcagtcccagcagtccacagcctcccctccttctgccagggcccccagcctcctgctgtcttctctgccttctttaggtggatgtgcttggctcttcccttgttctgctcccagatgtgcagaaagactctttgaagctcaggtcttccttctgatcagggctgtcctcctgagcaagaagccgcagttcacagtggaaagcatggttct

SEQ ID NO: 143312 - DNA, 295 bp, Homo sapiens
atatgctcaggtctgcatcccagaaaagaagagcctaggcacaacagctacagccccaccctactcttggccttcgaaccctctaggtggtccgaatagctatgcagacccaaggtcagaaagacagacttctctttgattgcacagtttacttttagaaattgctcacaacagtcagacatttcagacccatcctcaagagagactttccacaaagacgctggcagcgccctgtcatctgtgcaatgccagaaatggtggcaccccatagccacggagacctgagcaagccagg

SEQ ID NO: 143313 - DNA, 327 bp, Homo sapiens
atagcacctgtgcagtgcccacaaggggtctttttagaagtaataagcattcagactcccttggctctcataggccacacctgacaagaggtttactgagaaggacagagtacaggaaacacaatttgccagtagggaagcatctagcattaatggaaataattctcccactattgtatgtctcggtccacatagctgaccagttattctgtttggtcctccaagtgacaggtctaggacaagggagtgagacacatttgcagagccagctttagcccctaaaggagactaaaattttttacaacaactctatagacagagcttcca

SEQ ID NO: 143314 - DNA, 356 bp, Homo sapiens
atttaatagccacctctccaaaagaagtactagtccaaatgattcttgctttgttctgaaacatttccagtgatgttccaaagcagcataggttcattagatcaggtgagtaaggaaagttaacaagaagcaaacgttattaaatagcctctgtttaggatagaggaggcccatctgtctgcagtgaaggcaacacaagagcttacaaataatctgccttccccaaggtacatggctccaggacacctcctttgtgtgcttggaatgtgaagaatttaggagacaatcctagactgttgcagtgttgggggatccttgtttgaattggggacacaatgcagccggctgccactcat

SEQ ID NO: 143315 - DNA, 330 bp, Homo sapiens
atgaacattcactggccctccattttcatcttaattgagttgataccaaggcaccaaatacaatgagctggcataaccaataaagtgaccgatcatagcactttgttcatgttaacgcctttcttctctcaaggcttagcatgtgctaggtccctgctgcctcatgccttcacttttgtctagctgtcctttgaaaaatgaaggcctagttccactggaacaaactcctggttttctgcaaaaattctcaaaaactcctactaacaatactcagagatgaacaaaaagtttccttagataaatgctaagttctgagaagataatttacct

SEQ ID NO: 143316 - DNA, 295 bp, Homo sapiens
  misc_feature (153)..(153): n is a, c, g, or t
ggggaggagacggtggtgaccattgaaagacaccaggttgacagcactggaaactgaagtaccagttgtcgctagaacagtttgttagtggccccaatgaagaaccttcagaacctgtagcacacgtcctggagccagcacagcgccttcgancgagagaatgcccaacaagagaggatccccggcagcgggaggccaggggagaatgagctggggataagagaagtcgcaggaagaatcctctgcccggagcctgcagactccaacccctcagcctggtctcaggagccccaca

SEQ ID NO: 143317 - DNA, 784 bp, Homo sapiens
gatggagagtctctgtcacccagaatggagtgcagtggcaccaactcagctcactgcaacctccgccttccgagttcaagcgattctcctgcctcagacctgtagtcccagccacttgggaggttgaggcaggagaatggcgtgaacccgggaggtggaccttgcaagtgagccaaagtggcgccactgcactccagcctgggtgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataaaagtaaatgtttctgtggtccttctgggagtggggaaagttacaactccacaaatgttaagagagaagggtgaacagttagcagtcaggcagcatggttgggagtcatgaggaagagcattcaagatgacacaagttttgtaagcagacctaaggaacgggctgaagaatgttgtggagacccaggtacttcgacttagcattctgagttcagagttcgcccaggagttccaggcttgtggcaggtttagaaaatccaggatgatcggccaccttctttc

SEQ ID NO: 143318 - DNA, 439 bp, Homo sapiens
atatttggctcaggagattttgaactaaaaacatggcagttttagcatggatgatgagaaatttctaagagcgagattattttgcttgttaaaaagaattgagcttctcttcatgatgttaccttcatagatccatatgttgaagacctaaacccagttacctgtgaatgtgaccttatttagaaatgaggcctttgctgctataatccagttacgattaggtcatactggattagggtggccctaaatccaaggagaagtgtccttagattgagacttggtgacacagagatgctcagggagatgaccatgtgaaaacagaggcagaactggttacactgccacacccaaggaacacctggggttactaaaagctgaaaagggggagactctagtctttagagaaagtatgatcctgccactacattgattttggact

SEQ ID NO: 143319 - DNA, 281 bp, Homo sapiens
tgctttagcagcatccctagcctctactcattaaataccagtagcactaccccagtctgaccatcagaaatgtccactgctaaatgtttccttgggggcaaaatcatccccagttgagaatctgctttaaatcttctagtatctccaactgtctaaagcctcatccactcatattctctcctcaaagtttcaaaaaatctttcccccagtcttcctggtaatccaagctaaatcccaaagtctaccttagtatttcatttgtctttgccttcaaaatcctc

SEQ ID NO: 143320 - DNA, 157 bp, Homo sapiens
tacttagcatattctggaattggttctggaagtgaccttttttgtttcaatagttattactgagtagtagaaagtgtatgtaaatttggaatgtctttaacatggccttcaaagtgggaaccacagtcagatataacgtgacataaagtaacagaag

SEQ ID NO: 143321 - DNA, 340 bp, Homo sapiens
gtcgtacgcttactcactagtactgcatcagaggctaatggtgggcctgactactgtaaggccctggcagttgcactcagataaaaacctgtgctttagccaattgcttctaatccagcacattgcttcataaatgtctgcttttggccacaagggggactaaatgagaaagcatgggaatagttccttctaatccatcaccactaatagaaaagtaatttgaagctctaatatcctataactctatgaggtctgtagctgatggttaggagccaagataatgaacagcatttaagtagaatttccctgtctcttaaaaaatgtactactgaggtgtaag

SEQ ID NO: 143322 - DNA, 420 bp, Homo sapiens
tgataggtgatgatgggtgggtgggtgggtggatggatgaatagatgggtgatgggtagatgcgcagatagatggatgactagatggagagatggatgatggatgcatggagagatggatgatggatgcatgggtagatgggtggatggatgggtgagtggatggatgatggatgggtgggtagatgggtaaatgagtgaacagatggatgataggttgacggacagatggatggactacaatgagtagatggactggtatatggatgggtggataaatgccatcccgtcctatacctccaggtgctaccatgctctgcatctcacaaagggttgctctctttgtaaggtgagagtcatggctggcaccagagaaggaggctggtacgacagccgcctgcttcctccccttggccaactg

SEQ ID NO: 143323 - DNA, 103 bp, Homo sapiens
agaggtttgtgtaaaaataatatgcactaatacattgaatgactttagcacaatgtcaggcacatatgaaatgtccaaaatgtaacagcacttactcttaaga

SEQ ID NO: 143324 - DNA, 247 bp, Homo sapiens
atttcacctgtgcaaggacccccgcctgcaggagaacctatttttaggtgttaattttctttcttcaggaagagcaagcaagtttcccttctattaaaaaatgtctttgtgctgcaagagatgtttctctgccatctccccacattttctagtatgtaagagaaaagcagtctcaatattgcagccttgcctatcttagtgttgctccccagtaagctctgaaatgagaggtttatcttcttcagct

SEQ ID NO: 143325 - DNA, 123 bp, Homo sapiens
gagaggaggtttcaggtaatgcctgttttaggcatcctctcctttaagaaaaatttttatatcaaggcacctcaacataataatacctttattgcatataggtagaatataaaactgacttgt

SEQ ID NO: 143326 - DNA, 822 bp, Homo sapiens
gatcctctttccctcttccccaccctcattataggctgcgaagcctcctctctgcacctgataacaaaacgtcatatgagaagcatggtagatccttagcatcaaaggttgaggactcttattctgattataagtagtggctcttgactacaatcaagtctcaaataatagtgtaagagaataaagcagaataataagactaagttaacagtttaggcttctttggaatcatgcgggcctagatgaaaatcccaacactgtcctttactagctaagtgaccttgagcaactgattacaccctttgatgcctcagttttctcctctgtgttgtggggtaatagtaatatctacttcctggggttgttcgtgaagattaattaacaattatacttgtcaaagctttagcacagtgccctgtatgttatttccttggccaaactttcttactctgccatttgttcaatgtcctaatgagcatgaacactacattaggtatcatgcagaacactctaaagataagtattatgatctctatttcacagataaggaaatttaaactgggagaggctaaagggctgacttgcccaaggtcactgaactaatatgcagcagagacagaattaggagccaagtatattaagagccaagtgtattgaacctaaaatctgggctcctaaataccaagcttcactgcctctctggttccagtgagagtgggtgctagaaaagtattcaggaatgaagagttctcctcccagaagcaccctggcctctccaaaggcagttcatctgaattagtgaagcttcttagcactgcctag

SEQ ID NO: 143327 - DNA, 120 bp, Homo sapiens
agctccagtttcccggctttggcactaaccgtctcccacttctagcccctcacctctaccccagccctgccaacatctctcctgaccaatattgctctaacataataacaagaacaatta

SEQ ID NO: 143328 - DNA, 440 bp, Homo sapiens
gggctgtctagatattcattttaactacctccaccttggaaacaattgctgaaggggagaggatttgcaatgaccaaccaccttgttgggacgcctgcacacctgtctttcctgcttcaacctgaaagattcctgatgatgataatctggacacacaagccgggcacggtggctctagcctgtaatctcagcactttgggaggcctcagcaggtggatcacctgagatcaagagtttgagaacagcctgaccaacatggtgaaaccccgtctctactaaaaatacaaaaattagccaggtgtggtggcacatacctgtaatcccagctactctggaggctgaggcaggagaatcgcttgaacccacaaggcagaggttgcagtgaggcgagatcatgccattgcactccagcctgtgcaacaagagccaaactccatctc

SEQ ID NO: 143329 - DNA, 216 bp, Homo sapiens
agtgagtggaggagcgaggatttgaacccaaatggtctggctctacattttgtcctctccctaacacagtcagccaggatctgaaggcccactcctgttcctgtgagaggaggaaagaggttccccaggtctgagcccagtccataaacgcccatcagtaaataggtgatctgttaaataaaactgagctaggccaggcacgatggctcatgcctg

SEQ ID NO: 143330 - DNA, 852 bp, Homo sapiens
agcggagttcctcatctggactcactgggagaagtgattcactagaattctcattggaagaaatgacaggaaagctccctccaatatctcaatttccaccccactcagtacctggttttatgattccacaccctcctaatccatcctgccctcctaacacatcccactctcgtaagccatcccactctcgtgcccgcgaatccctccctcttcttccatctgccaagccccttcctcctctccagaagtacgtggatttttcagttttctgccctaactgttatcccactgtggctcatacctgccctccccactaccctaccctaatactctacctgcactgctcttctgctattcattacaaaccatccatttgtcaatgctctagtcccagaactctttctggtaactcccttatcgatcaccctagccctccttctagccctactggtcaacgcttgggtcccagaactcttccctgtgattcccttatccgttctcctgttcctcctcctagccctccttgccaacgctctggtcccagaactcttttctgtgactaccctgtctgtccccctactcctcctcccagccctacttgcaaatgctgtcgtcccagagctgtttcctgggactcctctacctatggcctctacccctcctccttagcctacttctttctagtaccctgtactcctagtccccagcccccagcctgcatccccaaccagaccttatggttcacaagtctcatcttggagaatggtttccctggtcccggggcagttctggaacagttcaggatggccacggactgtggattcccagcagtctgacctcgtggacaaagga

SEQ ID NO: 143331 - DNA, 453 bp, Homo sapiens
cccagaggaaggatcttctaatcaaaagtattagcatgttaaaggccaggagctgagagggaacacactgtcatccaggcatgggggcagtacctcctacctacactcccctatcccaagcctgctctccaggagccattacaaggaatctggcaagctcatcacattaattataaatggtgaatgaaggattaacttgttggccatggtagcttacattttcaacagagaagcctcttgccagataaatgaagctctcatagtaggatctcaggcataaatgataggtcaataaagctagtaaattttgttgggggtacctcctttcttcctattctcacaatggaacttttacccctattgcttaaagttccaagtgtcatatgttttcagacccctccatccctttatgatgcactcagaaaataataaattcattgataaccacagatg

SEQ ID NO: 143332 - DNA, 186 bp, Homo sapiens
gaagatgaggccccatcccaggagctgccacagagcatatggggctatcatcctataaactgaacctttcacaaagagtccttttgccttggcttactaagctctgaataagagttccactctggttacaaagccttggatcctgtcccaccctgaatcatctacctcttggatgggttctatatg

SEQ ID NO: 143333 - DNA, 703 bp, Homo sapiens
gtttgtgtttttcttcccttaattttccccttggggcaggctgtctgcatgcacagtgacctgccagcacttgggaggggccgcatgtgcagtgcgtttactgaagttgtgtgtatgctcgtttgaggcatttttctcttaccagtcaagcattcccagaggaaggtcatataccagttaaactcccattttgcctcttagtgcacatgtttgaaccgactcgcctagctcctgagatcttatcaggaagctgctgatcactagctccaggtattttctatctactgggagactgcaggtccctggaaccagctgcaaccaattatcattttagcgacacagtttaacaactgcctgaccatcacctgatggttgcctgacgacctgataggggccctctcctgccctgctcagttctgcctaactgcctactctaacatactgatttatgtcttggcctgcaacttctgtctccctaaatgtgtaaaaccaagctgtaactgaccacactttctcaggacctcttgggattgttctcccagccatggtcactcatattggctcagaataaacctctttaaatatcttgcagagtttggttttgttcatcaacatggttgtgaatatggattgtgtttattggttaagagataattaactttgaaaagttaatgtctcattaaaataaaacataattactttg

SEQ ID NO: 143334 - DNA, 506 bp, Homo sapiens
aaatgtatgattttattataaagtagactgtgttttccaagctttaccttctgcaccgttgttgattctggtgtgagccccaggggcgtcctcaaccactgctttcttgatcttgaggacatttgaaaatcatcataccaatatttactgatgtgggaaaaaaagattgggagctcttacttttttttactttgtgtatctgcttaacagcaaaaatgttgtattcttaatgctttgctgaaatggacttctttatgcaacattggaaaattgatattttgatgctttaataattcagaagtttccttcctgggctgtttggtacctgggaggtacttcaaggtgattgttaaaaattttgctttttagataagccattttaatttttctgacatattgaaatatgtaaaagcgtttaaaatttgagtcatggatttctaaagttatgctttattaactggagttacatagaattacctataaactttagttttgataatctgaat

SEQ ID NO: 143335 - DNA, 107 bp, Homo sapiens
atccaggtacacattaaacaattaatgtgcatatacagtattatattcagctctgcaaggagttacaaaggaaaaatccactactcctttactttaaaaaagtgttc

SEQ ID NO: 143336 - DNA, 893 bp, Homo sapiens
ctagccataagcattgagtctgcaacgcagagttgtaagtaagaggtagaaacatagagacaggacccttccaaaaagcttagctgcatggaggaaagaggttgcaggatgggaactagagggatagaagagtaacccagaatagttttggtctgagtgccttgagtatatttatatatagactgaaatgagggaggcggtagagatgcggtagagagaaggaggttggtgctggaagaatataagcctggaagacacaggtttcagagtgaatgtagaaagtgaacagcctcttattttcagaaggaaagaagggagggcagaaggatgaaggtatttgatgttggatgggggatctcccttttgcttcgccatcttcgtatcatcctccacttctctaagccacttgaaaccattagccacctcttccttctttgaaactcccttctaagtcttctgtcactctccaagactctaccctggaatgtgcctctagaacagtggaccccaacatttttggcaccaaggaccagtttcgtggaagacaatttttctgaccaggagaggggaagagttggggatgattaaggagcaagcaacctagatccctctcatgcacgtttcacaatagggttcctgctcctatgagaatctaatgcagctgctgatccaacaggaggcagagctcaggcggtgatgcccactcacctgctgctcacctcctgctttaccgaccggttcctaacaggccccagacccttggggagctggggaccccgctctaaaatgtagtgggtggagattggatgagtttgatgctcatatttttgtctgctagctttatatatgtgtgtctaagtctaagtattcttggcctacaggttttcttcttt

SEQ ID NO: 143337 - DNA, 538 bp, Homo sapiens
atttttagagcattatttttaaaaaacaacttgcctacatttctccatatgggatgatactgtatagtagtatggttttgtaaatgtgttatgtgttgtgatgttctctggtagcagccttacctttgtttgttttgttttttgagacagggtctcactctgtcacccaggctggggtgcagtggtgcgatcacagctcactgcagcctcagcctcctgggctcaagtgatcctcccacctcagcttcccaagaatagctgggacaacaggcggtgtcaccatgcccagcttttgtatttttttgtagagacagggtttcgccatgttgcctcagctggttttgaactcctgggtgcaagcaatccaccagcctcggtttctcaaagtgctgggattacaggcttcagccaccatgtccagccacctttctttcttatcttaatttatgttacaagatctgtaaagagaataaagaagtacttttgcagttgttttgaacagctgtaaaaatcatcaacctttttcgggtagtccaaa

SEQ ID NO: 143338 - DNA, 783 bp, Homo sapiens
gacattactactctttttgaccttgagtagatggcttatccttattctgtctctatttccttgtcaatgaaatgggaacgctaatggacattatctcacagagttattgggaagagtacatgagacataatgagtacatggacataataaactgcttgctgcagtgctggacacagaataagtgctagttagtgcctttggttatgttgtgttgagattggaacatttcttaaaacgtttcagtctcatttacttattaattacatttagagtctactctttcctcaaggccgtataaacatgcaagttttaaaaatatgaaatgctaacatcttaaggttgcaactaggttaagtcctgttgatcttcatgaaattgagaactgaccatggcagccctaccaggaaattatgacagagaaaaaaattccattcctcttggaggacagaaagtaataaatatagtgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttg

SEQ ID NO: 143339 - DNA, 428 bp, Homo sapiens
tcctcagccaagactgccaatgagatcattgatggaaggattcagagggtaaagaagcacattctttatcctatgattactggagatctctttagcccactgggagccctcccagctggcattttctcataattcaatgttgattcaacagcttcataatggccatctacactgtgtctgtccctgtgctagggatccatggtgtgatgcggaacagggcagggcagggcaggctctgctttcatggcagtgatggatagtagaaaggatggacaaaatcaatcaaagttgctctgcagtttagctttgtgggatgaaaacagaagaggagctgagacaaattacaagagaaatcacctcctttagatcaggtattccatgagaacctctcagaagaggtgccattgaaaatgaggcattaaaaaaaa

SEQ ID NO: 143340 - DNA, 164 bp, Homo sapiens
gctgattggcattaaactcgagttaacactgcagacaaccagggatagtcgtatgtaacttctgagccagtagaacagaagtaacactgaagaaagttcagtgcaagaaaacgcagaacagaagtgaggttaaaaaatgagaaggaaataaaaagcatggtata

SEQ ID NO: 143341 - DNA, 434 bp, Homo sapiens
ccctcctcaccacctctgggtctgtggaaaaattgtcctccaagaaactggtccctggtgtcaaaaaggttggagaccactgatttaaagggtgaatagggaaagaattcctcctaagacaaatggtaaggagttttctagaaagtgggataggacatgttccagacaaagattatatcatgtgttgaagagtgacagcttgaaatcatatgcaatccctggggaatcagcagctcagtatggttagattgttgaatatgggggcaggaaggagaggtggaagaggaggtccaagtctgagcttagtatttttggcttaaaagtgggcatctcatccattaaactgcagtggtgttcaagcttggatccatgttagaagcacctgaggagcttttcaaaaatatggctgggccccatctcaggtcaattaaatc

SEQ ID NO: 143342 - DNA, 912 bp, Homo sapiens
catactcaagtggtctctcctcttcccatacacaccttacggattcttcacagggtgtgatgatgggaagcctagacacgcttatcagaagtttgtcctcttatcgggatacgtcagaaattagagagaccctggcaatcacagcttccacctcctcattttacaaatgagcaactaggctcagagtacagaagtggctttcccagggtcacacagccagcttgtgacagagtcaggattcaagtaccatctcctgacttctccattgcaccagacgtcgatagaacacagagaacctaaaagaagaaagaaaaaaaaatagagctttgggaatatattgggcttctggttttcaaggacaattttatgataagtagcaatgatgcctcaaaagctctggtagctagcttgaatgaacttatgtaataaacatttatcacagaacatgtgtcatcaaacacctgccagttctgagcgttggcaccaaagctgctttcattgtcaaagaaaagagggggaaaggaacttggctgaacaaagctggcagacgtttatactagaaaatttagagatgtcaggagcaagggagcaccagtggtagaagaacctgcctcccctggctccatcaaacgcacaggcccatgagaatcacccggcctgctctgagcagcacactcggaggccacagccgcgcacaggaaagtgagaggaagtggaaacgtgcgagcagagggctcaaagcgacgggctcaccaccggaaaaaaaaaataaaaataaacacgctcagaaatagtgtaactgatatgcaaagaagatcaaaacaagggttttaaaatatcttggctgctttagaggagatgggggtggtaattaaagcgaggttgcaaatgcgtgttaggggagtggggcgg

SEQ ID NO: 143343 - DNA, 732 bp, Homo sapiens
gagaaggtttatcccacaaatctcaggcatcacttcttgaacatggagcacctcaatcattcctgtgtctccaacttgttgatttcagaagctgatcctaagctcatcttcaattgtaaatgattttgctaattgttagaaaagcacattgttagaatagctaattgttaaaacagttggttagaatccatgggagcttcagcaattttgagttcaatcccaagagggaagaggattttcttaaggtcaatgtcagagtttggactaaatccccggtctctttcatgcccaagaaagggccctttttcccttttctgactagtagtcaggtttacttccttgggagatggaacaaatgaaacataactgaaatttcatcttgcctctgcagatgtcaggagcaagggagcaccagtggtagaagaacctgcctcccctggctccatcaaacgcacaggcccatgagaatcacccggcctgctctgagcagcacactcggaggccacagccgcgcacaggaaagtgagaggaagtggaaacgtgcgagcagagggctcaaagcgacgggctcaccaccggaaaaaaaaaataaaaataaacacgctcagaaatagtgtaactgatatgcaaagaagatcaaaacaagggttttaaaatatcttggctgctttagaggagatgggggtggtaattaaagcgaggttgcaaatgcgtgttaggggagtggggcgg

SEQ ID NO: 143344 - DNA, 464 bp, Homo sapiens
cctcaagtctgtgaagtacttactatttaaatgatgcccagagcctctgaatcccctagaagtacagaggagggggagatcattaatggtgtggagaagttggaggaggtgagacgatgccagatgtcaggagcaagggagcaccagtggtagaagaacctgcctcccctggctccatcaaacgcacaggcccatgagaatcacccggcctgctctgagcagcacactcggaggccacagccgcgcacaggaaagtgagaggaagtggaaacgtgcgagcagagggctcaaagcgacgggctcaccaccggaaaaaaaaaataaaaataaacacgctcagaaatagtgtaactgatatgcaaagaagatcaaaacaagggttttaaaatatcttggctgctttagaggagatgggggtggtaattaaagcgaggttgcaaatgcgtgttaggggagtggggcgg

SEQ ID NO: 143345 - DNA, 967 bp, Homo sapiens
catactcaagtggtctctcctcttcccatacacaccttacggattcttcacagggtgtgatgatgggaagcctagacacgcttatcagaagtttgtcctcttatcgggatacgtcagaaattagagagaccctggcaatcacagcttccacctcctcattttacaaatgagcaactaggctcagagtacagaagtggctttcccagggtcacacagccagcttgtgacagagtcaggattcaagtaccatctcctgacttctccattgcaccagacgtcgatagaacacagagaacctaaaagaagaaagaaaaaaaaatagagctttgggaatatattgggcttctggttttcaaggacaattttatgataagtagcaatgatgcctcaaaagctctggtagctagcttgaatgaacttatgtaataaacatttatcacagaacatgtgtcatcaaacacctgccagttctgagcgttggcaccaaagctgctttcattgtcaaagaaaagagggggaaaggaacttggctgaacaaagctggcagacgtttatactagaaaatttagaggtaatttctagaggaacagaaacacattttcaaagtcttataaaatttatttaaatgtgattgggtgaatttagcagttaaagaagtgaagaacactgaggtccaattggtgcctgaggcttcttccaggacccagtcttttctgtctgccttgggcacagatttctagatgcctgaagatggacaggcccagaggttgcccagagtgatgtctgagattactgatctctatctaggcttccatagaaacacatcccaaaacgttcttggttcttattggaatctcatctcatttgcagaacatggccagagtcaaagagacatggaccatgtgtcactcagactgagtccatccatacaaagagaattctctagcctgtattggaagtcaatcta

SEQ ID NO: 143346 - DNA, 436 bp, Homo sapiens
atagggcctgggaaatgttcttgtctgtttcaagtttatcttgtattttggggccctggtctcctcagtcttccagcccaacaggtgtgagcgtccagggccgccacccggaagccagctgcctcttcatggggaaatctttgaaattcaaggcttggccatctggatatgcaaatgttccagatttgctgagcccaccaagtggctgagccccccatgcctgggccagcctgtatgtgtgtgtgcagaaggggactgcacatgtgttcaggagcttgagagtgagaattgtgagcatgtacactccttagtgtttatgcatcagggtgtgatgcataaacacgaaggctctgtagcctttgaagaacaggatcagatctgggtttgaatcacaagaccatgggttttcagttgggcaataaacttatctgtcttt

SEQ ID NO: 143347 - DNA, 451 bp, Homo sapiens
aatggtactgtgtctttatttcatgtttttatttgattattgctagcatgtagaaatagaatggtactgtgtatttcttgttttcataggattattggtagcatgcagaaataggatggtactgtctttatttcttgttttcataggattattgcagaaataggataggtgtttgtgtgttgatcttggattctgtgtccttgctgaactctattaaataaagtttcttggaatttttgatagattccttgtgattttcgacatggacacttacaccatcttcagagagagacagttttattccatttcttcctttctgccctgtatgccattccatctgcagccctcagcacgtcactcttgatcatgtcagccttgagttcttggtagttggcctttatcgtgttgaggatgtttctccacactcctgttttcctaggaatttttatcg

SEQ ID NO: 143348 - DNA, 455 bp, Homo sapiens
atgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaa

SEQ ID NO: 143349 - DNA, 239 bp, Homo sapiens
ccacagataacttagaatcagcaaagcaaacttacattttgaccctgtaagaagcaaacacccctttcccctttctgcccattggcacatctctggaggacagaatgtcttctttttatacttcctccattaatgtggaaactggttggagagtccctactgtggaggcaagagggacttttctttctcattcagaaaaaactacacaggcttcctaaatataaaggagaagaaacagg

SEQ ID NO: 143350 - DNA, 478 bp, Homo sapiens
  misc_feature (21)..(22): n is a, c, g, or t
tacatggtggtatatttaaanngccaaatcgttgagagaattcattttgtctaggaaacattcgtattctttttctcgcttggatgtgtacattcagactatgatgctcaggatttgaaaaaaaatgcatacttgaattgtgaatttttttttgagatttaactaagttaatttttgtaattagaggaaattaataaaatattttggcctgaaaaatatacatggtggcatcgataaacaccataaattctttagtatttaagctctgcctcagtttctttccaggtccataaggcggtcttacaaaaagcataattgctctaatgtgccatcctaaggacttttaactttaccctgtgaatgatggaaaacaaagtaatgatataatcacatcagattcaaaaaataattattgagaccactgctaatctgagtataaattatttaatacttatgtatttatagttttaaattacaa

SEQ ID NO: 143351 - DNA, 196 bp, Homo sapiens
ttaataatgtaaactggcttttcatctgggttctggctactgcatatctaataagcagctggctagacagactagatgtcaaaacacattactacacatgttatgagtcaaaacatgtaggggtagaggtcctgaaagctatctgcaaagtaaggtaaatgttaaaatctgaggttaaagtaaggtctccaaatct

SEQ ID NO: 143352 - DNA, 217 bp, Homo sapiens
ttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtg

SEQ ID NO: 143353 - DNA, 514 bp, Homo sapiens
gactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttcctgtag

SEQ ID NO: 143354 - DNA, 630 bp, Homo sapiens
ccgagctatgcaccactgagtttgtgtcttagtatagacaggttcgccatgtcggtcaagctgatctcgaacgcctgcactcagttgatctacccacctaggcctcccaaaatgttggaattacaggcatgagccactgtgccctgccacaattattgtttaaaatgcattattttattctagatttatgtacatggtgacatctgtgtttcggtacaattttgaacttgtatttcaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttcctgtag

SEQ ID NO: 143355 - DNA, 329 bp, Homo sapiens
atgaatttatctgcctgcctcctggtatgcccacatggttcaggtgggagggaggtaaccatgggaacagaaggggaagggaaatgatgttgtccccataatgccccatgcggtggcaccaggagcttttcatgggctttattccatttgtttatcacattggggcaatattctcacataatgctgcagctgaggaaactgaggatcagagaggttaagtcaactcacccagtgtcccacagctaataagcagagctaggatatgaacctaagtctgactccaaagcccatgttctttctgctacgccacgatgaccattgattgtgac

SEQ ID NO: 143356 - DNA, 1607 bp, Homo sapiens
taatctgattggttctgacgattattcaaacccagatagtccccgcccccttgccacggaggctaacgattggtcagtgtcttaccagacccgccctccacgccccagcctagcaggttcggtgggtcgcccaggtcgttaactcccagacccgttagaaccggtcaggagaggaatgtactgctcgatcctgattggcggcgggaagagggtttgaaaaatggcgggcctcacgctgactggttggggctgtaaacggtgggagtggttggctcgggaaggaaagccccgccagatttaaaaatacttagtcgggagactgggggttggtctcctggcttggcgacggcggcggctcggtttgctggcgctaaggtaacagaagaggtctgccttgcccttcctccgaccaccatttaggtcctgtctgtcccccgcgtcggctcagccctgcagcgttggctcctgggagctgtagtcgctctgctctgttgccctgcagggtctcccgtgcgccgcccagagaataataaatgaggagagcctggagtttgccctgcaaaaccgattgcccagctcctcccgctgtcgctgaggttgtcgtagaactcggggaagtcaaggcagggaacctcggaaagggcgcggggggccgggagggaaccgttcccgcgtcccgtagggtgttaaaaaacgttctgaaagtaagatgcttcccgccgagggagtttccctcagaaggctcctccttccttccctctttgtctcgggtgacaaatactgggaggtaaacaagggcaccctccgggtcccgaaggggcggaggcggcgccttctcccccggccccgccccctcctaccgggtccggaattccaagccccgagtgtctcggcccccacgccgcaccctgcagcggtgcgccgggagctcggagccggcggctgcctgtctttggctggcctggccttcgcctgggcattcactgtctcgtcctactagtgtgatagtttttaaaaattgagaatcgcataaaagcaatgcatgctccctatcccactcccaattgcgtatattctccaaacggcatacagccacgttacaggctcctccaagcttgggttaagaacctccgtgttagtatagggagagcgcgccaaagctaccttaccttactgcttaccagcgtcacaagctgcttttcccaaggtagaggactttaattgacatcctggtgtgctatttctgtggtatttagttttgagggattccccccattattggaatataggttgcgtgactgtttcaagaaatttaaatattttgtcttaatttttcagtaagttcgttggcacatgttaagactatgctctttggtttgtatatggttgtcataatagtatttgaaaaccagcagttgtttatctaggtttactaataaaaaagatcttaaaaaaaatgtattttcctaggaaatggataatggttgtccaacattgtgaatgtacttaatgccagtgaattgtacacttaggaatgggtaaaatggtaacttttatgttatgtatgttttaccacaaaaaaataaagtggcagtttttcaaacaga

SEQ ID NO: 143357 - DNA, 1553 bp, Homo sapiens
taatctgattggttctgacgattattcaaacccagatagtccccgcccccttgccacggaggctaacgattggtcagtgtcttaccagacccgccctccacgccccagcctagcaggttcggtgggtcgcccaggtcgttaactcccagacccgttagaaccggtcaggagaggaatgtactgctcgatcctgattggcggcgggaagagggtttgaaaaatggcgggcctcacgctgactggttggggctgtaaacggtgggagtggttggctcgggaaggaaagccccgccagatttaaaaatacttagtcgggagactgggggttggtctcctggcttggcgacggcggcggctcggtttgctggcgctaaggtaacagaagaggtctgccttgcccttcctccgaccaccatttaggtcctgtctgtcccccgcgtcggctcagccctgcagcgttggctcctgggagctgtagtcgctctgctctgttgccctgcagggtctcccgtgcgccgcccagagaataataaatgaggagagcctggagtttgccctgcaaaaccgattgcccagctcctcccgctgtcgctgaggttgtcgtagaactcggggaagtcaaggcagggaacctcggaaagggcgcggggggccgggagggaaccgttcccgcgtcccgtagggtgttaacctccttccttccctctttgtctcgggtgacaaatactgggaggtaaacaagggcaccctccgggtcccgaaggggcggaggcggcgccttctcccccggccccgccccctcctaccgggtccggaattccaagccccgagtgtctcggcccccacgccgcaccctgcagcggtgcgccgggagctcggagccggcggctgcctgtctttggctggcctggccttcgcctgggcattcactgtctcgtcctactagtgtgatagtttttaaaaattgagaatcgcataaaagcaatgcatgctccctatcccactcccaattgcgtatattctccaaacggcatacagccacgttacaggctcctccaagcttgggttaagaacctccgtgttagtatagggagagcgcgccaaagctaccttaccttactgcttaccagcgtcacaagctgcttttcccaaggtagaggactttaattgacatcctggtgtgctatttctgtggtatttagttttgagggattccccccattattggaatataggttgcgtgactgtttcaagaaatttaaatattttgtcttaatttttcagtaagttcgttggcacatgttaagactatgctctttggtttgtatatggttgtcataatagtatttgaaaaccagcagttgtttatctaggtttactaataaaaaagatcttaaaaaaaatgtattttcctaggaaatggataatggttgtccaacattgtgaatgtacttaatgccagtgaattgtacacttaggaatgggtaaaatggtaacttttatgttatgtatgttttaccacaaaaaaataaagtggcagtttttcaaacaga

SEQ ID NO: 143358 - DNA, 889 bp, Homo sapiens
actgaatgttacttttaaaaattagtatattaggtgctataaatagcacttcaaagcaaagcttagaggaaacgttttcaatgttgaaagatatatcctgtgttctagaaaaaaatgactaccatgagaatccattgtaacttcttatgtaaacacctgccctgtgtaacacattgtgcctgtgccttgatgatacaaaagcaaataaggaattaggaacttgccctccagtttaaatatgaacaaataattataatacaaattacactactattgaacgcataaagattattaacagtgtcatggaaagagctgttgactttgttgtggggctggcagagaagtctaccataagaagaaaatttacatttaaatattaaatatttaaaaatattgtttctagcatatatcatagccagagtaaagactgagtatatttaaaattgattaaatcacctcatctgttttttttcctccccacgtagattttgtgtttttttattaacttttaattttgataatagttttaaatttccagaaaaattgcaagagaaaaaccaggaactcctatatatcttttacctaattcaccagttgtttacattttgtcctatttgcctcatttttgtcctgctccatgcacacgtgatgttttttccctggaccatttgaaaatgtttgagatatagtgcccatttgcctctaaatatgtacatctgctaagcaaaaggatactatcttataaaactacagaactaatcaaactcaggaaatttaacacttatttgtacaatgctcttatctaatacacagtccatattcacattttgtccgttgtcccaacagtatactttttttccccagtccaggatcatggattataatatat

SEQ ID NO: 143359 - DNA, 328 bp, Homo sapiens
cgtctttctcctcagtagtatgaatatttttcatctgaggaggtgcacttaaaatttccttcttgaaaagtcatttcaatattttagacgtttagaaacatttatatgtatgtcagaatcctttctccgaagtgtttctgctaatcctggcttctttgtttcccctggccttgactttatgacattactttcttggagagtgaagtttttagtgtttgaaatctccagtttgagatagaggtcaggaatcatgctgaacccagatgttactgaaggaacaaagtctgagcagttttgggactaagcctactttgtacaactgattatt

SEQ ID NO: 143360 - DNA, 231 bp, Homo sapiens
atgtgcttgttgggtaaagacagagtagctcactaagcttagaaaagaaagataagagaaaggctattcattgtctagtacctttgcatttctgattagcctgcatataagtggatggcattttttttgtaggcaccgagactggaactttccatattatttttcaatcttattacctctactagaaagacagtggataagggagattacttaaaccattttttgtgatca

SEQ ID NO: 143361 - DNA, 198 bp, Homo sapiens
cgagactaaactcccaagtccatgtgtttctcactttactgctctgcctagaacatgaaaactggaactgggtgggaaaaaccttagaagtcatctaggccatgcattctttttttttttttttttttctgagacagggtctcactctgtcacccaggctggagtgcagtggtgtgatcacagtaggccacttatact

SEQ ID NO: 143362 - DNA, 510 bp, Homo sapiens
gattagcagcctggattcaccccatgtcagtgagtgggaacagataagcatagagactcaagatggaggtgaaggaaggggatggacccaaagggcacaggtgtgtgatctcaccaacccagcagggcagagggaagacagaatccaagatttggcagtggggaggtgagccactggtttgtgggggcctagtctgaaggtagggagggtttggggtggaggaaccgtctggaatctcccctccagccctccctcctcttcttttttctataaaagaattttaggatgggaataactaggccaagaaaacttctgggtaagccagcccaaacagagtagggaaacaaggagatctaagggtggaaaagccagaattttgagacaggtgttcggagggtagagaacaagaggaagggaagtgtttacgagaagaagaacttgggaattccaggtataaatgcctcctccttcagagagcagattttgagaaccaaatccaattcagctact

SEQ ID NO: 143363 - DNA, 221 bp, Homo sapiens
tgggtctagagttattctcacaatcacagaactaagacctcaagttaaagtgcttgaacatggcagggagcccaagaagggtggaataccaaaactgctatttcttgtccaatctaatgactgagaatagtggtatcattaacagaatggcaaggatttactttaacttacttgcccccgccacaccccagaaagtgctagtctatctaacaagtattatt

SEQ ID NO: 143364 - DNA, 250 bp, Homo sapiens
aaaaattgaaagtatagtttaaataaaccttttcccctgaactgtttgagaataagttgccagcatgcgggtccatcaccctgaaatagtttgtatttcctacaaagacacttatctataaaaccataatacaatcataaaagttaggcagtaaacactgatacattactatcatctaattcacagagccattcaagttgacagttgtttcaataatgtcctttatagcgaaaggattcaatccaggatt

SEQ ID NO: 143365 - DNA, 333 bp, Homo sapiens
ggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacggtcctggagcagacgctgagccctctgtgggatgaactcctggtatttgagcagttgatcgtggatgggaggagggagcacctgcaggaggag

SEQ ID NO: 143366 - DNA, 389 bp, Homo sapiens
agttaggacggcgctgagtgcccaatcccttcaagcctgctcctctcctagttctctctgattcagtcaatggcagttccctcttccgatagctccagtgaaggcctcgggagccctcctgggctcttctgtcacacccttcacgtttgcttcatcagcacagtcttgggctttaccttgatgtcaaactgagaatcccactactcctctccacttcactgccccactccatccaagctgccatcctttctccatggattggttcaatagcctcaaaatggatctccttactctgcccccaaccttcccattcctcttgagtttattctcaacagggtaccgagagcgatcctgctgaagtgtgtatcagatcaagtcagtcctctgtt

SEQ ID NO: 143367 - DNA, 362 bp, Homo sapiens
cagtagcctcagactaacaatactaacactactactatcagtatatacaccaaaaacaagcatagttttgcatgtgctctcccctttcttccacactgtatctgtacagagcttgtaatcattacataccacttctctttcgactttcatttattcttaattgttgtaataaactatgtttaatattcatccccagtccttatgttgatgccttgttctctctaatcagtttgattttttaaacagattgtttaggaagggcttataggaataatatctacatttttgcaagtaacagtttctggcctttataattgaaaatcggtttgacttgacataaaatctttgtcacattttctttc

SEQ ID NO: 143368 - DNA, 722 bp, Homo sapiens
tagctctcacacgttttcctagaaaggggggtaagatggtcccaggcagcttctctcttctctaattccagtaaaatgagagatgatgacgtccctctccaatcaggctgtgatgacattttagtgcaaatgttacattgttttttttttttctcttaatactggccggccccagaatcgctgtgatgaaatgggttcatgccatgtagatttgacagcatgaacactaagtcatcatctgcaactgagtttttgactcatgacttttgatttcggaattaggctgttttcactttttattgacatgtaacatgcgtatagacaagtgtacatacagatcctgagtgtgtggccaatggatatccttcctcagtgcccagacccaggagcaggaccttcccagtacccacatcccctctgttagccagtatcctcccttctgagggtaaagttgtcctggcttctaaccctgtagatgagttttgtctctgttttcacttgatatagcatacagcatctccttttatgtctgacctctgttgctcaacactctgcttgtgagctccttccctgttgtgtgtttgggtgcccctggctctcgtgcagtggggcagtgccatgcatgatgagctgcagctgaattgcttgttctgcagttgacaggcctttgggcaggttcctgttgctcgctgctgtgagtgcagccgctgtgagtgcggccg

SEQ ID NO: 143369 - DNA, 479 bp, Homo sapiens
ttttcttctaagagttttatagcattatttctatggttttccattcattttgagctaaattttgtatatgatgtgaggtggtccaccttcatccctttacatatagataaccagttttccctgcaccagttgttgaagacactgtcctttctccactgaatcatcttggcacctgtgtaaaaaggaaatatttgaccatatgtatgagtttgtttcttccctctctgttctgttctatcagtctgtgtgttgtttttatccagtaccacactggcctggttgctgttgctttatagtaagttttgaaaatgggaggtttgttgggcgtggtggcgggcgcttgtagtcccagctactccggaggctgaggcagaagaatggcgtgaacccgggaggcggagcttgcagtgagccgggatcgcgccactgcactacagtctaggcgacagagcgagactccgtctcaaaaaaaaaaaaaa

SEQ ID NO: 143370 - DNA, 538 bp, Homo sapiens
gcggccgctgtgaatacccttgcacgtgttgttggtgcacaagtgtgtcactgccaaatccagcatcttgacttagccctctcttttcttctaagagttttatagcattatttctatggttttccattcattttgagctaaattttgtatatgatgtgaggtggtccaccttcatccctttacatatagataaccagttttccctgcaccagttgttgaagacactgtcctttctccactgaatcatcttggcacctgtgtaaaaaggaaatatttgaccatatgtatgagtttgtttcttccctctctgttctgttctatcagtctgtgtgttgtttttatccagtaccacactggcctggttgctgttgctttatagtaagttttgaaaatgggaggtttgttgggcacggtggctcacacctgtaatcccagcactttgggaggccaaggtggatggatcacctgaggtcaggagtttgagaccagcctggccaacatggtgaaaccccatctctactaaaaatacaaaaattag

SEQ ID NO: 143371 - DNA, 330 bp, Homo sapiens
aattgagctcatatgaataatatgtgtataggtgaagaaatgtgtatatgcatgaatggaggttagttgtgtgtgtgtttattggggggtgtagaaaaattgcaggcatttgaatatgtgcatgcagaatgtaccttgagtgttacatgagtgcttgagtgcatttgaatgatttgatgtatgcatgggcatgtttgaagaattttgctatgtatgtgcatggggtgttggtgcatgtgttttagcgagtagggattatatgtgagcggtgtgtgtatggatgagaatgtaataactacagtattaattttgtttataagtttggggtta

SEQ ID NO: 143372 - DNA, 355 bp, Homo sapiens
gccagcagccggcagccagcagcaccgtacgtgggtcccagctcttccacttaaccaaggtcagggacattgagccaaacattttgcctcaccgagtctcaggttccttatctgtcaaatgggaatatgaacctcaggctgacccaccccacaggtgtgttacccagagataacgaaggtaaatgtatccacataagcattaaaaagctataggaatgtatttactacaactgcagctgctgttaactacaaggcaaatacaagtcttcactggtacgtgtcagacacgtgcagagaactttacgcctggatctcatctaactgacacagaaaccctgtaaggtaggtacagcac

SEQ ID NO: 143373 - DNA, 1045 bp, Homo sapiens
  misc_feature (1045)..(1045): n is a, c, g, or t
taaaatggtggtaaatatataggctttaagtttagatagttctaaatattattaaaattaccaaattattgtttttaaaaagtattagtttcctaggacaaatagagatttttagataaggctggatttgtaatactttaagcaacaggtcacagtgcttaagtatttaatgccgatttggcaagcagctgatgttttatataatgctgtcgggtattttatatttgcgtgtattttctgatgcactggatccagcacttcatgtcacgtcatatatctgtttataatgtatacaaatgtattttcatatatatttgatgtttgatggctttgaaactttaatcttgaaataggttttaaatttttattaaaactatttaaataaaaaaaaaaaaaaaaaaaaaaaaaaaaaaaaaaaaaaaaaaaaaaaaagaaaaaagaatagcagaaaagcgcaggaggcagtcaaaaaataaaaaaacagagaggagggggggacagcactaataaaaaccacccctgaggaggctgcacaagtcgtcccctccatcacagtcttatttaacactgggccgcccccttgagtgactcaaataacaggctcagtcagccggcccacatgtaatcctcagacttcggtggggcgaaaaaccacctcattcagtatgtctgcgaaaagaagcccccactcgggggaggcaaatcaagcgcgccacgacgcactacaattcagttatctcccgggcgatgtagggactcccccccctatcgtcttcgtcgaggactacccacacagctttagtagatagttgtcccaccctatcacggtgtgtcaaagcaccaatcctgggggaacaacactgatctagtacactaaggtagtagttatcaatcgtactatgaacgatcatgagtcgcgatatcgtagctacgcaacgcgctcgacgcgtcgaaccagcacgcatcacttacgagcccgcgcagcaagattacctgacactagcaattcatgactgagtcgtgacaatgcaacacaacacttttn

SEQ ID NO: 143374 - DNA, 1356 bp, Homo sapiens
tgcagaattagcacattcacttactgccatttcctgcctatgaggagttaaatggtatttttttcttcaagaaatattccacagtagttgtttaacatgttagagacagattgaagaaagagttaaaatagtattcataaatgaatttaatctgtatcatagtctgaaagattgtttcaaggccaaggcccaatactcttctatattaaattatctcaaggtatgtttattttcaatccatgcttaagtttagctacagagtcagggataaagtaggataagtgaaggtatttaattattgttttcttttccagatcctcaacagaataattgctgacaaactctcttgcccagaaaatgtctactggaattatggagtacaaaaaaactacaaaagcaatgaaaaaaagaaggatgttttatttacatcctatttcaaaaccattgctttcttgctattgtatgtctctgcaggcccaatatcgcgcatcttcataagaagtttagaattgttccttatgtttccttctaacaaacactggtatattcacatgaaagtgtatattttattcacttccaaaacagttagctcataattcagaacattgaggtttgcaaaatgactgaaggaaactttacctaaacaatagttgccagttctgctgagaattatcacgggcccacaacggctgtgtgtttttccatacagatattctaatttttttattatgcagctaatttttttttagactcacgaataaaatagcaagtcagtctgtgcataagcatatgtttaaatctaccaggagaaatgtctggaatctttttggttattaaaattaaaattcaggataatgaaaggcatatgcaacttattatattctttatataacttatttcatctaatcctccaaatagctatataacatatttatccccaccttacatagatgttaaccaaagtctgtaaggttcgttcatttgtccacagttacccagaaaattgtttgtggagctcagcacaaggctgactgccagactccaaagtctatgttccttctactaccatacattgcctttgtttttcttttataaaagttgaaaaaatatcattctgcttttcctacttttccgaaaactatttatgatgataaatccagttttttgtgttaagtttcaagaagttggtgaaatggagacagccaatccaacccaggagacagtgtttgaaaacagggcttcagctacttgcatgatgtggattggggaaatggtctgtcctcctagccatgggatgtccctgctgtgttcaggaatctttccatctcttggattttaaaggaaagtatcctttct

SEQ ID NO: 143375 - DNA, 1336 bp, Homo sapiens
tgcagaattagcacattcacttactgccatttcctgcctatgaggagttaaatggtatttttttcttcaagaaatattccacagtagttgtttaacatgttagagacagattgaagaaagagttaaaatagtattcataaatgaatttaatctgtatcatagtctgaaagattgtttcaaggccaaggcccaatactcttctatattaaattatctcaaggtatgtttattttcaatccatgcttaagtttagctacagagtcagggataaagtaggataagtgaaggtatttaattattgttttcttttccagatcctcaacagaataattgctgacaaactctcttgcccagaaaatgtctactggaattatggagtacaaaaaaactacaaaagcaatgaaaaaaagaaggatgttttatttacatcctatttcaaaaccattgctttcttgctattgtatgtctctgcaggcccaatatcgcgcatcttcataagaagtttagaattgttccttatgtttccttctaacaaacactggtatattcacatgaaagtgtatattttattcacttccaaaacagttagctcataattcagaacattgaggtttgcaaaatgactgaaggaaactttacctaaacaatagttgccagttctgctgagaattatcacgggcccacaacggctgtgtgtttttccatacagatattctaatttttttattatgcagctaatttttttttagactcacgaataaaatagcaagtcagtctgtgcataagcatatgtttaaatctaccaggagaaatgtctggaatctttttggttattaaaattaaaattcaggataatgaaaggcatatgcaacttattatattctttatataacttatttcatctaatcctccaaatagctatataacatatttatccccaccttacatagatgttaaccaaagtctgtaaggttcgttcatttgtccacagttacccagaaaattgtttgtggagctcagcacaaggctgactgccagactccaaagtctatgttccttctactaccatacattgcctttgtttttcttttataaaagttgaaaaaatatcattctgcttttcctacttttccgaaaactatttatgatgataaatccagttttttgtaagtagctctttagcatttcaatgcatgtagcatcaggcatgtgcatttgtgcatgcctgtgaatgcctctgcatgtgtgtacatgcatacgtgtgtgggggtgcatgcctgtgcatgcctctgcgtgtgtgtgtgagtacatgcacatgggtgtgggggtgcatgcc

SEQ ID NO: 143376 - DNA, 189 bp, Homo sapiens
tctgtttttgacacctttactgctaaacgtcaataatctttgagattttaattttatcttctgtgtgtccagtcttacacagacaaaacaggcagttatagggagcctagagtgcctaacaattctgcctgcctttcttcccatcacagttctgaaatacacaaagcgacaaagttttaagcaaaaatt

SEQ ID NO: 143377 - DNA, 906 bp, Homo sapiens
gcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaag

SEQ ID NO: 143378 - DNA, 316 bp, Homo sapiens
tcaagattgttccaaaaagtgcattcaggcatacatttcattaggaatttattaattactacggattcaaaaaattcagctatgtaactgtagcttcatattataagatctcaatttgcaaagaaatgaatctatcagagtaaacaaacttatttcatgtcttcatttttaggtatctggcaatcaaaaaccaatctagggccgagcgtggtggctcgtgcctgtaatcgcagcattttgggaggcagagctgaaggactgcttgatcccaggatgtcaaggctgtagtgagctgtgattgtgccactacatccta

SEQ ID NO: 143379 - DNA, 659 bp, Homo sapiens
gcgtggtcatggcatcctagtcagagctagcatgtcttggggcgaggcactggccttctctgagcctgttgccttctttgcaaaacaggaacaatggtaatcacctgttctgctacagcgcgtgcttttgtgatacaatagctcatgtattgagaaactagaagactgggttttgaggactagtgaactggatgtcacagttcacactgctttctcccagaaagcagtggccccccaaatagtggcaatgaaatgcacaattcacaaatacagccgagtgtggccaagtctcctcgtaagacgttcccagtgcccatcaactccaccttcctcttgttggttcacattagccagtgtttttaaagctaaataaggctgggcgtggtggctcatgcctgtaatcccagcacttggggaggccaagatgggcagatcatgaggtcaggagtttgagaccagcctggccaatatagtgaaaccctgtctctactaaaaatacaaaaattagccaggtgtggtggtacgcacctgtagtctcagctacttgggaggctgaggcagagaattgcttgaacttgggaggcggaggttgcagtgagctgagatcatgccactgcactccggcagtgctgtgctctgggtgacagagcgagactccg

SEQ ID NO: 143380 - DNA, 208 bp, Homo sapiens
ccttcaggtctttgctcacatatcacctgaccaccctgagtgagactgcaacacgcaccctgcctggctccagccccacctggcagcatttgcccacagtgccgacacctcacacatgccaggccagccacttagagatgctgttctctccccattagagcctatgttctcaaagggcaggattttgtctgtttattgctgaatctcc

SEQ ID NO: 143381 - DNA, 274 bp, Homo sapiens
ttctgtgcatatcctaggtccctcctctcccccggtcctcactcaaatcagtcacttatctgatgctgtccccccagctccacggtggtgcacactgctaacccccaactgtgcaagggggctttctccatcgcgccccaagcccctctgtccatgccccgagccattacctccagagaactcatgcacccgaccctctctgcggcagcccttgaacaatggcccaggagagttgccttcctatctggggggatggctcagatacatatgctct

SEQ ID NO: 143382 - DNA, 554 bp, Homo sapiens
aagggaaaggtgtttcataaaggtgtaaagggagaagtattagttcaggagctagaaattgcacagatatttagatcctaagttaaggaatataaactctgttcactgaatttgactgactaaaagaaaaaaaaagaagtatgaactcagcaactgcctactgtgtaataggacctttaactaaatcacatacaaattacatatttatgcttagtgaattgaaggggccagaaataaactttgcttgaagtggatgaattttttttataaacaaattccatggctgtttcaagtgcctaacaaatttgtattttgctccaagcagagtacttgccatgtggtagggtctaaaggctccggcacacactaggtagttgttgagtgtttgttgtgtgattgaatgcatgaaatgcagcttcttcttatgttacttagacaccatgtctcagtcatgctgtcctgcaatcctgcctagccttggtggtctagtgttaaaatagggaattaatctcttctgatccttagaaaagctctggtgattattgaaaaaaaaa

SEQ ID NO: 143383 - DNA, 489 bp, Homo sapiens
tatccaggtgggtcgaatataatcacaattgtcttcagaagagggaaacaagaggagtcaaacagagggcaaggcaatggtggaagcagagagacagagatagagaaggggtggagagggagattttaaaatgccacgcagctggctttgaaggtggaagaagggactgtgagccaaaagatgtttgtggccttgagaagttagaaaaggcataaaaacagcctagcgcagtggctcatgcctgtaatcccaacactttgggaggccgaggtgggtggatcacgaggtcaagagattgagaccagcctggccaacatggtgaaaccctgtctctactaaaaatacaaaaattagctgggcgtggtggcgtgtgcctgtagtcccagctactgaggcaggagaattgtttgaacctgggaggtggaggttgcagtgagccaagattgcgccactgcactccagcctggtgacagagcgagactccatctc

SEQ ID NO: 143384 - DNA, 853 bp, Homo sapiens
ttttttttttgagacagagtcttactctgttgcccaagctggagtacaatggcactatctcggctcactgcaaactccgcctctagggttcaagcgattctcctgtctcagcctcctgaaaggctgcgattacaggtgcccgccaccacaccccgctaatatttagtagagacagggtttcaccatgttggtcaggctggttttgaactcctgacctcaaggtgatccgcccaccttggcctcccaaagtgctgggattacaaggtgtgagccactgctcctggccttatggtgaagtcttgtatgtagaagatcaataaatgttcatcttcattgcttatattcatccggttctctgtatacaaaatgatcttctttttgcaggcatttttttgcttctcaagttttaacttcttacacattttaagactacttcaagattaatttgagtgtaaatgagcagtacttgttaggtaagtgtcttccattcaccgtcaagactgaatcattcttttcattatcaccacatattgcttattgtggaatttggaaacatccatttctcttcttcaggaagatcgtggagtttctccagtcaaggtcccactagagtgagttagggttgcagtaacctggagtgagcaatccctgattccaggtggtgatgtgggttgagtttcacattttactttatttgaagaatatgtgccaaagactcactaaaaataagaacaaactaggctttgttgcagctgagtggtctggcaaatttctgtatagaggaatcattgggcatgaaggatttgatactgggatagaatccaattgcccttggaatggaagtagaatatcc

SEQ ID NO: 143385 - DNA, 920 bp, Homo sapiens
  misc_feature (12)..(12): n is a, c, g, or t
gctgggggcggnggctcacgcctgtaatggctgcgcctttggaggtccaggcagaggcaggcagatcatgaggtcaggagatcgagaccatcctggctaacacggtgaaaccccgtctctactacaaatacaaaaaattagccgggcgtggagacaggcaccggtagtcccaggtactcgggaggctgagacaggattacaggtgcccgccaccacaccccgctaatatttagtagagacagggtttcaccatgttggtcaggctggttttgaactcctgacctcaaggtgatccgcccaccttggcctcccaaagtgctgggattacaaggtgtgagccactgctcctggccttatggtgaagtcttgtatgtagaagatcaataaatgttcatcttcattgcttatattcatccggttctctgtatacaaaatgatcttctttttgcaggcatttttttgcttctcaagttttaacttcttacacattttaagactacttcaagattaatttgagtgtaaatgagcagtacttgttaggtaagtgtcttccattcaccgtcaagactgaatcattcttttcattatcaccacatattgcttattgtggaatttggaaacatccatttctcttcttcaggaagatcgtggagtttctccagtcaaggtcccactagagtgagttagggttgcagtaacctggagtgagcaatccctgattccaggtggtgatgtgggttgagtttcacattttactttatttgaagaatatgtgccaaagactcactaaaaataagaacaaactaggctttgttgcagctgagtggtctggcaaatttctgtatagaggaatcattgggcatgaaggatttgatactgggatagaatccaattgcccttggaatggaagtagaatatcc

SEQ ID NO: 143386 - DNA, 866 bp, Homo sapiens
  misc_feature (12)..(12): n is a, c, g, or t
gctgggggcggnggctcacgcctgtaatggctgcgcctttggaggtccaggcagaggcaggcagatcatgaggtcaggagatcgagaccatcctggctaacacggtgaaaccccgtctctactacaaatacaaaaaattagccgggcgtggagacaggcaccggtagtcccaggtactcgggaggctgagacaggattacaggtgcccgccaccacagaactcctgacctcaaggtgatccgcccaccttggcctcccaaagtgctgggattacaaggtgtgagccactgctcctggccttatggtgaagtcttgtatgtagaagatcaataaatgttcatcttcattgcttatattcatccggttctctgtatacaaaatgatcttctttttgcaggcatttttttgcttctcaagttttaacttcttacacattttaagactacttcaagattaatttgagtgtaaatgagcagtacttgttaggtaagtgtcttccattcaccgtcaagactgaatcattcttttcattatcaccacatattgcttattgtggaatttggaaacatccatttctcttcttcaggaagatcgtggagtttctccagtcaaggtcccactagagtgagttagggttgcagtaacctggagtgagcaatccctgattccaggtggtgatgtgggttgagtttcacattttactttatttgaagaatatgtgccaaagactcactaaaaataagaacaaactaggctttgttgcagctgagtggtctggcaaatttctgtatagaggaatcattgggcatgaaggatttgatactgggatagaatccaattgcccttggaatggaagtagaatatcc

SEQ ID NO: 143387 - DNA, 425 bp, Homo sapiens
gaaaaatctaaagaatctacaaagtaagttgccaccttactgcaactaaaaagttgtagagcgtttagtgaggtgataggatacaaggtcaatatgtaaagacagtgtatttctatgtcctagccacaaacaattagaagttaaaatgaaagtatacctcacttcagctgattaagaacaagagtatgaattaaaattagactgcttggggccaggtgcggtggctcacacctgtaatcccactttgggaggccaaggtgggcagattacgaggtcaggagctcaagaccagactcaccaacatggtgaaaccccgtctttactaaagatgtaaaaaattagccaggcgtggtggcgtgcgcctgtaatcctagctacttgggaggctgaggcaggagaatcgcttgaactcaggaggcagaggt

SEQ ID NO: 143388 - DNA, 602 bp, Homo sapiens
ctaaactgtcctgtgagctgggacaaggcatttccctctgggcctccattgctcttctgtaaagtgaggagtggggctgcatcccctccaatcgtttctaacactttaatattccatgtctgagcaccctgggggagatgcagggagtgcatttctgaggaacgacctgctgagaacatctttggttcgtcatgtcttggcagcctcagactagcaccctccctaggccactgtcttgagatccatcccctgaaagtcaggagggactcggcttggtgccacatatctcacaatcactttgctagagctgacttcccagctgagtggaggggaaatccaacaaatattcccatccctttgaatttcttgtctgaacgtttatattccaaagcagtgaaagcctgctccacatggctgagactcagcccaggctggtagatttctgctccaacaggctggtatcacagcacaacagacagggctcaacaaagggcacccaggctcggcactgcctaagcctctgcctctctctcccccaacttggccatcgccagttgagaataccagtttgaatgggtcccctacaaagtaaacaattattc

SEQ ID NO: 143389 - DNA, 467 bp, Homo sapiens
gaacaagaaccggaaccttagtcacttttagtggaaaacaacagaaagcctacctgtatagtagctggaaactgattagcaatcattttaagatcagttattttgtgtctattatagaactaatattaaaaggacaattgctggtggatgctgtggaagggggaagaacgtaggtttggatgtctgggttcattacatggcctgctccttttatagagccagaggccctgggatactggtagaaatgtaggaagctagagctctgcataatttgtcaggtgatttaaggcaagttgggtggactcttgcttatagattggtctgatcaataatttgtccacctattaatatcttagaagtgttaataaggcattcgcctagttggtagttggggggattatctgtagattttcagtatggcaggagaggggaaaaaataggagaagaaagtggccaggcattagggg

SEQ ID NO: 143390 - DNA, 709 bp, Homo sapiens
ctttcatgtctatgaaataaactgggcaaactgaatgttttcccataacccttacattcatacggcttctcttctctgtgcatcctttcatgtatttgaaagaaagagaaattactaaatggttttccacattccttacatgcatagggtttctctcccgtgtgagtcctaccatgtgtttgaaggagtgaggcagatctgaaggctttcccacattgcttacactcgtaaggtttctctccagtgtgagttctttcatgatatcggaaggaactggaagaattaaaggctttaccacattggttgcatttatagggtttctctccagtgtgagttttttcatgtgtttgaagtgaactgggagaataaaaggctttcccacatatcttacatttatgagatatctctccagtgtgcattcccaagtggttttgaaagctggtaagataagataatactttcccacaatgtttacattcatagggttttttcctagagtgggttctttcatgtctgcgaacagaactgggacacttgaatgcttttccacattccttacattcatatggcttctcccccgtgtgagttctttcatgtatttgaaaggaatgggaagagctgaaggctttcccacactgtttacattcatatggcttctccccagtgtgagttcttttatgagcatgaaggcatgtggaactatggaatg

SEQ ID NO: 143391 - DNA, 234 bp, Homo sapiens
tgtggagtgagatcaatcccctctgcgaggcctctcctaggtgaagctcaagctggcttcaggtagggccctggaatattagccggacatggtggcgcacacctgtaatccaagctacttgggaggctgaggcaggagaatcacttgaacccaggaggctctaacccaggagtttccagtgagccgaggtcacactattgcactccagcctgggagacagaacgagactgtctc

SEQ ID NO: 143392 - DNA, 268 bp, Homo sapiens
gactaatactccacaaattcacttatatgaggagtctaggagtcaaattcctagagactgaaagaacggtggttgtcaggggctggggagaatggggagttcatatttaatggggacagagtttcagttttgccagatgagaataacctggaaatggatggtgtgatgtttgcacaatgtgaacgtactttactccactatacatttgaaagtgagtgcaatggaaaagtttatgtgatgagttttttaccacaattaaaaatataac

SEQ ID NO: 143393 - DNA, 632 bp, Homo sapiens
aatggcacaatctcggctcactgcagcctctgcctcccaggctcaagcgattctcctgtcttagcctcccaagtagctgggattacaggcacccgccaccatgcctggctaatttttatatttttattagagacagggtttcaccgtgttggccaggctggtctcgaactcctgacctcaggtgatctgcctgccttggtctcccaaagtgctgagattataggcgtgagccactgctcctggcctattgcctaataatattagctattattattgtatggaatatataaccctggaacttctcttttaggggctgttgtcattaagaaagtgagggtactgtttcaaatgtttaaatagagtttaaacattgtttctgagacttccctattttcgtttcccagtaactttatcagaagttgaatatcatttagaattctctcatctttttaaaagcttttctttatatctcatatgctgcatacgtagaacccagatttggtcttttttacacactaacattgtactggatacaaagttattgagaaatcagcagctttaagtgggtatgtaattaaaataaatttcttcccttcaaatttataccattgtggtagctgatactgcctgtt

SEQ ID NO: 143394 - DNA, 402 bp, Homo sapiens
ggaggaagggctggcatcgccttcctgagactagacagtgcacagcccctgggtgagatgagctcagagtcagcaggggcctggtgggcttgccacacctggctggtgggacagggcaggggcatcactcaaattcaaaagaagccacttgagggcagtaaaggaaatgccggcgtgcgctcaggcagggcacacgtggagcttgctagtgggaaccagggccactctctagaagctgagcaggctgggggcggtttccaaggcatccatgcattctgcctctgtgacctttctaagcgggcggtgggtctgtccctacccagggttagccaggcacggggcagggctccagtctccagtgccgttcttgtgcccatcagccaccagggcgcaggaggttgg

SEQ ID NO: 143395 - DNA, 206 bp, Homo sapiens
tattttcttctaactagtgggagagtatgaaaggaagtagaagttgtccaggtagcaaagagaaaaatctttaaatgcagaaagttcaaagagagagaaggcagtgaggtcacaagtgttgttataaacatggctacaatatgccccatgacctttctgtgagacatggtgacaaatgccagcattcttgtgggggtcagactgag

SEQ ID NO: 143396 - DNA, 260 bp, Homo sapiens
gattaagtggatctgtttcaaccacgtggttgtccctgtcagtggcctaggccacagagtgaggctgagtaactctagagcccttgccatgatctctgctctgtgcactttcctgtatttctacattctgccctacagtcaatccacacaaacgctgcatgaagtccaaccaagccctgagcctcccatgattaatctcttcccccaaacattctagcactttccatatttgccactgaaatatagtgcctcctggcccc

SEQ ID NO: 143397 - DNA, 515 bp, Homo sapiens
tcgctcgtgaaaaccggcctggcgtcttctggcccttgctcttgggtctgctgtttctctcacgggagaggctgctctgaggtccccgaagctgcaggctgggtgggacggtgggagcctttccctggtctttagtccggctgacatcctctctctggccgtcatagccagcgccatgggattggggaagccacagggacctcccagcacgcgccaaccctggacttcccccagagctcatctgggtggcaggtgctggccacgtggagtctgccctccacgtgccgtgggtgaagcttcacctggcgcagggaaggccatcagacttccagctcgtcacccatgtcctcaacccctaaccactgaagcgatgcctgtgttttaaccttagtaaccgtgccgcccagctcctagaagacacgcgactccacagcagttaggagacagcagatgcattcccagagctcctgagaaggagcggcttgtgtggggtgactctatctcaagccgtaggc

SEQ ID NO: 143398 - DNA, 471 bp, Homo sapiens
gcatatttcacaccacagagaagataaattcccaaacatattacggatataatgaaaaataaaaaagaaactacacaaacactgtaaggcaacatggatttgttcctctttaatcacaatgttactgtaaacctttctaaccacatttttcaaaatccagatggcagtaaaaaatcaccataatcgaccgcctaaaaggtaaaacatttccacctgactgacatgcatacacaaagtccatagtacaagcttataaactgggactagatgtctgcagcatactgcatgagtaaaaggctaatgtccctaccatataaaaaaattcttggctgggcatggtggctcatgtctgtaataccagcactttgggagactgaggctggaggatctcttgaggccaggagtttgacaccagcctgggcaacatagcaagtccctgtccctatgaaaaatgcaaaaattagctggggt

SEQ ID NO: 143399 - DNA, 395 bp, Homo sapiens
caaacatctatttcaagtctactgtccttcgaaagactgaccaacaagaaaccttaaaaagctgcaacttgtggagggtagctgggtttcagcccaattttaccagtgaagtgccgtatgaccttgggcaagtccctgtatttctgggtctccactacttctacaaattgggatcaggcgtcctattttccttgcatttaactgcatccaaacactgtgctaggattctcaaaactgcaaaggaagtccatcatctgtctcactgactctgagtcataaatatgttggaaagtattgtcccatttcccagaagaggaagctgaggctgaggcaggtggagggacttggcccaaatcctagagcaagtagctaatgaaggaattatgcttgggtcc

SEQ ID NO: 143400 - DNA, 299 bp, Homo sapiens
tgtttaggaattttaagtgttttgacccaggttagtattgggggtgtgggctatgtagaattagatattgaaatcacttagtcttgtttttaaactgcaaaccaaaagaagttcttcactgtagcaaattacagtcttgaaattcccccaaaatctttgctttgaattgggttttggaggttacattgagattgatgttatcaacatagattgttacctgacagtttggataaggggcccctttttctctaatttttgtggttagaaattaggttaaaaggtagtcttctgaaaagtca

SEQ ID NO: 143401 - DNA, 351 bp, Homo sapiens
aaactgtcaaaccaaaaaggaagtgagttgaaaagacattctctaccgagaatgcagcaagagttgtagatatcaagttactgagttgctgcttgagaactgaattataaataaatgtgttaggtagtggaattttgttttgttttccccaaaggagaaatattcgccacatggaaacaaaatttattcagcatattttcattctgtaattgcaccattgctattcttaattctttgtgtttctgatttaaagggaaaacacacacaaaaacagactgttgtgtaaaattgacaagaatgagtgtgaacctgacagtcagagacagaggttgttgtaaaattagcaatgga

SEQ ID NO: 143402 - DNA, 742 bp, Homo sapiens
atcacttgaacctgggaggcgagaggcagaggttgcagtaataagccaagattggaccacagcactccagccttagcaatagagagagacttcgtttcaaaaaaaaaaacctatgcaaatcccaattacacacgctgagtggcatgttcagctgagccacctgcccaaggcgggaccctctcttcctccgtctgcaggtcacatggagatggcagagcacctgcacgtgcacctggagaccctctcaagcctcgtctcctggcactgcctcctcctgacattggaggctgctgggagtaccagcctgtaaccctcgttgtgatggcacctgcctggtgctataattcagacatttgtctccccaacctcatgttgaaatttgaaccccaatgttggaggtgggacctgacagaaggtgcctaggacatgagagcttggtgctgtcctcgcggtcatgaatgcattcatgctttattccttctcacaagaactgattgttaaaaacgcttggcacctcctctgcccactctctcttgctccctctctcaccatatggtctgcatgcacctgctcccatcgccttctgccatgagtggacacttcctgaggcctcaccagaagcagatgctggcaccatgcttcttgtacagcctgcagaactgtgtgccaaataaacctcttttctttataaatcacccaacctcccaacacaaatcgtccaagacacctggtgtcccccaaa

SEQ ID NO: 143403 - DNA, 469 bp, Homo sapiens
cagtatatgtaagtaaacatcaaggtatttgttacctacatgttttacccatatcttaattatctccgaaattgtttgaagagtcttaaaatctctaagaaaagggcaaatagataagcagagtgacataggacaatacttatactagaaaatataaaaactttctagcagtcaaggtttctaggagatcattgtaggttacctaatctcataatcttatgtgaataagcatttcagttcctcaagagcaccaaaaggaagtctccttgagggtttttgtataactcatattgaactatataattttcagaatctttgccagaaattttacaaaaattagagtttttcttataaagttgtttcttatatagacagttgacaaaaacaagagcataatgaaaccagctcaattgtcccatagaactgatgtttacagtcttttaaaaataaacatataaattgaaactta

SEQ ID NO: 143404 - DNA, 677 bp, Homo sapiens
gcaactgatagaggatcttcttacatttgctttatttcatggtgctgcccaaattcatgctgtaccctcagcagcaaggagtgggaccattactcctggcgttcccagatggaacagacaccaagcctggctttgccactgaacacaatacaggactgataaaggaaatagaggctgcccatctctcagtgccacatatgagaaagggaagttgtcattttatatatccactgtcaagcatcttggtaaaacagaagaaagcaggctgggcctggtggctcatgcctataatcccagcactttgggaggccaaggagggcagatagcttgaccagcatgggcaacatggcaaaatcctgtctctacaaaaaaataaaaaaaaacaaaaaataaatgtagtcccaggtactgaggaagctgaggcaggaggaacacttgagcctgggaggtaaaggcttcagtgagccgtgataatgccactgcactccagcctagacaacagagtgagaccctgtctcaagaaaaagaaaaacaagagggaggcaatctactttatacccagagaattttacatgcaaggaatttgactatgaataagcctccattgcttaagagagacttcactatttgggattttaagaaagaaatacacaaacaagcaaatctcatcagcagag

SEQ ID NO: 143405 - DNA, 616 bp, Homo sapiens
ggcctccattgtcatgtgttgtttcccatgtgtgtcctgtcttcagatggcattttcctccttctttagggcaccagccacgttggattaggacccactcgaatgacctcattttaattgattatactgcaaaagcccttttccaaataatgtcacatacacagattccaagggtgaaagcttcagcatatctttctggaggatacaagtcaatccttaagaataggttaatgggccaggtgtggtggctcacacccgtaatcccagcactttgggaggccgagacaggcagatcacctaaggtcaggagtttgagaccagcctggccaacatggcaaaaccctgtctctattaaaaataaaaaattagctaggcatggtggcacacaccaataatctcagctacttgagaggctgaggcaagactcacttgaacctgggaggcggaggttgcagtgagctgagatcatgccactgcactccagcctgagcaacagagtgagactctctctggaaaaaaaaaaagaataagttcatgcataaacacaatatggtagattcatacaaggggattttttaagcaatcaaaagaaataagttatcaaatcataaaaaga

SEQ ID NO: 143406 - DNA, 195 bp, Homo sapiens
aaaacattttatgaagtgcagtggttcggggctctgactctgcagtcagacttgccagttctgccctacactggctgtgtgccttgggaaagttacttagcctctgtgtgactctatttttttcatctgtaaataagaataattaaaaataaggccgggcgcagtggctcatgcctataatcccagcattgtggg

SEQ ID NO: 143407 - DNA, 238 bp, Homo sapiens
tgtgtgtgtgtgtgtgtgtgtgtgtgtgttctctagctagcctgcagggacgggactcagttcctcagcagcccagtgcctggcacaacaggcattgaattagaagtgccagacattttcaaactttaaggtataatttgtttggacactttggctgggcattttgataaaacatccctagttaaaagatggcaaccaacaggcatcaaaccaaaaccaccctcaaagagcaaaatat

SEQ ID NO: 143408 - DNA, 427 bp, Homo sapiens
gaggaggtaggctgagatagatgtgacctttgctcttgcaaagctgatatcctaagggttggaccgatgctaaatatgcaaagaaacccaatacttgcagatggtgctgggtactaccaaggaaagaaatagggtatgtgacagagtacctggaaagggcactggccagcttttatgggcaagggacgtcaaagaaacctgtctggagatgagacaggccaggaaaatcagggcaggggccagagtagggcaaatgtggtgcctagagcctcatttttttttttagatggattctcgccctgttgcccaggctggagtgcaatggcaggatctcagcctactgcaacctctgcctcccaggttcaagcaattctcctgccccagcctcctgagcaatatggtgaaacccaatctctactaaaaatac

SEQ ID NO: 143409 - DNA, 114 bp, Homo sapiens
cttccaggcgaatcctgacctccccaaaccagaagtggacgagaagtaaagacagtgaagaagaaaaaagtgaaggaagaaaaactccaaaagtatactaagaatcaacgtgag

SEQ ID NO: 143410 - DNA, 833 bp, Homo sapiens
gagcatctttggattttagtatccacaggactcctggaaccaatctcctgtggatacagagggacaactgtacttcatcaattgacctagatccatctctattaatgtgttctctgatacttgatgcctttatttcccttatcttttttataattgttagtttttttttttaaagggtctgattctgtggtagcccaggttggaggaatgcagtggcatggtcatagatcactgtaacctgaaactcctgggatcaagggatcctcccatgccattctcgggagtagctgtgactacaggcaggtgctaccctgcctagctgtttactttttgtagagatggcggcttgctgtgttgcccaggctgatcttgaactactggcctcaacaatcctcctgccttagcctcctgtgtagctgggactacaggtatgtgccaccaccacgcctgcctaatttttgtaattgttgtagagacacggttttgccatgttgcccaggctggtctcaaactcctggactcaagtgatcctccctccttggcctcccaaagtgctgggattataggcgtgaggcactgtgcctgttctgtgcctgttttttcatcctgaaataggaataagtaatagaacattcctcctaagtttgttgtaaatgaattaatgtgcatagaacagggtctgtcatacttagtgcctaataagagtgtgtgtgtgtgtgtgtgtgtgtgtgtgtgtgtatatatatataaaaaaattatatatatttatttatatatatttatttattttcgatacagagtctagcctgggcaacaagggcaaaactcagtct

SEQ ID NO: 143411 - DNA, 186 bp, Homo sapiens
ctgtcctcctgagcccctgggaaccaatgacaacaccagtgtattctggttatttctggatgaaaatttaaagaaggtcttgcccagaaatccaacagctattctttttttttcttttttattttattgtaaattgactatttactattgtgtatatatttatggggtacaaagtgatgttatgat

SEQ ID NO: 143412 - DNA, 350 bp, Homo sapiens
gatcatgccactgcactccagcctgggcaacagagcaagactctgtctaaaaaaaaaaaaacaaaaaaaacaaaaaccgaaacaaaaaaagaaaatccatcaatggaattggaattcaaaggctacattttccccaaatttctaccctaaagggactgctgctgaccagtacaatgaggaaacaatttcatctctgaaaatttgtaatcacttgctggcattattgaagttataaccacagggtggtccaaaagaattcaagccacaaatttcatttaatttggtgccatattgatgacgtccctaggaagcaaaggaacaaatacaaatccattttgagaagttaccct

SEQ ID NO: 143413 - DNA, 398 bp, Homo sapiens
aaaactgtgcataagtgagtacgttttggaggaaacatcttgtctcaaaggtatccgtaactccaaaaatattaaaaatcggtcattttattgcatttattatttatatttttgagacggagtctcactctgtctcccaggctggagtgcagtggtatgatcttggctcactgcaacctccacctcctagattcaagcgattctcttgcctcagcctcccaagtagctgggattacaggtgcccaccaacatgcctggctaatttttgtatttttagtagagactgggtttcaccatgttggccatgctggtctcaaactcctgacctcaagtgatccgcccacctcagcctcccaaagtgctaggtttacaggtgtgagccatgatgccccaccaag

SEQ ID NO: 143414 - DNA, 390 bp, Homo sapiens
caggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctaatgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagctt

SEQ ID NO: 143415 - DNA, 354 bp, Homo sapiens
agtattttgttaatgttaaaatattttatacttgcagacctggtatttcggatagatttgtttaaatctgtgatattattccaattaccttcacttcttttgttttactttttaaaatgtggttactacaaaatgcaaaagtaaatatgtggcttccatcatatttcatcacatttagtgtggaccctgaggatctaggggagttatgagccttaagttgagggtgacccaggtcaacgtgaattgctctgaaagagaagcaaagggcataaagagaacgtataaatggagagaggagctcagtctcacagggtgaggaaaggctttctttcttacacagtctggcacttcttc

SEQ ID NO: 143416 - DNA, 486 bp, Homo sapiens
agacctgctatttactccatggctgaacagccatggctctagaaaaataaaaggcaatagtaaaatggaaggtggaggagagggagaaatcaagaacaccacacacatttccggcttaagcacccagtggtgtcatttaacaaattaagaaacaccagaggaagtgtaggaatcatacattccgttctggatgtgttcggtttaaggggcatccaaatggaaacattcagtagcaattcgatagagtggtcctcagactcaggagagaggtaaaaactgaagacataaaaatgaatactcagcacacagatgaaaaatgaaatagaaagcgatgagaaagcccaaagaaattcaaacatttaataaatgagcacagaaagactcaaaaggtgactgagaggccaggcacggtggctcacgtctataatcccaacactttgggaggccaaggcagacagatcacctgaggccatggagtaaatggca

SEQ ID NO: 143417 - DNA, 228 bp, Homo sapiens
cttgggacatttagggtggtggcaaataactctgcagtgtaacagcgcttgaatacaatgatgacttgtaagggtatcaacattatgggaagacagtgttagaaattacagatttgtgaaagaattttttttgttttcattttctgagaaatagatatggggtgcacagtgatgttatgtatgaagtgtgggatgattgaattagctcattaacatattcatcacctt

SEQ ID NO: 143418 - DNA, 84 bp, Homo sapiens
atactcactgagctcttgctgtggcactccctatggtagcaatcgagggtatctacacttgattttcaaggaataataaataag

SEQ ID NO: 143419 - DNA, 469 bp, Homo sapiens
attttttttacttaacaaacaaccatggcattatgagttaaaattgcattatatcttttaagttttaatttgggaaggaataatattttaactgtaatatactcaagtacttatatacaatttttccttaatagtttaaatggcatttctcccaaccccatttcaattttcaatgaattacttctcgcacataatgaaaatagctcttggttttgggatacacgtgtattaatagcattagtatgctattgcagcatttaacaccgtatttgttgttgacttacctaaaccctgaccaagattaggtaatcactgctattttagttttatctggaatttttaaggaaccctagtaaaggttttattctgctgtctgtcatacatcttgtaagtatgacatacatattatctctttttgtttgatttgtatttttctacttaatcatagtttgtactactgaggtgtaag

SEQ ID NO: 143420 - DNA, 540 bp, Homo sapiens
ctcttcaagggacagtgagtaatgacacagatttaaagtcagccgaatagctggtatctggctcttagtcttagcgaggctttgactagttcttaaaagttgacattcttcctggacttgcagtctgagtgcatgaggctctccagggaataaaaattagcctgctgtctgaaatgtttatgaaaacagctaaatttagatgatcaaagatttggggaatccagggacccttgagattgaagactgtgatatctttaacaagtatctcgaacggcaaaggttttttcttcagaaattccccttcagaggcatttaaagttctagtgggaagccgttttaatttctctttaatgggtgggatggagcgaggtcttgtttaagtagaccacttgaacattttcttttcctctgttcattggctccaagctaacttttgaagagagtgttgctttagaccaaactggaattaattctaaaagagaaggcaggtctgtcgctcaagtttaacatgtggatgaatttgccatctcgaattaaaat

SEQ ID NO: 143421 - DNA, 344 bp, Homo sapiens
ttctggaccaaaagggttggaatgatgaaacgttccatttgatgaagcagcctcctgtggccaggtctggtgaatcaggacattctgattcccagtctcctgcactggagtctcagcagctggcaaggcaacagtcagcagacaggttgctttcctctgggaaggggatggagcaggcaccgccacaggcaccgctgcagcggctgtagctgctgttccaggagttgctgagatccagggggatggggcacttcaacggtgatttagggaccgtgggcagggctgagcagctggatcccgtctgagcctcctagtctgctgctcagcgtgcagctcccaggagg

SEQ ID NO: 143422 - DNA, 215 bp, Homo sapiens
gattcaaaaagaggggggattgtcattttctctcctttaagaccccaggctattgaacttgaggtggccatgtttggaggtggcccctgccccacatgactcctttggttgttggcagtgggcccagcctaatcattaggagaggggagccaatccatgcccttttagagccatgccaacaactgtgtgttctagctcagcatttcccagaatgg

SEQ ID NO: 143423 - DNA, 296 bp, Homo sapiens
cccgtaacacacccgcacttgcctagtttctcctcccacctggagtgtcacagatttcatctgccgtctttgtttttcaccccagcttcaggaacaacagctgattctttaagacaatgctcaatacattctagtcaaataaatggttttaagcgtccacaaggtgccaagcctatgattcccgcattctcttaccctcagcaacttcatgtctacagatgctgagtttctcagtgagtattaaaaacaaatgaaagattggtcgggcacagtggctcacgcctgtaattccagca

SEQ ID NO: 143424 - DNA, 909 bp, Homo sapiens
aactttgacagaattggagatagaattagatagccacataatagtaggagacttcaataccccacttaaaaaaaaatggagagaacaaccagcagaagatcaataaggaaataaagaaattaaacaacacggtagatcaattggacctaaaagatatatacaaagcaccccaccctaacaacagtagaatatacatttttttctagggcgcataaaatggtctccagataaaccatgtgttagaccacaaaacaagtcttaacaaattcaagaaaatggacatcacaatggattaaactggaaagcaatagcacaaagaatacggaaaaatctacaaatatgtagaaattaaacaacatactacttttgaccaataggtcaaagaagaagtcacaaagaaaattgggaaataccttgagacaaattagaatggaaacaatatttcaaaacttatgagatgcaacaaaagcagcactaagagaagtttatagctataaatgtgtacattaaaaaagaagatctcaaatcaacaacctaactttacatcttaggaaactagaaaaagatgaacaaactaaatccaaagctagcagaagataataaagattagagcagagagaaattagagaacagaaaaacagtaggagaaaatcaacaaaactaagagtagctttttgaaaggatcaataaaattgacaacccttagctgattaacttaaaaaaagagagaagactgaaataactaaatataaatgaaagaagagatggtacaattaatgccgaagagataaaaagagaatagtataagtgaatactatgaacaattgtacagcaacagattggataatctagaaggaatggatgaattcctagaaatatacaacccaccaaaattgaatcatgaagaaa

SEQ ID NO: 143425 - DNA, 407 bp, Homo sapiens
gttaatgatgtcgtctcttaaccaagaccagtctatacaaagaaactgtaaagagttgacagttgacactagacaaagtgcaaacttaaagagttatttataaactgtattaagtcagctggtgcctgaaagtgttcacgtaatggtaaaaattcagctatcaactctgaacaaagctggtctatcatattcagtcccattacagtaaatcatgtttcatcaaatttaaagttgcttcaaagtctcccaaaataaagcctgttctttgatgtgttcacttctctgcttagagtaactagaaatatacgtgatgagatggacttcaacccctggacatcagtgcttttccaaattcatatttccctcctatttttctagccacgactcccgtttctttccaacttccc

SEQ ID NO: 143426 - DNA, 103 bp, Homo sapiens
tttcaaatgtctcttaagtatttgaatggacatcacagtctggaagacagggacggttctggattggtgttataaaatcaacaggtatttgtctatagaaccg

SEQ ID NO: 143427 - DNA, 377 bp, Homo sapiens
atttgctgaaaccggcagaaccatatatgaaattcatatatacttaggaaagctgaacatacttgcttttatagaggtttctaatgaatgaatgaatggaattgaggaaagaagcttaaaatgcctcatgctttttaaattttaccaatgtgctgcagagagctttcattgggaatgaagtgtaagcctcacctgacacactaagaaccacgtgaatttccaagaaggggaaaggtattcttgcctgagaaagccccggctaatgtgtcttccatctggaaagtctttgcaaagccagttgggatgtgccaagttcagttatatttgggtgctcttccgagagaacttcgcaggggattgggtcagctctttctagg

SEQ ID NO: 143428 - DNA, 286 bp, Homo sapiens
gtgcatacagatgcagtcatacagtggatatacgcacacgcatcgtcgacccgagcgagtgcgcgcacacatgccctcacccgacatccacacacagccctctgtacataaacacacacattcacatgcacacacagcctgtcacacacttgagcatacacacagttcccagcacacatgcatgtgcacaaacatgtacatacacagtcctcagcacacacacaccgtgacatacacctgcacccaatagacagctgcatacacacagcacacatacactcacaca

SEQ ID NO: 143429 - DNA, 481 bp, Homo sapiens
cctaagaaggggtgaactggtccaggttggaaatggagcaggtggaaattcctgtactgatcagcagtgggatcatgcccgcgaagagccactgaactctagcctgggcaatatagtaagaccccatctctttaaaaaacaaaataggaaaaaaattaaaaagtcaattattaacaacagaaataatgtttaaaaaagaaacacagtacagtacagtacaatactatctgtgactatgtgcagaggcaaataatgtaaacaatgagtactgatttaaccaaaaggtaaaacattgggaaaatgggggcggtgaagcagaggggaggaaaagaaaggggatggctgtttaagaaaactaaatcatccaccttaataatggtctcgaataatgtatcaaaagataaacattttgagctgggcatggtggtatgtgcctgtagcgtagtctcagctacctgagaggcggaggcaggaagactgc

SEQ ID NO: 143430 - DNA, 240 bp, Homo sapiens
gcggccgcctactactactactactgctcgaattcaagcttctaacgatgtacggggacatgtgcatgacctagggacccaaaaaagttggtgctgtttgagagatcctttaaatggctctgaaagatggcagcgttccctttttcccctgtatcttattacattatccctaggagtaagttttatcttgtataaacacataacaataaaaagatgaatagatgtggaacccagagttgg

SEQ ID NO: 143431 - DNA, 645 bp, Homo sapiens
tatctattcatcttaaaccatttagtaatcaaaaataaatagggaaaaataaagctggatattcatacatagagaagtgtagattcttcaatggaaaacatgttttttaagtgtccaaggaatagttataaaatttctgagtattttaattaaataactaagatttaagtgttagactcatgagaataacttagtcaaaggcctaagcatgagagattaagtttgataaacattgaaaatgggctgaaaagcctgagtaagaaaattaattactttttcattttagaaattataggacaacaatttttcccaaccgtcaggggtgtatatatgtgcatgtgaaagtgcttatgttaatgagcttgttaataataagttatacaaaattattagttggcagcaaccagattttaaggaatattggccttcttgggcttccgaagaaaaccttggacgcttttggtaggaaaagttgggattcactctccataaatccggcgttgaaaaaatgaatcaacaggggtcatgattctagttttgaccaagctacatataacagtgtaggcatctgatgtatgatctatgtattaggttggaaaatttcccttacaactgacattgctgaatacaaattatatagaggtt

SEQ ID NO: 143432 - DNA, 1631 bp, Homo sapiens
gtgaccctggctattccctctagggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggtaaaagaaaaaaggaaaatggatggcaaattccctgtctttctgaatccaaatcttacgattgctaggggcctggcagttctaaaaactgacttcgtggtcaagtagctttggagtcactgactgtctccagacgtccatttttgcacatgagaaatgaggatataatactacagaagaggcatcttacccaaccaatgcaccttacttctctgtgaaacacaggggatgctgggcgcaggcctaggctgtggcctgtagcctgtaggacagctcctgccagcagccacaggaacagtgatgtgatgtaacatttcccaagtacttagctcatgccccaccctatt

SEQ ID NO: 143433 - DNA, 2113 bp, Homo sapiens
gtgaccctggctattccctctagggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagcgtgagttgatgtagagtattcctggcggtgcctctccttactgcaaatatggcactcccaccgccagccgcctgcctccgcttcttatgcccatcccaccatcccgccttcctgttgtcatttctttgaggcctggcacaacctcgcgccaaccctgaccctggctgtacccagttcacaagtccccaacagccctcccatgatttctgcttgtctctcaaggccctggaccattttccctgaacccttctagaactccctcttccttcctgctctcatggctttcctaacttctagaactttgcatcttggaccccagggttttgctgaaagcctactctgtgcccaacacagcgctgggtgctgttggtaaaccccagctcactactcaatagcatctcccacaaagacttgcaactcagggagcagagttctttgctacttgttgagctgacctgaatttaccgatgtctccttttcagtgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggtaaaagaaaaaaggaaaatggatggcaaattccctgtctttctgaatccaaatcttacgattgctaggggcctggcagttctaaaaactgacttcgtggtcaagtagctttggagtcactgactgtctccagacgtccatttttgcacatgagaaatgaggatataatactacagaagaggcatcttacccaaccaatgcaccttacttctctgtgaaacacaggggatgctgggcgcaggcctaggctgtggcctgtagcctgtaggacagctcctgccagcagccacaggaacagtgatgtgatgtaacatttcccaagtacttagctcatgccccaccctatt

SEQ ID NO: 143434 - DNA, 248 bp, Homo sapiens
tggggtgtgagtcccattgctgcctgggacactggcccagcctgctggagctggactgatccggtgatttttgcctttcttggtttatttcccatttggttttcccaggcttttagtagagcccacttgggcaatgccaacctatccacccatgcttaacggaggaatcagagatgattgaacagagaggaacaaagcaggagcattcctcccccaaccttgttctagagacaaagtgagtgctacat

SEQ ID NO: 143435 - DNA, 217 bp, Homo sapiens
gtagttggggagtgaagggatttgcttcagggcagccacgaatggatttttcatctccaatcccagccagcacattttgttctgacatttctttggcacctttgccaatgacgtgacggtgcctgtgcagctctttcccctgccttccaaattccttggagaactgtcatattccccactccccacttcctcctgccactgcaggcacctccaaaca

SEQ ID NO: 143436 - DNA, 498 bp, Homo sapiens
ggcctcttaattaccaaattttgcatttaccttcattgtatctgaactatgtgcaaaatttggcactgtaaggctatgactcgcctggtttttccctccctgggcttttctcttcatctactttcctctggtcatgcctaaatagtgctcatcctgctctcccacccagctatcttccatcccaactgttgaccactgcctctgggctcaagactctcaaattggtatgaccagccaaggcctctgctgagtgccagctgggagattcatttgctcactaggcagctcctcgtggaggtcccattggtacctcagtttcctctctcctgactaaagagacttttagtctctttcatgattaatccaatttatcacatctgaaatcttggattcattcaagaggcctctcattttttttttttttttttttttgggaaaaagaagtcccccccgggggcccagcggggagggcaggggccggggggatcctcaagagtc

SEQ ID NO: 143437 - DNA, 241 bp, Homo sapiens
ctggatgctcttagttcaattcattagtgatggcaaggtatataaagtaaaattgcttagagaaagaaaaaaatcaaatgggataatacttcaaaaaaatagagactgatcaccaaaagtctaatgaaggtttgtgaatcatgtttttcaaatggccatttgagtagcgtgactcatgcaatatcctccctccttggcctctttccacagtcagccaaaaattagtgatgaaaatcatatg

SEQ ID NO: 143438 - DNA, 503 bp, Homo sapiens
tgggaataatgctagtggtgtctctggaaagggagctgcctggggtgtgttgttggtaggagggcctggcagtggcaagacggcccctatgtactgaactcttatggccaagttcacctgcaagtttgcagagaggtttacatcgccaagctttggcctttcatttctgcaaagcccaggactctgatactttgtgtgttggagggtttattagaggtctagtagcccagatctgccgcagtggactactccaaggatatgaggacaagctaagggatccagcagtccaaagcctcttacagcctggggagtgcgagagaaacccagccgaagcatttaaaagttattagctaattgaagaggaagaagaagcaattagagctgtgtgtaaaaaccataccagccctgcttttctgattgacagaaggagccaatcactttgcattcccagtttacactttaataaaagagaaggctttagtctttctacttggaccatattg

SEQ ID NO: 143439 - DNA, 657 bp, Homo sapiens
gctggaactggcagccgccgggggccaagaggaggatccggagctgggagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgagttacttgtggaaattgttgattacccggacgtcttaaaaccaagaaacctgtgaacaggttcattaagaatctgctgtcttgaaaaatgcatattatgaatgctttgaattaagaaggtgttaacagtggttgtcatttctgccacataagagactataatctgaaacagttcctggcagttgcccagatgcctgaaactggcacgatctagtactcttgagtgatcatccttcaacgagaaatacagacctcttacagcctggggagtgcgagagaaacccagccgaagcatttaaaagttattagctaattgaagaggaagaagaagcaattagagctgtgtgtaaaaaccataccagccctgcttttctgattgacagaaggagccaatcactttgcattcccagtttacactttaataaaagagaaggctttagtctttctacttggaccatattg

SEQ ID NO: 143440 - DNA, 1011 bp, Homo sapiens
gctggaactggcagccgccgggggccaagaggaggatccggagctgggagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgagttacttgtggaaattgttgattacccggacgtcttaaaaccaagaaacctgtgaacaggttcattaagaatctgctgtcttgaaaaatgcatattatgaatgctttgaattaagaaggtgttaacagtggttgtcatttctgccacataagagactataatctgaaacagttcctggcagttgcccagatgcctgaaactggcacgatctagtactcttgagtgatcatccttcaacgagaaatacagagctacttacatactgtacctcataccgtataaatgtaatctctctgatgccatttaatgcagtggacctcttttcagaatctaattgtcagatgcagaattaacacttggaatctggagaagcattttgtacaaattgaaagattgggttttttctttagttttccacatgtattgtctcatctctgttcttgaaacatccacaatcacataaactccagttataaccatggagttatgtgactcattaaaatttaggaaaagtgttgctgagctgtggaatcaggcgtttctccctcagttcaacaactaatacatagactgctgatcaagaataaggaaccaaataaagtcatgcacgttctgttgacagaggaactctgtggctgttgaattttactgtaactagttactctgtcttcagagtcaacttaatatacaagttatgtcataatggatggaaagacctgtgttgatgtatccagactctagcaaatgaagataaaaaacccgttatgactaatccttgggaagagaaagtctgcaaaatggctcaaaccagttta

SEQ ID NO: 143441 - DNA, 459 bp, Homo sapiens
tggtcaggcttgggcccagctcgagcatctgtgtgggagtgcagcatgctccagccccgtgtgcgtggagctggaggaagccctgctgggggtctgacggagcaagtcccagctgtggaggatgactgccctcccgcctgcacagccagggctctgcccagttcccctgtatggtgtctgcactccagccccagcctgtggcaaccgtggttcaggctctgaagccattttgcaccgctgtccctgtctatcgccctccctcaccaggatgagcatgagcgcctgctaaaaagtacagggccagggactggcactgggaacgcactgccccgggtggcacagtgccttttttctgttggcgggggcagcctgatgggcagagacagagtgggggctgctcctccccatgcctgcagggcatgtggaagacccccaggaagagcggctgcctgcggcctc

SEQ ID NO: 143442 - DNA, 409 bp, Homo sapiens
taactgaaggactgacactcttgagatggctcaaagttgaatttataaaatgagttgagagctaacaacaggtttagaaaatgctttgctagaaaaaaaagatttagctagaaaacagaacaagtccgggcgtgatggctcacgcctgtaaacccagcactttgggaggccaaggcagcagatcacttgagcctaggagttcgagaccagcctggacaacatggtgaaactccttccctactaaaaatacaaaaaaaaaaaaaattagccaggcatgttggtgcacatctgtggttccagctactcaggaggctgagctgggaggatcacctgagcctgggaagttgaggctgcagtgagccgtgatcacgccaccacacagacaacagagcaagaccctgtctcagga

SEQ ID NO: 143443 - DNA, 489 bp, Homo sapiens
ttgggaggtgattaggtcatgagggtggagtcctcataaatgagattagtgccctcataaaagagggtcccagagaattcccttccctcttcccccaagtgaggacacagcaaaaagactgtcatctatgaaccagttagctaggccacaccagacattgaatctgatcaccagtctgatctcagactcccagcctccagaaccatgagaaagcaagttccattgtttataagcctccctatctatggtatttttgttacagcaacctgagtggactatgacacgtatcacagagaaaagacatactcagtcaacaattggttgtccatatggaaacatatgggacaactggttatccatatggaaaataaaataaggccaggcacagtggctcatgcctgtaattccagcattttgaaaggccaaggttgaaggattgcttgagcccaggaattcaacaccatcctgggcaacatagcaagactctgt

SEQ ID NO: 143444 - DNA, 364 bp, Homo sapiens
cacctcggggtcctgagctagctgggactacaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcag

SEQ ID NO: 143445 - DNA, 862 bp, Homo sapiens
tgggtcagagtgtcagtgctgacaccaggacagtcccaggcaaactgggatcatggagctgacctttgcatgagagagacaaccagagccaagtgacataaatggggtttcgccatgttgaccaggctggtctccagctcctgacctcgagtgatctgcctgcctcggcctcccgaggtgctgggattgcagacggagactcgctcactcagtgctcaatgttgcccaggctggagtgcagtggcatgatctcggcttgctacaacctccacctcccagccgcctgccttggccgcccaaagtgctaagattacagcctctgtccagccgccaccccgtctaggaagtgaggagcgcctctgcccggccgcccattgtctgggatgtgaggagcgcctctgcccggctgccccgtctgggaggtgaggagcgcctctgcccggccgcccatcgtctgggaggtgaggagcgcctctgcccagccgccaccctatctaggaagtgaggagcgcctctgcccggctgccccgtctgggaagtgaggagcgtctctgcctggccaccgcccatctgggaagtgaggagtgcctctgcctggccgctgtgcaatcttccaagtgtgaagtgacagcctttctgcaggtgtatccaacagctgtgaagagacagcgaccatcgagaacgggccatgatgacgatggcggttttgtcgaaaagaaaagggggaaatgtgggggaaaagaaagagagatcagattgttactgtgtctgtgtagaaagaagtagacataggagactccattttctgtactaagaaaattcttctgccttgggatgctgttaatctataaccttaccccca

SEQ ID NO: 143446 - DNA, 734 bp, Homo sapiens
tgggtcagagtgtcagtgctgacaccaggacagtcccaggcaaactgggatcatggagctgacctttgcatgagagagacaaccagagccaagtgacataagctggagtgcagtggcatgatctcggcttgctacaacctccacctcccagccgcctgccttggccgcccaaagtgctaagattacagcctctgtccagccgccaccccgtctaggaagtgaggagcgcctctgcccggccgcccattgtctgggatgtgaggagcgcctctgcccggctgccccgtctgggaggtgaggagcgcctctgcccggccgcccatcgtctgggaggtgaggagcgcctctgcccagccgccaccctatctaggaagtgaggagcgcctctgcccggctgccccgtctgggaagtgaggagcgtctctgcctggccaccgcccatctgggaagtgaggagtgcctctgcctggccgctgtgcaatcttccaagtgtgaagtgacagcctttctgcaggtgtatccaacagctgtgaagagacagcgaccatcgagaacgggccatgatgacgatggcggttttgtcgaaaagaaaagggggaaatgtgggggaaaagaaagagagatcagattgttactgtgtctgtgtagaaagaagtagacataggagactccattttctgtactaagaaaattcttctgccttgggatgctgttaatctataaccttaccccca

SEQ ID NO: 143447 - DNA, 1004 bp, Homo sapiens
tgggtcagagtgtcagtgctgacaccaggacagtcccaggcaaactgggatcatggagctgacctttgcatgagagagacaaccagagccaagtgacataagctggactgtactgccgtgatctcagctcgctgcaacctccctgcctcgggctcccgtgattctcctgcctcggcctgccgagtgcctgggtttgcaggcatgtgccgccacgcctgactggtttttgtatttttggtggagatggggtttcgccatgttgaccaggctggtctccagctcctgacctcgagtgatctgcctgcctcggcctcccgaggtgctgggattgcagacggagactcgctcactcagtgctcaatgttgcccaggctggagtgcagtggcatgatctcggcttgctacaacctccacctcccagccgcctgccttggccgcccaaagtgctaagattacagcctctgtccagccgccaccccgtctaggaagtgaggagcgcctctgcccggccgcccattgtctgggatgtgaggagcgcctctgcccggctgccccgtctgggaggtgaggagcgcctctgcccggccgcccatcgtctgggaggtgaggagcgcctctgcccagccgccaccctatctaggaagtgaggagcgcctctgcccggctgccccgtctgggaagtgaggagcgtctctgcctggccaccgcccatctgggaagtgaggagtgcctctgcctggccgctgtgcaatcttccaagtgtgaagtgacagcctttctgcaggtgtatccaacagctgtgaagagacagcgaccatcgagaacgggccatgatgacgatggcggttttgtcgaaaagaaaagggggaaatgtgggggaaaagaaagagagatcagattgttactgtgtctgtgtagaaagaagtagacataggagactccattttctgtactaagaaaattcttctgccttgggatgctgttaatctataaccttaccccca

SEQ ID NO: 143448 - DNA, 408 bp, Homo sapiens
catgtggaaacctgccatttactccatggccacaaaacacaagctaaaatctttttttatctgttcacaaattctttaatgttcctcccttcaaaagggtgaccttaattctcctccctcgaatgcaggctggacttgatggcttgcttctaataatagaagacggcagaagtaatgttctatgatttccaagatgaggttataaagaagacagttaccacctgacatgctttgctctctttcttctcacttctctctctaggattgctccctttgggagacaccagccaccattccatgagggcactcttggagaggttcaaatggaaagaatctgaggtttccactaaaagccaatactatcttgccagccatgtgagtaaatggcagggtagcgagctcgagtgt

SEQ ID NO: 143449 - DNA, 170 bp, Homo sapiens
ccttctccccaagtcacccagctcacaggtggccgcaagctctgaactggaactgtttctaacacatctggctgcttcccctagagacagacatgcaaatagcttcatatcctcttgtagctgtaaccatttgcagacaccttattgtcttacagctttttaatttgcct

SEQ ID NO: 143450 - DNA, 174 bp, Homo sapiens
tttgagaccagcctgggcaatacagtgagaccctgtctctaaaaaataataataatttacacacacacacacacacacacgtaaatttcagacaagtcagtcacggagagtcaagaccaggagctacctaattagatgatggggaataagaaataggaaactgtgactagtctt

SEQ ID NO: 143451 - DNA, 209 bp, Homo sapiens
tgtcagattaaataatttgctcaacatactacagctggtaagtggaacccaagcttgatcccagtttatattctttccaacctatcatactgcctatcaaagaaagcattagtagcaggttctcttgacattgacgtgaatgctttttttttttttttgagacggagttgcactctgtcacccaggctggagtgcaatggcacgatctc

SEQ ID NO: 143452 - DNA, 441 bp, Homo sapiens
aatgggatttaaaggtaggaactatcttgagaaagctaagtgttacaaagtataattagtccaatccagtgtttcccaaacttacctaagcttaagaatttcctcagggcacttattaaaaatatagattctcaggcaccacccggacttactgaatcagctctccaggggaggggcctgggagcctagtgaggtaggtagggtgatgacacaccctgcattttctgagcctgtcctggtttcaggtaccctgcatgatgaattccagatgtctgtttatacttgtcagactgtgtctcaattttcagacaggagctatgggcactgtttatgtaggccatctcattcagaatcctctctcatatcgatgcaggtagaacatgcttataaaacacgagaggatgtgtagccacaaagttgcatagtgtcagtcagcgtaaa

SEQ ID NO: 143453 - DNA, 269 bp, Homo sapiens
atagcaatatcttctactgtcagtgctggccagaaggggacagagaactggcactgcctccatcagcacattcagtattgccgtggtacacggagtgtcctgtgggccctcccgagggtcgctgttagctggttggttttctgatgtaacacatagcacatagacgtgtttagcaggcccgattctctgagccttcagatcccttctgtcatggtctgtcatagcagttctggcatctctacttcatttaatgtgggccatcatttttt

SEQ ID NO: 143454 - DNA, 216 bp, Homo sapiens
ctggcctaggacagaccctagggggtaggctggggccctgtaccgaagcaaggggttttcaaggctgccacccggggctcatggcccttggcctctctgggagggaggagccccggccatccccaccctcgtggatgtaactggttttcttccctctctctccctcccctcctctctgcgtctttccctctctcctgtgtttgcctctctgtcctg

SEQ ID NO: 143455 - DNA, 190 bp, Homo sapiens
cattagctcggtacccagcagcatctaaggctcgtggccataaatccatagttcttcatcacatcccctcctttcgtccccatcatagctcccttggtttaggccccattaacttgtcattaggtctggaataactctagatgggcctcagcttcatccaagatgctgaattccccttccaaagtagcta

SEQ ID NO: 143456 - DNA, 746 bp, Homo sapiens
tttcagagtcaacgtgtagaaaatatgtttttgttttattattattcttttgcttggtttttgttttgttttctattatttttaaaattgtggtgtaatatatataacataaaattaatcatttaaacaatttttagggatgggcatggtggctcacacctgtagtcccagcactttgggaggccaaggagggcaggttgtttgagcctggtctcgaactcctggcctcaagggatctgcccgttttggactcttacagtgctgggattacaagcaagagccactgtgcccagcctaactttctttttctttttttctttttttgacagcctgggcaacagagtgagatcttgtcttaaaattttttttaagtgtacagttcattggcattaagtacattcacagtgctttgcaatcatcaccactatccatttccagaaatttttcatctcaaacagaaactctgtatccattaaacaataactcccagttctttccttctcccagcccctggtgacctgtattatctttgtaaagaatgcctatttgagccatttcaccatttagaattgggtttttgagggggatgggaattgttgagttggagttctttatttactttggatattaattacttatcagatatgttatttgcaatattttctctcattccatgtttgcattatagagtgtctgattagccggtcatgctgcgataaaaaaatacccaaatgggaattttaagg

SEQ ID NO: 143457 - DNA, 113 bp, Homo sapiens
tggaatttgtacattcacatcagggttgctctttgaaacatttctgtgggatgttgttggcttattccaagtttgctgctattacccaaaacattgtttgaactttgcttctg

SEQ ID NO: 143458 - DNA, 346 bp, Homo sapiens
ctaaagctgtcatgatggctgtgatcgatgactgctacacgctcagcccgggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggcacaaccgggagagatttattctaggtaatgcaaggctagttaacattcaaaacttaattaatgtgatctattatggaactttcccaacttgatcaagagcatctt

SEQ ID NO: 143459 - DNA, 437 bp, Homo sapiens
agtctccaaatgctcccttactgagtcaaagcgtttgccccgtaaattcatgtctatctagaacctgtgaatgtgatattgtttggaactagggcctttgcagatgtcactgagttaagacgacctcatgctggattggggaggccctaatcttgaaagatgtcctcttaagaaaagcgaaaagagacagacacacaagggttagaacgccacgtgaagatggaggccaagattggagtgatgtggccgcaagccaaggaatgtccttgaagttgggagaggcaggaaagaccctcccctagagcctttgggtgggggtgggcagccctgccaacacctggaattcagacttctggcctccagaactgtgagagtagaaacttccattgtttaagccacccactttatgatgtcacggcacagcagccaggggaaat

SEQ ID NO: 143460 - DNA, 551 bp, Homo sapiens
aaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggtccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggtgccatgtttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgcta

SEQ ID NO: 143461 - DNA, 647 bp, Homo sapiens
aaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggtccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgtttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgcta

SEQ ID NO: 143462 - DNA, 547 bp, Homo sapiens
cttgaacaacgctatatttagcattggttaagtacagatattttgtttttagcctattgcagaattagctcaataattcataaaatgggtaattattcataccaatgctaaactcagtatttattacatcaaaatttttaatgtattggctaattttggtaaagctaagaccaccagtgtgaataaggatggatttttggttatttgccactgagattttttagcatagatcccagaattattttaggaaaaagaatatgctgtgctagcacatagtgggtgcctattaactggtagttactattattatgcccttggtactaattttcctaaattaactatatatcataaatatgctgagacagttaatctttgattttaattatgtccactgcatagatttggttaggaaaactatttctcatgactgctgttgcatttttattaagcagaatttgatgcaacagatttgagcatatgtggacttctactgaactaggtgtataatcaaacaagtgtgaaagaggaactcaagccgaagtaagag

SEQ ID NO: 143463 - DNA, 779 bp, Homo sapiens
gaggtctcttatgaatgtgagtgaagcccctaaggtgatgagagccttaccagcctctcttactttcccagaagctttcatttacttatttgttcagtcaaaagggtatttattaaatacattcgggccacaatgtctaggaatggcacagaaatcagaccagggtcccgcccattgggactcacagtccccacggggacatgagccttttcaagtgcaaggcagagaatgatttgagcccctgaaagactctttgattaggaagcatttgggataggaaggtgtcagttccggctttgaagacgtgggggcagggatcatcttggaacgttttgtttgaaggagggactttggactggtacattcgatttggaccatagtgggcaaagaaccaacgtattgagcactcactgtgtgacaggtgtcacaatatgtcaagtaatttttatcacaccctttgagatagtttctctaatcccagttttacagatggggattagagagattaaatgccctgcccaaggtcacacagccagtatgtagtaaagtggagtttccagttctggcctgtttgaccacaagcttgtcctctttactattataccactttgcattccagacagagggaacagagagaatggatgccctgggcagatgtgggcacatccaggagctttatttactcagggagcagggtacatgaacaggagtagtgaccaatacggttggaaaggcaatttggagcctcaaaagtcaggttgaagaatttgggcttcatt

SEQ ID NO: 143464 - DNA, 350 bp, Homo sapiens
aattcaactggcaatataaataatgaacctgggacacagctggaggaacaagggattggggggcaggagaagtgtattttagtcttggctctagcacttgttttatgttcctgagaaagtcccttaatctctcctggtctcaatttctggatctgaaaaataaacggattgagcaaagtactcaataaggtcccttccagttctaggatattaattgtatatctgggtttgtcatttatgtcacctaagcatgcctagattcaattgtcctagactcattaggtttaatgtctaatcttgctgctggttctactttgcctctttttgccagggaatgtttattgtgtagg

SEQ ID NO: 143465 - DNA, 380 bp, Homo sapiens
tttaattctctttcgtgtttgtaataatgctggtagattttggttaatttttttgggacaaggcaattttaaacagtccctagttgttaccatatgttttttgccttttaaagagtgaaactatcagccgggcgcggtggctcatgtctgtagtcccggcactttggtaggccggggcgggcagatcacagggtcgggagatcgagaccagcttggccagcatggtgaagccctgtctctactaaaaatacaaaaaattggctgggcatggtggcgggcgcctgtggtcttagctgcttggaggctgaggcaagagaatggtgtgaacccgggaggtggagcttgcagtgagccaatattgtgccactgcactcccacct

SEQ ID NO: 143466 - DNA, 209 bp, Homo sapiens
aaaggcgcttgttggcatctttgaagaagggactgggggagccctacttcagagccagtcagtggggagcagctacatccttcaaaaggaatagcaggtggtgtcccccagcctggctgacctgaaggtgtagtagagagcacaaggggtgcagtcctggaactggggcctaacgagaggtatttgtggttccccaacaaaagccctgt

SEQ ID NO: 143467 - DNA, 393 bp, Homo sapiens
tttaggagttcaagaagaagggggagatgtaatgaggtaatcaagaccaagtcaatgtgaaacagtctgaagtcccaaagctgggctatacttatgggccccaaggtgagtacagatggctcctaatctgaagattctccactgtgctattacatgtaatcccaaaccaaacttataagaatactggccttccctggcatttgagttttattctgcctctttaaaagggctactcagaataaatcagtctcctttgcagagtcaggagaagggaaaccagcctctctgtgcagtgttagcatgatgagctaagagttcagaaatgactgtaaatgaaaaatggtgataatgatagcagctatcatttactgaatgcttcccacgggccagctg

SEQ ID NO: 143468 - DNA, 394 bp, Homo sapiens
acttccacctcccaggttcaagccattctcctgcctcagcctcccgagtagctgggattacagtcatgcgccaccacgcccagcgaattttttgtatttagtagagacagggtttcaccatgttagtcaggctgacctcaggtgatccacccgcctcagcctcccaaagtgctaggagtacagtcgtgcaccaccatgcccagccagtcttttttttttttttaaccttatatagctgtagattccaacttccacaggcatgaaaaatacttatatatgtacatatatacagacatacctacctgactccaaatatggggatcaagtaaaacattaaccaacatttttagttcaaggtggcctgttaatccaggaaatagattacaattaaaat

SEQ ID NO: 143469 - DNA, 756 bp, Homo sapiens
ttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagacctctgttctcccaaaatattaaaaaaaaaaaaaaaaaacccgaggtgttggtgtgggcccctgctctgtatcctcccacagtctaatctccaggaggctgggggtgggaaggatcgtttggaccctgggaaggttggaggtctaacagtggagcccttagggttggcacaatttgcatctcccagcttctggggcaacagatgtgagacccctttcttttaaaatataattgggtcccacttctatcttcatggccccattcttttaagaacacaagcgtacacttgctctttttggtaagacccctttaattttaccgtcccaaagacccaccaatctttatacccttatataactggttagaatttgcgcctgtgcttttaacggtttgtctcttagcctcagaaggtccaattatttccccgatgaatcgcacgcggtgtttacatcccaccgcgcgtgggaacgctctctaacagatacgggggg

SEQ ID NO: 143470 - DNA, 266 bp, Homo sapiens
cggcttgattctatgaaggcgtctatttgatggaacgtactggaacagttcatagccagcccagcaaaccttgtgtggagacagagcttgctttttctctttccttttcctgtttgcagtgagaatgaggcctttctctccccggccctttgctctccccacagttgtctcacgaggtcacttcctgctgacaggctcctttcagtgcaaggtttggatggaaacaatactccgttttctgggggactggtgaggctctgggcctc

SEQ ID NO: 143471 - DNA, 326 bp, Homo sapiens
aaccattgtcctaaaccaatatattctttcctatggttgatttccactacaatttccactgtggttgaaagttatttcttattattgcttctccttggtatgaaaatgcaaatacacagtatgcatatttattttagaaagtaagcttgagggcaggacccatgcctatttctattctgtttatcaagcaacagaaagggctgcacataaacgcatggacttaggaaggggaacaatacacatcagggcctgttgggttggtggtgggtgaggggagggagagcatcaggacaaatagctaatgcattaggtgatgggttgatagg

SEQ ID NO: 143472 - DNA, 347 bp, Homo sapiens
  misc_feature (201)..(201): n is a, c, g, or t
  misc_feature (302)..(302): n is a, c, g, or t
  misc_feature (320)..(320): n is a, c, g, or t
aaaaggatgagttataaaataaaaaatttattaaattggagttcatcaaaagacagtgtcttcaaaagtcatcattaagaaaatgagaaggcaagctctagactggtagaaaatgtttgcaaaatatatgtccaacaaagaacttatatctagaatatatgaaagaattcttacaactcagtaataagaaggcaacccaanttaaaaaatgggtaaaagatttgaacagacacttcactaaagaacatattcagatggcaaatacatacgtaaaaaattgctcaacatcattagttagaccnccagtggaaggcttggtncagtgggttcacggctgtaatcccagc

SEQ ID NO: 143473 - DNA, 340 bp, Homo sapiens
aaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccagggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctc

SEQ ID NO: 143474 - DNA, 437 bp, Homo sapiens
gccggtgggggtggtggagggagagagagcatcaggaagaatagctaatggatgctgggcttaatacctaggtgatgggttgttatgtgcagcaaaccaccatggcacacatttacctatgtaacaaacctgcacatcctgtacatgtaccctggaacttaaaagttgaagaaaaaaataaaataatctgttccagattcttgtcccagaacaatcctgagcttcctactgtacaggatctatcttccaccctttgtagaataagaaaccatttgcctgctttgaatcatctgatctcttcgaagcaaatcctcaaacatcactggtggcagcttactgtcctcattatcaagctcaatgaggatgtaatccatctgggccaggggatgtgaacacagaatagccttgacacatctggagctgtagctatttcctat

SEQ ID NO: 143475 - DNA, 576 bp, Homo sapiens
tgtattccaggggttcatgcgtgaggtagctatgatcaactgcagtcgttctcatggatttttatcctttaaaaatggttatgggccgggtgtggtggctcatgcctgtaatcccagcactttgagaggctgaggcgggcagatcacctgaggtcaggagttcgagaccagcctggtcaacatggtgaaaccctgtctctattaaaaatacaaaaattagctcgggaggctgaggtaggagaatggatcacctgaggtcagttcaagactagcctggccaaaatggcgaaaccccatctacactaaaaatacaaaagttagtcgggcttggtggcaggcacctatagtcccagctactcgggagggtgaggcaggaggatcgcgtgaacccgggaggcggagcttgcagtgagccgagatcagggcactgcactccagcctgggagacagagcgagactccgtctcaaaaaaaaaaaaaaaaaaacaggagtgaaaagttgagatgaccatgtgaagccagccaacctgaacaaaatgtaacttttgaatgataaggcacgcagaacgcgcctaat

SEQ ID NO: 143476 - DNA, 422 bp, Homo sapiens
caacagcatatggttataaagtatttgaaaatcatactctttatttgtagcagaataattgacaccactgacttcaaaactcattgttttatatgtggatcactctgaaataacatttcattttctttcttcagaaaaatgatgttccaaagagaagttcagtttaaaaatttatatgaagagatttctgatgaagcaaaaacatacatatactacattaaaaaatataaaaagatatcctacatatacaagattaataaggtttcatgaaagtaacaggcctgaagaaactttgaaatctctgcaaactttcccgtcatttacggaaaacataaaacctgaatttactatctgcccctttcaactttattctatttttctaaagcatcctcaaaataaaaggtagacattttggagtgagg

SEQ ID NO: 143477 - DNA, 371 bp, Homo sapiens
cagcatgaaagtccctaacttggcattaacagcacaaaatggatagtaacccaggagagcatgctggatgacatgacccaaatcaaaagatgatgctttccttggaaagataaaatggaaaaaccagccaactaaccaataaaggattgcattttttctcaattctgagataaacaaaacaaagatataaataagcagataagctgattaataagatttacatccactcaacttatacctcaatttgtaacttcaacatttttttatacataagaaagtatgccttggtcgaagtactgacagctttggtttaaagtaacactggcagaatgaaaacactctccagatttttctcctgttgggacaaagat

SEQ ID NO: 143478 - DNA, 379 bp, Homo sapiens
tggtaaatattcctagtgataacctgaacatagccaagagtttctgccttaatcaggggaaaatacaggcttaagataggagctgggcaaaattgttagaccagttaatggatttgtttccctactttgcatctcattttgtggaagtgattttcagtgtcaattgtttgtttagacacagagtttggccctgttgcccaggctggaatggatcacagctcgttgcaacctccacctcctgggttcaagccatcctcccacctcagctacttgggaggctgaggcaggagaattgcttgaacccaggaggcagaggttgcagtgagccaagatctcaacgtcacactctagcctgggtgacagagtaagactctgtctc

SEQ ID NO: 143479 - DNA, 523 bp, Homo sapiens
acacataaatatcagacccatggcatttcaggctccgggtttgtgggagtagaggggcgggtttgtgatgatgaagcgcctcagctctgagaggatgcagcctgggcctctagaccagaaggcttcactaccctagaaccagagtggacatgcccacgtttcatgcacttcccaggagttgacagatcaagtaggccaagaattaatatggatatgaaaggtttgaaatacagttaacaggcttggtttgagagctgggaactttgcactcaggaattaaagaacatcctttccttccaagaacacagaaacatatgccaggccacagaaagatttccacaaatctcaaagaaccgttttcaaggaaccctcattctgtcaaggagccctcattctgtcaccatggagcgattgtattagataacaacacttggccagacatggcgacccacacctgtaatcccagcactttgggaggccgaggcaggaggatcgcttgagcccaggagttccagaccaacct

SEQ ID NO: 143480 - DNA, 239 bp, Homo sapiens
gcctaaggcatgtactggctgtcttccacttccaccatcttctactccccataataaaccagacggccctccttaatttcccaggtccacccagcgtcagagcacctcaccacggccttcaaggcccggcccacttcagccgcaagtgcgctacgtgcatgtgaaggagcatacacgttccatgctcccgctccaaccacctggcctcctttcaattcctcagacccagcacgcctgcc

SEQ ID NO: 143481 - DNA, 388 bp, Homo sapiens
atcccagaaaaggggacactcagctcagtttcctaacctacccacaatcaccagctgtctggtcttgtcagctgcaggctactgagtgggtaagaagcatggcgagtgtgttagagaaatgaatgaacttaaagcacttttttggtcttggattgctctggagaaaagtctgagagggcagcagtaaagttctaccaagaagtctgtaggatcatcttcagatttggactttggccacagccctttctccacaataaaaaaaaaagaagtcaagggctgggcatggtggctcacgcctataatcccagcactttgggaggccaaggcaggcaaatcacctgaggtcaggagttcaagaccagcccggccaacatgttgaagccctgtc

SEQ ID NO: 143482 - DNA, 297 bp, Homo sapiens
gagagatagggttaatttgtacaaaggagtcatggttgctcttagtttctaaagtcaatactaagatgtgttcaactatagttcaatttaccgtggagaattcctctaattgcccatgcactatggtatttaggacacactaggcttgtccgaaccagcaacatcactctcagttctcagttaagtccattaaagtcagttttcccaacccatgaaatacttggctggttctgaaaacccaagctgacatgctagtatgtgattaggggcctcaatccctcccagtgtggagggatc

SEQ ID NO: 143483 - DNA, 458 bp, Homo sapiens
ctgcgcttccaccggaaacctgtatactttgagtacgggaaaactctagcgctattcggacaaagaaaagtatatttatgtatatgagggggaacactcactgtatggtcatgtgctgagtcaagaactcctgatctgtagtgatctgcctgcttcggcctcccagagtgctgggattacaggcatgagccaccatgcccggcccaaagatgattttttaaatgctcaacaggacaaagcctaatggtagtcttttgttaaaaacaaaatttaatatcaatccattgacaggactctttgtgtactgagctatatagtaatttcaccttaatagaagttcttcataaccaccccatataaaaccatccattcttatctcttttttttttctccatactgcttatcacagctgacactttatactgactttgtttccccctctataccctttactccag

SEQ ID NO: 143484 - DNA, 341 bp, Homo sapiens
agtcatcgtcatagctgactcttgagggtgcaccctctgcctcccaggtccaagcagttctcctgcctcagctggctacaatattgcaaaggttttacagggaccaagtttcttctctttgagctagaattatatcagttccagggggtaattaacataggtgctctcctgctgatcagagctctttgattaatacagaatggaaaaaattagtacttaataaatgcagtctattatgtagacagaatccttcagaacttggagttcaaagggaaagaagtagaaaaattaggccagttgtattttctacaccattttatgaagtagtaacagatctagag

SEQ ID NO: 143485 - DNA, 567 bp, Homo sapiens
aaatgatttcttacatcttttatccttggtcactttaaatctttacaccttattgtaatcgatttacattagaagcagcatacttgatggtctcagtgaagtctgtgtggtggtgttcttttagtggagcctagcaaaaaaagaatttccttgatttcctgatctttgggattctagtcatatggaccacatttggaataagcacatagttgaatataaaatgacaaaatgaaacataaccatattcttaaagttctcattgaattgttctaccatagttgaagtgtttggtcagtatggccaagtgtttgtttgtttttgagacggagtttcgctcttgtcaccctggctggagtgcagtggcacgatctcggcttactgcaacctatgcctccctggttccagcgattctccttcctcagaccccggagtagctgagagtacaggcgcccctccaccacgcctggctaatttttctattttgtgtattttaagtagagacggggcttcacctgttagccaggatggtctcaatctcctgacctcgtgattctgcgcgctcggcct

SEQ ID NO: 143486 - DNA, 632 bp, Homo sapiens
ctggagagcatgactacttctgtccagggttcctccagaaaaaatttattaacagaatgatggttaacagttgctgtctgcttacactacaaatgtccaaagagtggggggctcccagcccttgggggaggcagacaggacgagccagcacttccaatcccaccaggacatggcagggggccggctctgcgccaagcccacaggactggaccaaggctcgtcccactcatcagagggacaggaccagcccacagtcctgtgcaccccgggccaagcctctcctcccccactgccacgttctcaggttaatgacaagcgaataaaagggaagatcctactcgctgacatccccaaccacacgcccacctctcagaactaacagctgccctggtcaaggctgacaggaagaagtgcatgttggggacatggcagacaccccaaaaatggccgggcaggcggacgaggcacccccaggagtgaccagatgccacccccagtgcgtgtccctcccagagctctgcagaggacgcctgtatggaagcaggtgctcaaagatgggcaacagaatcacagagagcaaaaggcgtctgcggagccgacagccccaaccaggagccaaacccagaccccag

SEQ ID NO: 143487 - DNA, 151 bp, Homo sapiens
cgctgctactgctaccactccagggctgcttcgcggagccactgtctttgggctttagctcccaccactccttcccagcaggcgtgggttcttagacttcagtggaccacctttaactggaaagcgtgcttccttcccaacagaacaagcg

SEQ ID NO: 143488 - DNA, 243 bp, Homo sapiens
aggaaggcaggagcagggcttgcttcaccaacacagcggagaggagagaaggcaggtggagaatgggccaaggcgattggaaaatcaagtgaactgaagttcaaggcagtcctaacgtggagaatataatactatttggacttgatctaggagacctcaagggaaatgggtgatttctaaagacaaggtttcccacattaccaccattcatagactcctacacaatttttgtaatattcaagt

SEQ ID NO: 143489 - DNA, 710 bp, Homo sapiens
taaacatttcacttttttttgtctttttgcctaagcacaaatttctgtaagtctaacaaaacaattgtagtaactcccttaaaattacactctcttgataccaatttgtccaatttggtatcctttttgtacactaaagtcttaaatctaaataaactctaaattgtaggagcataattcttttagttgaggtaataaagttctttatctccattgcctcaattttaattcctgtttggaaagttgagctcactttatttgccagggtatctggaatgcagtatttgcgtggtggtaggatcttgggaacaggggaattgcttctgattagttgtgtgactgaaaatactgatcacttctttggaaattgaagagggtgcactagatctttattgaaccgaatgtattcagtgtctcagtgctaacactcgtccaggccctcaagaagcagaagtggactggaatataccagcagttctcagtctccttagactcactttacactctgaaaaatgtgttcatactcaaagagctgtttttcacgttatgattatatttatcattaatttaccaaactagaagataaagtaaatacacctattaaaaataaaaaattacatataaatatttttataaaaacaacttttcccaagccaaaaatgattagtgataaaggtgacattgttttacattcttgcaaatctcttcaa

SEQ ID NO: 143490 - DNA, 137 bp, Homo sapiens
atggacgtgtaaataaatgatggtaattcagttttagttctgtaataaaggcatgtacaggctactgtgaaagagcagagaaagcttcacagatgattgacctggcaaccacatgtcagcagttattattatagttg

SEQ ID NO: 143491 - DNA, 335 bp, Homo sapiens
cttctcttctcactcagacccctctaatccaggccatcatggcatgggaggagacatgctgatcttgccttctccaagccatcctgcagactgctctagagttctctttctaagtgcaggtctgaacttgtcactgcctgcctaaacctctgagagttcctattatgcagaaattgatctgttattctgctgtgaacttttaattcactactaaatagcgtgagctaatacatataaagtgcctaactcaacatctaaggagatgctcaaaaaatgtcatttatgctattatcactgaaggctccttcaagccttgcaaagttgatatgtagatg

SEQ ID NO: 143492 - DNA, 398 bp, Homo sapiens
ttatctatccccagaaaggccggcttttccttgcaaccacctcacctcgaaggtcagttagtagtactgtgacctcatcctactcgacactaaaatgccaaggaaaacaaatatagctacaaatcagaggaaaagctggttgctctggggccagttcaaagcactcagcagtgcactaggccctgtggttaacactgtcacttttgaccctcatgaccgacgtgaagtgggagttagtaatgattagaaagaaaagggggtgggaaatgagaaaaattaaagcaaagccctgaacaatgacaaaatgtctctgcaatgcacctctgagagggataaggtaagcgaaagcaggccagtgctttagaactgcatttctgtcctacaagtgtaggtgatgt

SEQ ID NO: 143493 - DNA, 202 bp, Homo sapiens
atgtagcaagaccttgtctctacgaaaaaatattttttaaattagctgggtgtggcaatgtgcatctatagttctatctacttaggaggcaatgtgggaggattgcttaagctcaggaatttgaacgctgcagtgagctatgatcacactactgcattccagcctgggtgatggaggaggaggggaaggggaagggggaggg

SEQ ID NO: 143494 - DNA, 594 bp, Homo sapiens
aatatttcagtcctatgggtgaccacttaaaattccaaccaaaacaaacaaaactgcatatctataatttactgagtataactctacctttcagccatattagtttatatttagaagtggtccgaattatgttaatcttagtagtttgttgatataatgccactattacagattttctttatagattgtttaaaaaattttttcttattatcatgtgaaacaaaatgatgttattttagcagctgaactactatgtaaccatgactaaaaatttagtaggtgataggcaacggtgttggttaatttcttctgaataaaagacatgctatataatatttttacagtaatattctaatagtgtattactatatgatgccagaagatcagaatcaaatatcattaatgatgagcaactacttattttttatctaattttattaacgcgtttctgctgttaaagagtacttcaaatatatatgtaaagctcagaaaataatataaccccatgtatttcactcagattgaacaagtattgatattttgccatatttgcttcagattgctagaataaaatacagatgtaacctttttttt

SEQ ID NO: 143495 - DNA, 345 bp, Homo sapiens
gacaggtggcccacagggattgcagcctctgtgctggaacgtgttttatatctcgatcgggcgggtgagaggttcactcccactgaacctggcgtgccatagagctgccagcctgggtcaggggtagccaccaccatgccccatcctgagctgctatgaagcgtgcgtgcctggctccaaatcctcccgatctctcattcaggcttctgccatgtgttagagaagtgagtggctcagaaactggccaagagaggcaggaaggtggtgggaggtggtaacacgtgtcagccaaggctccacgccccctggcatgtgctccagttgtccccttggactcacttacaa

SEQ ID NO: 143496 - DNA, 286 bp, Homo sapiens
aatctgaggtataggagattctgagatatttattttttcccagagatgtttttatctgtcttttgtgccttgtgactttgataaggttggaaataacttgcgcggggattggtttgagaagtccattgtctcagagatctgcctcattcaaaccagttgatactctcttttacctagagtagtcctgttttcatatttgaatgatgggatggtggggggaagaaataccacggagtttgacaaattatagataggcgcagaggctaacactaaatcctattttgag

SEQ ID NO: 143497 - DNA, 443 bp, Homo sapiens
cccaacaccgtctgtggaaaaattgtcttccctgaaactgatctctggtgccaaaactaggttggggacagatgtagtaatatgtacataacaaaatatgtattaatcaattgtttgttactggtacggcttctggtcaagagtaggttaccagtaagtagttaaggtttgggaggactgaaagtgatgcgtgaattttcgaccacgtgagaggctggtgcccctaacttccacgttactcaagggtcaagtatataaagaacaatctagggccgggcgcagtggctaatgcctgtaatcccagcactttaggaggcggaagcgagtggatcacccgaggtcaggagttcgagaccagcctggccaacatggtgaaaccccatctctactaaaaatacaaaaattagccagaaatggtggcacacacctgtaatcccagctac

SEQ ID NO: 143498 - DNA, 393 bp, Homo sapiens
ccatttttcttactacatgctgggacagtgccagagtcctagaactcagagatggatgtggtgtttgtacccttgaatgattctttgaatgccaggctagtgatttggaccttgttgacaagtttttaaaaggggctgcatataatctcttgaagccagacattgaagcagaagctcccccgactcccgctgtgccttccctccttctttcccttatttgtggtaatgggatcactgttctcccaggtacccagtctcaagggtctttttgcagtgttcctgtggtcttctgtgtgacaaagaccatcagtggcaattttctgccctaatccctgccaacctcactcatcaccagcatggctgctggaccatccttactgggcactctctgtg

SEQ ID NO: 143499 - DNA, 471 bp, Homo sapiens
agctcggttccctcgaagcctgcagaaggccattcagactggtgggcacagagagggcaccaggtgggaatatgcaaggcacagcacgctggccacagtgcacaggttttaatatcttgctggaattacttgatgagctaaaatgaaaggagttttgaagacctccttatgttccactaggtccagggtaaatgtgcacatggcatcacatgctactctgagtaccagatgacgctgtcccctgagcctgacattcctgcagatgactgggagtgtgagatgagcatccaagaaagaagcacatgtctgctttaggtcagagtgctggctaatcagacacctaagggatctgcaaagaggaagtgcaggttcccaggagaggccactggaaagccaggctgtgaaggggcaatgacagcccagtccaccctatgtgacaaagaacttctgacacttgcatcttgttctcac

SEQ ID NO: 143500 - DNA, 423 bp, Homo sapiens
agctcggttccctcgaagcctgcagaaggccattcagactggtgggcacagagagggcaccaggtgggaatatgcaaggcacagcacgctggccacagtgcacaggttttaatatcttgctggaattacttgatgagctaaaatgaaaggagttttgaagacctccttatgttccactaggtccagggtaaatgtgcacatggcatcacatgctactctgagtaccagatgacgctgtcccctgagcctgacattcctgcagatgactgggagtgtgagatgagcatccaagaaagaagcacagaccaggctttagccacatgcaaagacggcgaatcacggacaggacaagggacaagcaagaaaaggaagcgacaggcgactcaagacgagacccacccagaagccagactatcatgcgcg

SEQ ID NO: 143501 - DNA, 403 bp, Homo sapiens
taccaccatgttgtttatctgttcaccagttgatggacatttgagttgcttccagtttggggctattattagtaatgctgccaataccttttgggcatataattttgtgagtacgtgttttcttttctttttttattttttgagatggagtctcactcttttgcccagctgggattgcaccactgtactccagcctgggcaacagagggagactctgtctcaaaaataaataataaataaaaacttcattctagtggatgtatcttgatacctcgttgtggtcctaatttgcatttctctaatgagtagtgatgctataaaattaaatacaattaagaatttaaaaacatgtaaaaagaacatgtatgcagtaaaaccatgtaagaaggaaagaatggttctc

SEQ ID NO: 143502 - DNA, 451 bp, Homo sapiens
aagaacgttcagaatagctttattcataacagcaaaaaactagaaacaacaaaatggtcagaaacagaagaatgggccagacgtcgtggctcactcctgtaatcccagcactttgggaggccaaggtggatggatcccttgaggtcagaagtttgaaacaagcctggccaacatggcaaaaccctgtctctacttaaaacagtacaaaaattagccatgcatggtggcaggcacctataatcccagctacttgggatattgaggcacgagaatcacttgaacccaggggggtagaggttgcggtgagccgagattgcgccactgcactctagcctgtgcaacagagtgagcctctgtctcaaaaaaaggaaaagaaatggaagaatggataaatcagttgtggtatgtgcgtataccacatgttgtggactgtttgtagttccccaaaatt

SEQ ID NO: 143503 - DNA, 561 bp, Homo sapiens
tttagcctccctcctggctcccctctctggcacctatgtctacttttcttctccatatctggcacctttccttccaggccttgatttccacttccctgttgtatttggagtaatttagctctttcttagttcttccaatcccttcctccccattgcccaccagccaatcaaaggatgtaaaaggagtaggagagtagttaataactctattctgttacatgcacttaggtatacttgttcagcaactgttgcccctaccatttgtaagtttcatgacactcacatgacctcatgaatgttttattcaccactgtacacccagcacccagcacggtgcctgacacatagtaggggttcaataaatattggcggaataaatgcatatcatggttctctaaggcaactcattttttaatttcaatttaaacatctgggtccctggatatgcaatcctgggtacccatatacccaggtagaaggtcaccatagactgtgaacacattgcctgaccttcttaatatccaaatacatgcattagcatccagaattctccaccacatt

SEQ ID NO: 143504 - DNA, 299 bp, Homo sapiens
ccgccttggtctcgcaaactgctgggattgcagggttgggccaccatgcctggcctgttctatttcattattgctattaatcttttattgtgtctaatttataaattaaaattacaggtaaaatcatagtatatatagggtttggtactattcgtggcttcagggggttttggaatgtatcccccttgtataagagggactactgtactatggatttagaagttggtcatcagtcttctcagagggtctgtaattaggatttcttagtttaagtatggctgtataaaccttttccaaag

SEQ ID NO: 143505 - DNA, 241 bp, Homo sapiens
ccttccttacttgcagccaccatgatggtgcaggctccagcccctccctggcatttcctgccatggacccggcccaaccatctccgcagggtgcactccttcgtcggtgtgaatatggtgtttagagaccccaatctggtcaccaggggtggtgcttgctcctgggatttcgttactgctagggctttggaagagacagagccaggaaataagtatttttttttaaccagtaaaaaaaaaa

SEQ ID NO: 143506 - DNA, 378 bp, Homo sapiens
gctggtggagtagagtagattttcatcgtgtccctacttccctgtgggatacacgcctgttggctggaatggtgggtggaatcactcatgttgtctaagatcttgttctctgtctcttttttgtccagcactgcgtggctgaattcacacaggtgaaaggtgtgctcgctattatgggctgaattgtgtccccctacccaaattcgtatgttgaagccctaacccccaatacctccaactgtgactgtacttggaaatggggcctttaaagaggtggttaaggttaaaatggatcattaaggtgggctgagtttggatgtatgtccccacccaagtctcatgttgaaatgtgatccattttaaccttaacccgagcgc

SEQ ID NO: 143507 - DNA, 426 bp, Homo sapiens
aggaagggaagaggagggtgggaccaggccataatggccctggatacccaattgaacagctgggggcttggccggcagccaacattgagccctgagggcagggggcagactctggcaccaggagtggaagcaagggacctggaggaaggcttgtacccaagggctaagttacatttttcccgagagaggaatgctacacgccaaaccctggctcttcctcacccccagcagcccaccctactccacctgtcttagaactgacattccctcgagggtctcacaactgggggggcaccaagtcagggacagtttctgcttggtagtctcaactgagaggagaggagctatttcctacccatacactccccacataactgacaacggcttccacaccccaccccatgcagcactggcgagggcatacgt

SEQ ID NO: 143508 - DNA, 394 bp, Homo sapiens
ttgagttgtaaaatgagaagagcactacctaccccatagaattgtgagattcaaattagattaaatgttgataacttaaaaataaaacatacaaggagtgctgagaaagtaggcacaaggttaacatatggctggggaaattttggataaccgttttgaagtctgtccatctatctatttggggtgtcatctatctgtatcaaggactattgaaatatacatggccaggcgcagtggctcacgcctgtaatcccagcactttgggaggcagaggcgggcagatcatgaggtcaggagatcgagacaatcctggctaacacagtgaaaccctgtctctactaaaaatacaaaaaattagccgggcgtggtggcgggcgcctgtagtcccagctac

SEQ ID NO: 143509 - DNA, 466 bp, Homo sapiens
cgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaacta

SEQ ID NO: 143510 - DNA, 438 bp, Homo sapiens
gggaattactgtttcccatctgctactccatttactagcaatgaggtttctgtttccaaacagaaacagccttctctccccctagactaatttcataaattccatgagctttccacaaagtgggaaaccagtcattcgacagtagtaacatatttcaaattaggagctacctctcttttcaaagatattttcaatagagaccccgaatactgccaaaagagttgaaatgagacaacagaaaacgccaactctaaggctcagaaatttcctaacagactttattttcagtcaaaatctgtggcttcttttgatggggaaaaaatgtctttccccatgactggtaaacaatcccagatataaaactgtccaaagtaacataaaccgaagtctgcacagctccattaacaagcacggcccatgccagagtggatccacgca

SEQ ID NO: 143511 - DNA, 323 bp, Homo sapiens
ggaagtcagcgtgtggcctgcacgcacagagccgtttattaactgagtaggtgccataggcagggaccacgtggttcccagctggcaagggaggtcaaggaagtcccagctccctgatcctccagggacttcctgcccatcttgggagtagagttcattggggccaagagcaagaggctacaggctcatctcctggaagcagacgttatgcaaacagaagcttccctgttaatgggagtttgtccagtgtattctcccaagagcaggggccaccggctggatttctgttctctgtccatgtccctgaagatggcacctctaaa

SEQ ID NO: 143512 - DNA, 331 bp, Homo sapiens
ctttgttcaaggtgcctatttgctctgcacagtgactattatgaacacagaaaactgttcattgttaaatatggcatgctaagtggttttgctttctggcaaatctccaaaccataattattaagggactggagctgctgaggaattcttgggttacaagaggctttgatcctgttcctgccttctttccctgacatgaatttccacgggtgtggctgactttcattgtttttcactgctgtggtgctgctgtgaaggtgaaggattaaacagaacttcaaggtgacaagggattgggccccccagaactgctgagaggaggctctggcta

SEQ ID NO: 143513 - DNA, 546 bp, Homo sapiens
atcttcatgactacgtgattataattccttgagagccccatgtctatttgctaaaaaataaatatgtgctgctacactaacctaacaagcagtcatcttgtagttcctgcctgaaaatgtttgatcatggttgtcaactctatgcctgctataatttttgcctagcataatgtgaagagaaaagataaaaatccttctctcactgtgcattttcactgtcccctcccctcattcttagtgtatagaattccagaatgggccttgctttctgacattttcctgccccatgaccctaacagatctattcaacatgaccctgacggctgagatagatctaaacccagccccttcacagtggaacacttaagctgggtagtagttccatactgagacccctttcagtactttctcttcctccccttcttttttgttgtgtcttcccctaccaacatgagctcctttttagggagaagttgtatccttcactcttttcccccatcacctaggagttgctcaatatagtcattaaataaattttggcattct

SEQ ID NO: 143514 - DNA, 749 bp, Homo sapiens
aaatctttattaaaaagaaggagagagataagatggcagcccaaatgcagagtgaagaaatcattttttcctaaaagagagaaaacagaagcaggttttaatacagaagcaaagcaacagtgcggaggcagagcctgaggatgtcagaagtatacttatacatctgtttcctcaaagaaattgggagctcccagtggaatcccagcagaggcactcaagcagaggttttgaaattgcgaacagcgtttataactaatggaatagaatccccaaaaaccaacaagggtctgaacgaagggagccttaggaaagagagtgcacacatgctttctctgagatagaaggggagtgggagatgatgagggaaaacacgggaatattttgaatggaaaaaaggctgcacacaggagttgtttggcagtggagagaagattctcatcagctggccttgatcagtgcagtaaggcagaggcgaggtcaccgcccacagagggagctggcagcattcaggggctggcagagtgggaaggagctgaggaagacagaaaccagctgttggggcccatatattttggagttaaccagagactcagaagaggccgggcgcaatgactcatctctataatcctggctctttgggaggctgaggcaggaggattgcttgagcctaggagttcgagaccagcctgggcaacatggtgagaacctgtctctacaaaaagcaaaaagatacaaaagttagccgggtg

SEQ ID NO: 143515 - DNA, 268 bp, Homo sapiens
gaattctcggatcaggagcagctctgtgcttttctgggacaagcttctagagggagaggcagaccacatccacaaccctccctcctgtttgccctcaggctggggagtgtactcagtgattaggggcaatcgtagacactcagtaaaaggcagccaccttaaggaaaagtagccagattgttttacacaggagcccccacccctgctacttctcactgagcaaggcctcctgagagaagctgtggcggccggagaagctgtggcggcc

SEQ ID NO: 143516 - DNA, 267 bp, Homo sapiens
gcagtggcacccttagctcaggagggtgcgtcaggacccagttccatcctcacacggtggggaagcctgggctgtgctcccagaacaagaaacagacctgggtgatgagtgacaaatgtggacggttctctgcactgtgggtggaaatagaaacccttagtcagctgtggggttcagcaaagaatttccctggttaacggaaacttgactggctgtgggtgagggggaggttgggttctgagacgtctgggaggcctgggctcttcg

SEQ ID NO: 143517 - DNA, 264 bp, Homo sapiens
gctagcgaacacactggaaggcaaagagggagagtcccatgtccccacccctgcaagtggaagagctggagagtgggaggtggggaaattgtcagtagggttggagggtaggcccaagtgaggtcctccagttagagcctgagcagtcctttgagggaaccccagtggaggggtagggttggaaaatgtatcattcaagttatagagctgcttctggttgagcagggaatggggtgagttcgttaaggaagactgaagaagtcc

SEQ ID NO: 143518 - DNA, 860 bp, Homo sapiens
atgctcagttcatatgactgattttcactaagtgtaacaatcaacgagttcaccataaagcctttcccaacatcaggacagtaaagcaactactgaaaaccattcctgaatttgtgatcaatggactcaagtttagggagaggagcaccttggtctgcaacaatggtttgaatcccagtctctaattacttctttcccaaatactctggtcaccaaagggacaatatttggtgagatgcagccattctgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagaccctgaaacagccaagacatgacacttagtacagaggaatccatagaggtgttggggatattaacctcactcttggcatgctgaacaaggaagatattgttaacaaggaagacatttacagtcatctcacttctgttattcagaatactgacatcttggatgatgcaattgtccaacgattgatttattatgcttctaaggatatgagagacaacaatatgctcagagaaatcagaatgctagctggtgaggttatggtgtctcttgctgcacatgatttcaactctgtgatgtatgaagtacaaagtaacttcaggatcttagagactaccagatgaattcgttgtgcttgccctggctgaattggcaaccagctatggtat

SEQ ID NO: 143519 - DNA, 609 bp, Homo sapiens
caagttgcttagacagaatgagattctctattcattcattcagtaaaatttaccaaacactgtattatcagtcaccaagctaagaatgcaggatacaaagctgcataagatataggtggatccttccctcataatgcttattctgagaagggtagataatgtaaacaaaaagctatgacagtgggatcagaactacaggagacatatgcacaaaatattacaggaagaataagttattccgatgggggtcaaaaaggcttcaccaaagagctgacatcttagttgccttaaatggaaaagaaaacaaaaaacggcacttcaagcaatacaagtatttatgcaaaagtataaggaatgaaaaatatgtttattgaagaataacagtagtctggttcacactacacaatgcaaagatgtgtgttacacaaggttataagctaaaaagagtaacttagtttacgtaaatcagttctgaataagagacagtaactcagccgggtgtggtggtgcacgcctgtagtcctagctattcaggagactgaagtgggaggactgcttgagcccaggagctcgaggctgcagcgagctatgattgtgccactgcactac

SEQ ID NO: 143520 - DNA, 196 bp, Homo sapiens
cctcagcctcccgagtagctgggattacaggcgcccgccaccatgaccagctaatttttgtatttttagtagagacggggtttcaccatgttggccgggctggtcttgaactcctgagctcaagtgattctcccaaagtgttgggattacaggtgcaagccaccatgcccagccaaattggagagttattatagac

SEQ ID NO: 143521 - DNA, 743 bp, Homo sapiens
ctcgtctctactaaataaataaataaatccagaggatcccacctccctgcagccctttcaaatggaggctgtttatttgcatacagcccaagttcctcctggtgggaggtggggttgctgttctttctcctcactccttgaggctgcctccagatcatagcttctttcctccctattcatttgaccagtaattgacagccaatagctataaagagcctaggggccaggcatgctggtaaggaccttgggtggatgacatcatttcagcctcagcacgactcaatgaaatattgttgttgctatccccattttaccacagagcctcagaggctcaggttaataacttgctacttcatatattgtctcaaatatatgaatggaaccaacaatatatgatgttcctacttcatatattgtctcaaaatttttaagaacagcttgtttgaatttgaattcagttaatgtcatacatcgcaactggatttaagatgaggtcattttcactgaggagttttccagaatctgtatgttgtcaattacatccttatggtatcattgaacttgtttccctgtcatctgtatttcctgtaactggtatttagatccaaaggtttaaacagattcaaatttgattttttttttggcaagaatacttcataggtggatgaaattgtacgctacatctagatacggctcgtattaactgtactagctaccctataactcgggggcgtacagctatt

SEQ ID NO: 143522 - DNA, 320 bp, Homo sapiens
cttgcctcagcctcccagtagctgggattataggcgtgcgctaccacatctggctaatttttgtatttttagtagagatggtttcaccatgttggccaggcttgtctcgaactcctgacctcagatgatccacctgcctcggcctcccaaagtgctgggattacaggcatgagccaccgtgcccagcctctacaaactttttattccattaacaaactatatgcctgggatttaagttttcttaatacttgatggagtcctatgtaattttgcagcttttaattttactaagaccattttagttctgattatagaagtaa

SEQ ID NO: 143523 - DNA, 367 bp, Homo sapiens
tgtagtccatactggtcagcctctcagcacagagatgccagaacattccagagtatgctgtgagactgcctagtgtctgtgtccagccattcagggaattaattagttcgcatggatgttaccatggtacgccgagaggccgaagaaacaggctgtctttgtacagactaggagcattttcattagcagagaaataagattgcagtgtgaaaacaaccacgagggcctctgtttacagagaaggatgccgagctgagcccagtctccgcatttggacaggggccttggttgtccaggagacaagtggtaataggtactagaacttccagaaaaacttggagaaaaaagtcaagttgcggccgggtgt

SEQ ID NO: 143524 - DNA, 404 bp, Homo sapiens
gccttgaggattcctggaaatgttattccagtgattggttttagatattaaaagtattgctaaaagttatccaggaaacatttgcagatttggagattgaaggggaaaaaagtagtaagaaaactagaaacactccattatagtgtttgggatgctggactttggacagttactgtggtacaaagcaagtgctacgtgtaaaagtcattgtagaacaagaaatgagcatcattgtctgatccgaatctgaggttagattaattttagagtgtctagcaggcacacatatctcattaagaagtagttgttatttaagaatacaataaaaattttatttcaaatttatgtgtgttacttttttcaaatggctactaaagtatttgaatatagatagacatttgggg

SEQ ID NO: 143525 - DNA, 314 bp, Homo sapiens
acctgtcccgtgggtacaaaaccactgtcctctggaagcctctggccttgctgcggcttcccttacaaatgatctttggtcttgggagtctagtcttaggcctccttcacgcccttgactgcagcatctccggcatctaggcctaccttgtcccctccagctggtggcagctcaggacactgcagagcctgacttgccaggagacctcgcaggtcctgggttcacagggctatttctaggctctggtggctccagccctgcctgcctaagagggtccctccacaatcagtgaggaagccagtctctggccccca

SEQ ID NO: 143526 - DNA, 492 bp, Homo sapiens
ggcccagagtgagggagttctggagcaagttccagcttatagtacaaataactcgacatttaggccatatgacctggcaaatcccatgatgccagagacattcctggtagacaaggatgctacagagtctctggcaagccctgattgcataagtcgtaacacagacctttaggtttctggagctcagtcagtctttccgcagcagataactagtcactatttagagagtagctcctcacatcagagcacatcaactatgtgaccagagctatccatcatgagctgggtattgtcagatccaccaaacccaaagaatagaccagcatagtaataactcatgttacattcaggatggtgcccaagccgttcctagggctcccacttccatgaaaaggtggcccatgtaacttacctccaagacaccagcacctttccctcagctcatggcttcgttggggttcaccactactatcaggtgacagaggaggaaaa

SEQ ID NO: 143527 - DNA, 698 bp, Homo sapiens
gtaatatctattctgtggagatggatgtacccaataaagttgggggacagagtcactggcccacaaatcccaggtaatcacattaagagatccagcctgctctgcctaatgttattactttctccctgtggaaaggagaaatatgacactccaggggactacattcattgtttactcagtcaatcaacatttattgagcacccacagtgtgcagagctagtatcagaccaggatttgaaaagtaaaaagttcttcccctgagggatctgcaagattaatgaagtctctgccctcagggagctgggaaactgctgggggaaaaagtcttcggtttcagggctctcccagtcagatggggaaaggagaaaaccacccagaaaagcaatgtaaagatactcacagcactacactctgaccaactgagctaaccggcagccctaaggactcttaaaagataagggaagtcatcctgcaaattaaggacttggcagctgtgggacctcagtgttaattaaaggtgttttgaaagcccaagttaaggatgttagagaagtgtgctttggaagaggcagagagacagagatggcagacagacacggggaatgtattctgaggttctctgcaaaggcagaaggagaagcagtaccagaatgcaaaggactggtaagcaaaaatactagaacataaaaagaaatcag

SEQ ID NO: 143528 - DNA, 166 bp, Homo sapiens
tgtgtgtgtgtgtgtgtgtgtgtgtgtgtttgcacctctgttgtttttccaggaaaggtagatctaacattgtgttttagtctttccgtatttttttcaagtaaatgacttcctaatactctaagaggaaacgcatgtgatagttttcttttctcttaagtataca

SEQ ID NO: 143529 - DNA, 505 bp, Homo sapiens
aagagccgtggcaagatgagggcgtttatagccctatcttatccatatggacaggtgctcctcatgcatccgtttataggctctccacaagggtcacattccattcccagagctatgaacatctgcttttctaggataggaatcttggtgatgtgaaacctccctgactgcacgtccattcataggctctctgcaggggaaagcacatcacgtgctgttggctcattctggcagtccaacctggcattgtctttacacaatcctgcatgcaattatgtatttacaataatcaggagcatttcatcttttattccatagcaatagtttcagggggtctccctacatcaacctctggttccctctggtgctgttttctgagcacactgtgaacttccttgctggtaagggtgcttgtgctgcctcccctatgggaatgcccttttcaacccagcagtcactcagcttgtcagggtccaggtcactccatgaggtcagctggcaaggc

SEQ ID NO: 143530 - DNA, 468 bp, Homo sapiens
aattctcttggccaagggtcacaaagatttgaagactaacatggctattctggccacatactcagccctgtgcatgtgtaacttctgcgggagacgtccctgtctaagggtcctgcaatctaacaggaatatatagagaatttatatcttcctggatatatggagaaatatagggaatttggctcactgaagtgcagaatccacatcttcttaaatggcccttggctagagaacggtggctgtctgtcttagcattccaggctgatataacaaaataccacaaactgggtgtcttataaataataaaaatttatttctcacaattctggaggctaaaattccaagatcaaggtgccagcagattcagtgtctagtgaaggtccactttatggttcatatacggcaccttctggctgtgttctcacatggcagaagacgtgaccaagctccctcagacctcttttaaaa

SEQ ID NO: 143531 - DNA, 182 bp, Homo sapiens
ctgcaagaatgggcacagaacttaggaagggctgtcactggtcctcacctgctcctggccacctggggtcatcttccttccacataactccctcagaaaacctcacctgtgtcagctgcactttcagtagtgcctcctcccgcatggactgctctaacttccactccgtacgtgctttgctg

SEQ ID NO: 143532 - DNA, 356 bp, Homo sapiens
cctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttgga

SEQ ID NO: 143533 - DNA, 525 bp, Homo sapiens
cctcatcttcacgtagctgtgaacatgacatggcctttccttccacaccttgggtttcatatgtggaatgactggaatgatccatgagtgcaagctgggttctactgactccctgagatgccgtgccactctctcccagctctagatataggcgtatccacagacaggcctggctggcctgggaaggatgagggtaatcagggctgagagtgtccagctgctgatgggacacacggtggggaaagaagtgggtcccaccccagccagatgaatccaggtgcaggactgccccagcaggtgatgagaacttcctggggagcaatagctgagcttccagaaactctgtgcacactttgttcagacgtcatccaccatgaggatcgggagagtctcgaagttcacgtatggcattgccctgccttgctgagcaataacaacttgtttatttcttaggaaagtcagcctggtttcctttattcaagtggtaggtccctgcttagtatgtccacctgatatctgtcagga

SEQ ID NO: 143534 - DNA, 353 bp, Homo sapiens
cctgagtgacagagtgagaccttgtctcaaaaagaaaaacagaaaagaatcccagactggccccaccccagggcaccctggctgtgctctggctcatcaaagcccagttccctgcagtctggaggcctgcactgggcaaggggcaggggctgtgactgccattggagaggagaggatgactcagacaggggcaggagcaggggaggcgccgtcagctgccttagttcccaacagaagggcaggctggcactgagaagtggctcttagctcccgcctcctggcccttatcctgccctaccggccccctgcccactccatgccaccatgtgcccctcagctcaaccacatcccca

SEQ ID NO: 143535 - DNA, 282 bp, Homo sapiens
aaagttgtcctgaagaaatcagtgagtttaatgtcatcacattctcaagtgaattttgagaaggaaaacaaacattggagactgtctgaacaagagaacacattggcacagaggctgtgattagcacatgctgatcaggaatagcattctttccccaccggctcagtgtaaattttgccattcactttctttaccagctagtgccttgagagctaaatgtcatggacctgtgttaagtttgtaatgttaatttgcccccttctcataagtccacatcttttc

SEQ ID NO: 143536 - DNA, 270 bp, Homo sapiens
tctgctgcaagtgagagcactgagaatggagaagagggaacaaacggaaaccttgctcaggggagagacggcaggaatctggcaaccaagtcagcagtgatgtcatttaccaagtctgggggaagacgagaagcagctcacttctaggtctgttcaggttgaagtgtataaggaatcctccagcaggcagttagaaacataggtctggagcctaggagcaaaccccatggtggagatacagaggcagctcacagggaggagtgaacgtgg

SEQ ID NO: 143537 - DNA, 363 bp, Homo sapiens
agtctcggggctgctctccgtgggtctcccaccattggccgaattcctttggcttctcttgggttgggtcttgggtcttctcctgggatttgctcccttggtttggggagggaggcgcatcattttatggcctcctgagaacaggtgtttgggatgtgtccctttaaacagaattcccacgctcccttcactcgactgctggcatgttaacgccacctcacttgctgtcccctcccctcttctgtcctgtggacacgtgttattcttgccctgacaatttgagaatgagttgtagacttggtgcccctttactcccaaatgcttgaacgtgactttgctgccaacgaggacatgacgccgtac

SEQ ID NO: 143538 - DNA, 585 bp, Homo sapiens
ccttctttctctctgtagcctccctgtgcctgtctcctgctcccaccccagcacaacagagtctaggtctgttttccgctgctaagtgtgtgataatttattatgcagcaatagagcactaacacactcggccagtggcccaggcctcagtgtgcggcacactctacttagcacctccacatgtgtgagttctgtcttctcagccccactccggtccttgagggtgggaatcttcctcctttatctcctctgtatctcccaccccttggtcccaactacagggtaagggttcaaaaaagtgctcatttgaattcggcatagcactaagtcagtcagaactcttcagaggcaagtgacagaaagccatctctcatcactggcttcaggcacagcaggatatagggctgggtcaatgtaatcaggattcaacatctctcatggcatctgtatgggcagtagggcatagtggttaagaccatgggctctggaattgggttgctggataaaatacaggacacccagttaaatgcttcagtctttgtctttttgccgaagttccaacaaaaggcccgaagaggagtccca

SEQ ID NO: 143539 - DNA, 797 bp, Homo sapiens
gaaagtctctttgaagaggaacctctattttatttttacactcagaagcccgggcagctctgccgggagtgcagggaggcagctctcctgggggtgcagaacacattggatacaccggttattttaccaaggctttggctggaatgttacatttttgaatgtgaccaaactgctttgaggaattgaggctgactttataaagccaatagacatgggaaagactggcctcatgccttgcccacacggttctcttacaaggttcctcagcttgcggttttggtatcaggatgacaccaaaagcaatggcaacaaaagccaaaattgacaaatggaatctaattaaactaaagagcttctgcacagcaaaagaaactatcatcagagtgaacaggcaacctacagaatgggagaaaattcctgcaatctatccatctgacaacgggctaatatccagaatctacaaggaacttaaacaaatttacaagaaaaaagcaaacaaccccatcaaaaaataggtgaagaatatgaacagacacttctcaaaagaagacatacatgcagccaacaaacatatgaaaaaaagcttatcatcactggtcattagagaaatgcaaatcaaaaccacaatgagataccatctcatgccagttagaatgcagatcattaaaaagtcaggaaacaacaggtgctggagaaataggaacgcttttacactgttggtgggagtgtaaattagttctaccattgtggaagacagtgtggcgaggatctagaatcaaaaatgccttttgacccag

SEQ ID NO: 143540 - DNA, 335 bp, Homo sapiens
actgcaacgtgtcatcaagcatcacccaaaacatgccacacacatgagggctgtctgtgaccctctcgaatgctaatttagaaaaactgcccagctctccaatatgcctccatagtctgcttttaagaactatttttgttctctcctcccaccgtgcatggctgagtgtgaatagctgtttcctgggtcctcactgccaaggtaatggcactctatcccatctcatcactttcaagttcacctctactttgaccccaggacacagcgctcttcacacatactcactttgatccattattctccctctgctctagaaagacacttgaaatacttaa

SEQ ID NO: 143541 - DNA, 415 bp, Homo sapiens
tgcttgaccggcactctctggctcagtttacatatccacaaaatgcgtggatagatttgaagggttttaagcatccaaaggtgccatacgaacctgcagcaccaagttagcgcgaaggcatttcagactaaggacactttcttcggttccactgcactcatcccttcacaggcttcattttgcccctcaaaagctacaaccgaaacccctgtatttctagagtccgaaaggcatgaaagaaaacaagaaccagtctcgggatgtgactgcggctcagttcaactgctacctcctcatctaaaagccgcctgctctgaacgtggggcgccagtcccgagcctcttgcgtcaatcttgggggagtcaagaacccacccagaccctcttttccagctctcccaaggccctggactaga

SEQ ID NO: 143542 - DNA, 687 bp, Homo sapiens
ggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtt

SEQ ID NO: 143543 - DNA, 248 bp, Homo sapiens
acttatcacctcaaatggaaataaaaggtagacaaaggccaggaagagaaagcacagatgcaaatactcagtgcccagctccaggccccgccccatgcatgatgtgcttccccagtgcactcaatgggcaccatatgtatacactgacatttgacctaatacaatcatgtcagtcttttttgtttacctctcctccatgccagtagacagtacatcagaggaggggtgagaagatgtaagttggctct

SEQ ID NO: 143544 - DNA, 319 bp, Homo sapiens
ccgcttctggacaagcagggctcccgtggccagtgggagggagcagctggcccagctgtccacagccgctgggagtcagcctctgttctgtcttaagatcactatcatagagccttggcctcgtcctctgcgcttggccttggaagctctcctgggacctctccccaagcccaggacacctctctgtgttcctggctcagtctagtcaacagtgtgagtttctctcccagcctctggcctagcaaagctggcctctccagtgtgtgcctgtgtgcgcgcgcacacacacacacacacacacacatacacacaaacagaa

SEQ ID NO: 143545 - DNA, 339 bp, Homo sapiens
tgggattacaggcgcccgccaccatgtccggctaatttctctattttttttggtagagacagggtttcaccgtgttagccaggatggtctcgacctcctgaccttgtgatccacctgcctcggactcccaaagtgctgagattacaggcgtgagccactgagcccggcccatatttttagtcattattttagtcacactttcaacactatgcactttaccagtgaaaaattatttctaacatttcttttgctaattaacaagccctccagttcatgcccaatgatgtactttgaaaggaaaaaaaaaaaccaaattataaaaaaaatttccagtgttga

SEQ ID NO: 143546 - DNA, 301 bp, Homo sapiens
ggagtttgagaccagcctgggcgacatgtctcttaaaaaaaaaaaaaaactctcatgcctggtcccatcttacttttttaaaatgagaaaagattcagctgtgtctatttaaaggcttctctctctctctcctttgggaaggacatgctttgtgcagctaaaatggagaaagagtggctaagatccttaggatccagaatgtctggcaacaagccctagtggctatgctaaaaattaccaagaattttgtatttctttgtcatagacccaatttctcttctgtatgccattaggtagcagt

SEQ ID NO: 143547 - DNA, 278 bp, Homo sapiens
cttgcttaagaagaaaagaatcatctttattttgttttgttaaataccaccattaactgcagaagctatgattcattgctcgtgcagtaatatatgcccttttaaagtcattctggaactatggcattaacacctatgaagattttgcaatcatgtatgccctagatcactcgctgaatgtacattcatgtaaaaatatgtttagaacaagactgaacattttttgatattaaagtcacttttgattattcattctgatactaaatggacatttccac

SEQ ID NO: 143548 - DNA, 371 bp, Homo sapiens
cttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtg

SEQ ID NO: 143549 - DNA, 110 bp, Homo sapiens
atcttaaagtctccttgatattttttgaacttttagaaatctttgctagattatacttatttggctaggtgggcatatttaccttttcccaagccacctgtcaatttcct

SEQ ID NO: 143550 - DNA, 639 bp, Homo sapiens
tgcagtggttcacaactgtaataccaacactttaggaggccaaggtggaaggatcacttgagtccaggaatttgagaccagctgagacaacatagtgagaccccaactctacaaaaatagtaaaaaaatatcagccagccatggtgatgtgtgcctgtggtcccagctacttgggagctgaggtgggaggatcacctgagcacaggaggtagaggctgaggtgagccataatcatgcactgcactccagcctagatgatgaagtgagacctctgggtatgacaatacgcctgttcctacacccaattggaggtgacatatagctgggctgggaaatgactgggccagatgaagtggctcattcctgtcatcccagcactttgggaggctgaggtgggcggatcacctgaggtcaggagtttaagaccagcctggctaacacggtgaaaccctgtctctactaaaaatacaaaaaaattagccgggcacgatggcggacgcctgtaatcccagctacttgggaggctgaggcaagagaatcgcttgaacccgggagccggaggttgcagtgagtcaagactgtaccattgcacttcaacatggacaacaagaatgatactctgtctcaaaaaaaaaaaaa

SEQ ID NO: 143551 - DNA, 821 bp, Homo sapiens
ggaggatgagtggggttattcagataaaggggagaaggggatatgtgatctagccagagaaaccccatgtgcaaaggccaggggtgagagatcaagtagttagcctggctggggtgctaggtattctaggggagtgagagttggggttgagggtagtatgctatgtgaaatacggggctgaatgggaaggatcctctaggtcctgtcaaggaatgaggactttatttgagggcaattagaagtcatgcaaaaatattatgctgtgaagtgttatgatcaggcctgagttaataggaagactggtttgggaaggttaaagtctggagtcagagacaccagtgaaggtcaaggttgatgcagcaatgtaagtgagagataatcatggcctggaccaaggttgcagaaatgaacatggaaggggagaatgggttctggcggtgttcagcaggggtagacagtgggacttgcagattgtttagatggagagatgagggaaaagacaacatttaaagctgactagggtcatgggacttttgaggcttctagatacgatggtctagtgttctgccttctggaggggctgaccctgtattatcccagcatatctaggcctgagaaaaataacctacaagcctgccagaaatgtataggcagcattaatttttacaaagtgtaaatgtgtggtcattttctgtgacttcttttgtttactttttttgagacagggtcttactctgtcactcaggctatagtgcaatggtgcaatcatggcttactgcagcctcaaactcttgggcttaagtgatccttcccccttaact

SEQ ID NO: 143552 - DNA, 1078 bp, Homo sapiens
ctgtaaagcagagtggatgccacatgtgtgtgcatgtgtgtacacaaggggtactgtgtgtgcatgggcataggcacctctgtgtaaggggatacctctgtgtgtatatacatatgggtacctgtgtgtatgtgggtggggtttccatgcatgtgcctatgtacaacatgtgggtgcccgtgtgtgtgtgcagagaagtgtcagggatgtgtccagagaggctgtgtgcctccctcacatctgaaggttcagcctgggcccatccgcctggtgtactgctcatgcccagttctttagaaaacgctggtctgcaggtttgctcccccaagctgtcaggagaattggggggatcagaagacatctaaagtctcgctggtacccccaaatcccagcagtcctctagtaagatggtgatgtgtcctctcatggggtgtggcttcgaacccctgacgtgtggatgcttcattgtgcacctgtggcctctgaacagctggccacccagaagggtacatgtcctctgggccctgggtacagtgggtcggtgagctggatggccggcaaaggcactgagtgctggagggtctacagcagcctgctcggccactgggccaggcctgggcaggcaggggttggttcttcagccccagctgagtgctgcgcacatcctctgccccatgcacagcagggcagcctggggaggactgaaggtggctgaagcacccctgactgaggactgagcagggtccttctccctgcctaggggcccccagcctctatatcccagagagctgggtttatggcaggaacggcagtggtaacagctttcctatgtgagtttcatgaccaaaaacctaacagaaaagcttgaaggcagacagggtgtggtggctcacaacctgtaatcccagcactttgcgaagccaaggcgggcagatcgcttgagctcaggagttcgagaccagcctgggcaacatagtgaaactccatctctacaaaagatacacatattagccaggagtggcggcatgtgcctgtagtcccagctacgagaaagactgaggtgggaggatcacttgag

SEQ ID NO: 143553 - DNA, 541 bp, Homo sapiens
ttagacttatccaggccaaggtatgttgtttgacgaacaccgcaggtgatcctgatgtgcatccccgtctgagaactgttaactataaaagtttgactttggaaatgaagaaaaattaccttttagcctaatcatgaagactaggcgtcaaaccaaaacaagatgcatcagttactgtagcaacacattttttttaaaaaattgcttgttgtcacaatgaagggtgtgtatctgtttccagtatgcaattctaatgccaaatgtctgccttaaaaatagcaaaggagaccatcaggttaacataaaggaaaactgtagttgtgtgactcatgtgtctgtagattgtaattttataattacaatttttataagataaaaaactaccagttgtaaattcaaccaaaaaaaatttaaagctttgatttagctttttgctttaacttgggtagtaactgaaatataaaggaagaaaatctattaaaaccaatgaggttttatatttttttaaatcttgattcaataaatatcagctgaattaagt

SEQ ID NO: 143554 - DNA, 702 bp, Homo sapiens
catttcccttagctagccatgacctcaaacattaaaaacatgtacctcccttactttatagaagaaacatacacccagacaggccaagtagatttacccggtctccgagcttcttcatggcagagctgagcttaggctgaagtgtcttgatagccatcgaatgtgctagatgctgggatgtgctccttgtcctcggtgagagagcgggataagacttacctggtgtggagaggagctgcagtatggtaggaggagcaggattagctgctcagaacagggcacttctgcttagcagcatctgcagatgtcagcagcccatgaagaagggctcatcagcaaagtcttggctcccctgtccctgcccagcacatgcagggcaaggagagacaagacagagcttacagggcatgcttctgctttctctcgctgagggctggcctaagcaaaggggtcctgagcttgcaggctggcagcccaagccatgctcactgcctccaggaaatgagttttctatgcaagccctcctccccaaaaagttgtgatagcaatattaaaagtagcattattattggcctggcgtggtggctcacacctgtaatcctttgggaggccaaggcgggcagatcacctgaggtcagagttcaagatgagcctggccaacatggccaaaccccatttctactaaaaatacaaaaaaaaaaa

SEQ ID NO: 143555 - DNA, 593 bp, Homo sapiens
accaaacgccaacagtgtggcctggaacacccagtgtgaggacatgctctgcttctcgggaggaggcaacctcaacatcaaagccagcatcttccctgtgcactggcagaagctgcagggctttgtggtcggctacaatggctccaagatcttctgcctccacgtcttcatttctgccgtggaggtgccacaggtaactgggagcacctgtccactctcagcactggcaaggccagtaagaccagggaagccgggcccctggctggtgctttgaggagagagtagcaaggagagaagaatggcagctgtgatgtcgtgggaggcagtctgggcttggaacctgcagccctatctccactccttgcaacctgtgtgactgggggcaaggagctcaacctccctgtgcctcaatttcttcctggtcccccttctggtaaggattcagaggggtatacagtgttgtcagcagagtgtattttacagagagcccagtgtgggccaagtggagagagcagcaaagccgggagtccagcagggtgtgtgtgtgtgagcacatgtgtgatggtggtgatgtgtgtgtgagagagggggaa

SEQ ID NO: 143556 - DNA, 259 bp, Homo sapiens
ttttgatcctgagcaaggagaggcttgtttcaggaaagggctgttatcattcctgttttaaagttaaactataaactaaattgctcccaaagttagttcggcctacatctaggaataaacaaagacagcatggaggttagaagcaagatggagtcacctatgtcagattcctttcactgtcataatttttctatgccagatgtttctcactgtcataatttttgtgaaggcgctttcatgtactcaatagttctgtttc

SEQ ID NO: 143557 - DNA, 613 bp, Homo sapiens
tcttactcaagtcagcctcccagatttctgtctgcagcgcgactgtgtgagggtggtcaaagtctctttgttttcttcctttctgaatttggaccagcagagccacattcggaagaatgggttctttggttttgacttcagcgcatctgatctcgaggagtcctcggtgatcttcagcctcccaggaagagtcactgtttgcctttgtctctgtctcttgggtcctttgttgtgaagaggagaatcatgggatacgattctcctttcgtcttgttttgtgtcctgagaacttgcctttatggccagtttggcttccaaatgcctgggggaacagccaatggtcaggatgtagccccaagaatttacaggccgggcgcggtggctcacgcctttaatcccagcactttggaaggccgagacggatggatcacctgagatcaggagttcaagaccagcctggccaacacggtgaaaccccgtctctactaaaaatacaaaaattagccaggcgtggtggcgggtgcctgtaatcccagatacttgggagcctgaggcaggacaatcacttgaacccgggaggcagaggttgtagtgagtagagaatctcagccac

SEQ ID NO: 143558 - DNA, 640 bp, Homo sapiens
ccagattcatagaccccccccccaaaacttgtttcctcaatgtggaaaagtcacaggcactcatcaccagcccagcccatgagggcacccttggggcatataccctgcaaagccacaggtgccaagctgcccgaggccttgggagcccagccctcacacccctgtgtcctggatgtgggacagggtttcaaaaagggtgattttggagctgtaggattgaatgactggccttctgggtttggagtttcatggggccagtaagtcctatctgtgttttgtttttttttctggcaaaattcttccttttggctgggaatgcttacccaatgcctgtacaagcattgtaccttggaagtagttaacttgctttatatttcagaggctcatgggcctaagggactgtagccttgtgtcagatgagactttaggctttggacatttgtataaatgctggaatgatataagattttatgggactttagggaaggcatcattgtattttgcaatgtgagaaggacatgagatttggggagtgagggaaagaataataaaattcagctctgtgtccctaccaaaactcatgtggaattgtaattggaatctggcgcagagagtggatcctctagatcgacttcaggaa

SEQ ID NO: 143559 - DNA, 169 bp, Homo sapiens
ctcattttttcctgttcagcttatatttgagttttgtgtctctggaccaaaccaaatattttttactcccaggaaggtcttcaccaaccaggaataatgacaccaactggtgatgtaatccccactgaaaactcttttgatccctttccagccaatggaattcttcccc

SEQ ID NO: 143560 - DNA, 352 bp, Homo sapiens
aagtagggacccactgagttccctccaggattgtggagtttcttttacagccacatgtggataagaaactaagggccacagaccaaatgacaggtcggatggcaaccctggaaaagtcacacagctcagcctgttggaggaagaggagcagtagaacctgtgtggagcctgacagaacccaagatgccattcacgaaccgagaggtctttcaagatcacacacagttctacgacacagacatttcgtcttcttgccactcagtagcggggcccatccctctgtgcctccaaggtccgtgtgccatgtggaaaactcaggtgttctgtctctgccaggaccttcttcctgctg

SEQ ID NO: 143561 - DNA, 794 bp, Homo sapiens
tccgtgcccgcagcaaaagttctggaaaagaacctgttagaaaatccaagctgatgcaccgcctcaccaggcgtgcaatagggccacagtggcctgtcaggatgtggctcgggacccaggaaaaaagctccatcgaagcctgtgctgccttcgtggggagaagttccattctaacccactcgtgcatccgccggcaggttcttctcagttctcctctgattctaatcagaggattcgagtttctggattaacactgtgatacaatcttacccttttccataaaatatgtatccagtgaactaggggatctagttccgagggtctggagttgaagtcttctatacttccctcaccctcattaagccacatcttgagaggaattgtaataatctgatctgtggtctttgcgaacctgcaaagtgtgtgtaagacctcataaagccaaacattcaaggctttaaaggtgatttatagattagattttgattaaggctaccttttcagggatggctcagcataagatatgtaccagctttgaggaggcattacggaggaaaagcaaaaccttacgtccttgggaaaactgttctgaaactaatgactttacatttatccaaaagagaaattgtggggaagctgtttatttattctgtgtaatcattgcattcatatgttgttgtttcaaaggattaatttcccaatcagttttcccagtaacactgtttatgatttttgaacggcatgcaagtaatgaatgcatagagcataatgtatctctaacccaaatacatgtg

SEQ ID NO: 143562 - DNA, 547 bp, Homo sapiens
aggagttcccatcagttattaagttaccttatcagaggttgacacacggttacagcaatctcacgggtggaaggtgttaccagagaaaatacaaaagccaaactaatggcaaagaagaaaaatgagaacccatggctaagagatatacctgggcaatcagaggggaagagaagacagtgagagtcagatcttccatacacttttatttttgtgcatattgtgggaacagggtaagtagaacaggaatgggagggagacttctcaaactattcatctttctatatttttttgattataggaccacataaacgtatttaaaaactatatcaaaggaacaataaggaaaagatagtttttatataaatgactactatcctgtgattaaccctaaatttgaaaataactggggacatggcaagtcagttttttattatcctaagttgcagactcttgacccacattgcagtttgaagcaaaatcgatgcaaattattctgaaagtctcactgttaaatttagtaggcagaagagggaaaacttccctttgt

SEQ ID NO: 143563 - DNA, 328 bp, Homo sapiens
accacagggcctgttagggcaagctggggcctccttgtttaattcacgacaggaggaagagctgggtatagggactccactgtcaaaagccctgccaaccaatgacacaagccagcaaggcaacccccttggcacaaagagacagtgggcaaccacgggcctgcagaaggacttttcccctccgcactcctggcgagggtcaggtaccagatacctcacaggctgggaggcaggggcggcatcttttaaccccaagccttgggtattttttgctataagagacagctgcagggtccaatctgctgccttgacccctccaactcccaag

SEQ ID NO: 143564 - DNA, 197 bp, Homo sapiens
gctggcagagtgcatgggggtggtgagaccatgggccaccaggaccctgggcataggtgcctggcctctccttggctggaccaaggtgcacatatctggctgaccctcaggtacaagagtacaggcctcccgggctttttgcctgggagcagaaacatgctgcgcgtctaggtgaggccagcctgggctcatttcca

SEQ ID NO: 143565 - DNA, 450 bp, Homo sapiens
ttgcacattttccagtcattttttcttaattgagaatttttttaatattggagagacagtcttgctgtgttacacagactgatgttgaactcctggcctaagcagtccacctgcttcagcctcccaaaatcctgagaatacaggcatgcgccaccatgcccaaccttcagtcatcttagataccatgtaccttgggctttataagtataaaggttttgttccttacagatctcagtagtactgttaagctggtgtgcttttcaaacagtaatcaggaaagaacaacttgtgttagtattttctggcgtgcttagtgggttggtagtggtgatataggctggtagctgagcaacccagcctttctggccaaaaagtgttatgtaataatattgtttgagcaaagctgctaaatataagatcattgcattttctttcgtaggacttgattat

SEQ ID NO: 143566 - DNA, 269 bp, Homo sapiens
aagatgttctgtgggccctttctgtctaaaggaaccaggaactacttctgggtaataatttggtcatttaaattcagatctcagtcaccattttccaaaatgggatgggacccaaagccttctggcccgatgatgtcctggcaccagccccgccacctgccccagcgggtccagagcatctccctccacgtcccccatgtggatagggctgtgcgcccgtttactgggcacacgccgctctgcaccgctgtgatacgggccatatgtct

SEQ ID NO: 143567 - DNA, 677 bp, Homo sapiens
atgtagataactacctcagacatttcctaagactttcttagagtttgaaatctttagcactagactcactttggcttaaatacatgatttctaaaaggccactgcacaaatgtacaatgatcacacagaagagatattttcttgacagtttagtataaattagcatgtcagattgtatagagaaggaaacagaaactgcaccaaataaggttgatggagatgagaaaaatttagagtctcaggacaaggagggcaaaaactctagcagcaggaaaacaaagtgaatgatctggacagatggaagcatctaactgctttgttattgggaaaagaataaatataaagttgacgttctaaacaacaagaactagactggtatttcattgctctgtctccagttcctggcagggaacatggcacaaaataggctttcaataaatatttgttaaataaaaaaagggatgaatgagacatttaaaaaatatattttaactgtctctataattgctaaaatttcaaagagtaaagtaagtttcatttttgcatacttatgtaaaacaagagcatcacaaaacataggtgaatcatgttgtatcaggcatatgctgatgttcaaaaaccgtaaggtgacctgtaagacatttaaacctatgtagtaaacaaatgacttaagatgt

SEQ ID NO: 143568 - DNA, 277 bp, Homo sapiens
gaaccccctcaaggccttaaaaatcaccaacattttgccaatcttgtttcatttatcccctccagtttttttattttttgcatttagagggttgttggtttactttggagtattttaaagtaaatctcagacattctaacatttcacccttaaatagttcagtttgtaagagataattcttgacaatctctgccctaaaccatctttggggaacagttcctactcagtggaggacctctgtcccataggagcaaagctcattgagaacacaggagct

SEQ ID NO: 143569 - DNA, 192 bp, Homo sapiens
gagtatagaaactaaaaactgatttataagtcttatgaaaaagacaaaatataatataatattactagagtgatgtccccatttattcatgtgtttctgtgtatatgcgtatgtgaattctttttaaatttgtctacgtccctcatgtgcttcacttaaaaatagccttcaggaatggttactcttcctggg

SEQ ID NO: 143570 - DNA, 781 bp, Homo sapiens
agatgggcagtggagactggaatattgtgtccaagggtgttggcagctggagtttggcctcctaattatagatgtgaagagaattacggtctgcagagggcctggcagtcctggtgctgacctgccgaagggccagatcttggtggtgactgcaacttctctgagttccttgttggaagcccccttctctggctctgcagcctgccaggcttgtggtgagtcatcctgctgctgactcatttggaccttcctccctttccgtcaggtttccaaatctcaggcgtgggtggtttccaatgggctgtgtatttcctgagaccctgagcggaggcagacaatgcttatgtatctggagacaccctaaaacaccaagcttgcttgcgttggaagtcttccagaactggttacccatattttaaagcaaagcctctgatgcccgtcagtcccaggctgggacagtgggcacacagaacatactttgctgagctttccattcaaccaacttgatattttcaggaaaaaacatgctacagtgttatgtagcaagtcaatatgaacatgtctctaatgctcaaagacaagcaataattaagttgactggtttcccaggactgtgctttgtcgtaagacatagttaaaaaaaaaaaaattagtcacaggtataatcccagaaaggattaacaagggactagtaggttctaccctaagtaaggaacctagtataggacttgacccttttccttctctaggcacatagtggggtcacttgatgtttctctct

SEQ ID NO: 143571 - DNA, 355 bp, Homo sapiens
agtgatcctcccatcttggcctcccgaagtgctgggattacaggcatgagccactacgccagccccaaacataggttttggtgggagagaggtccggcaccttccaaggcagggagttgaaactacccccaaagtgggagaacactgggaagaaagaccaggggcatggggggcactttggttagagcccccagaggttctagagctgtgccatgcaaaacagtagctgccagccacatgtagctttttaaattatagctatgtacatttattttactttttttttttttttctttttttttgagatggagtctcgccctgtcgcccaggctggagagcagtggcgcaatctcgg

SEQ ID NO: 143572 - DNA, 359 bp, Homo sapiens
ttcagtaattaagatgaataaagttaaagttgtttattagaagagagtcaatatcacagattttgttaaagttgtttattagaatagagtcaatatcacagatcagttatgactgaggactctggagttggatgcctgcggtttgaattccagctccaccacttgaggacctcaggcaaggggttcaaactctccaagctttagcattttcatctacaaaatggagatcatgacaatcactatctcagagggttatcgcaaggttcacagacaataatgttatcccagacgtcaggaaaagtaatgggcccttaccttcatggatgcacactaggcaccaaggggcctgccggcctacc

SEQ ID NO: 143573 - DNA, 537 bp, Homo sapiens
gtcagaagtgccttttgccctccactatgattgtgagaccttccccagctacatggacgggacttacagtatcataagaaagatagacatttaaatcatctcaacaaggacaatggacatcatggaatcacacagcaggagaacctcgcctagtctaccgatcagatactccatgcagttgtcacctcctctatgaagcctctcctgccccttccaagtagaactgtccattccatctgtggcagagtctggctacatgttcatcaaaccctgtttcaaatatcctcctctgcatgtcattacactgtatctcccagcccccttgcatctacatgaggccgcatgaccacatgctgggtcacttctgggccaaaatggtattggagagtccatcttctccactctggctctctttccatgcaccagataggtgatttttagtgatctttagtggaagatgaaacaggtctgtatctctaaatgactttgtggagtggagcttcccttcccaagctgacccacaataaactctgatgt

SEQ ID NO: 143574 - DNA, 1091 bp, Homo sapiens
  misc_feature (608)..(608): n is a, c, g, or t
  misc_feature (611)..(611): n is a, c, g, or t
  misc_feature (613)..(613): n is a, c, g, or t
  misc_feature (616)..(616): n is a, c, g, or t
  misc_feature (622)..(622): n is a, c, g, or t
  misc_feature (646)..(646): n is a, c, g, or t
  misc_feature (670)..(670): n is a, c, g, or t
  misc_feature (718)..(718): n is a, c, g, or t
aaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaanaananaancgtatnaaataatgccctgaaagaataatngggattatacctgtctgttcttanagatttcatggttggctcagacagaacaatcatctgtttgacttcttnggttcctcatgcagcagaaggaagacagaaagatagaaattgattatttttatgatagcggtattcaggatctcatcacctttgcccgtgttcacacttttgtccatggtaaaatccttggtcttcctacaccctgtcgtacgctcccttggttgatgtcacttgccctttcaatacgtggatgactatcagctagtgcgcgtgacctttctttcataaaagacgcgaacactgtttagattccacgtgtgagttgaaacataacggggaatacaagacgtgctaccacttagaagaggtaatatgcactgcaattctcagtctatgataatctaagcggcagtggcatgattatactttcaattgcagtaca

SEQ ID NO: 143575 - DNA, 322 bp, Homo sapiens
gggagtgggggtaagagatttagaggctttttatttcctaagtgttcagaaaagccacagggtctgcccacagtctcatccctgagagcaggtgaaggactgctgcctatcactgagcaggtgaaaaatgggaagtaaaagtcatggctcttaacattccaggggtcctgctgttgagaatgccttgctttgtttgacactatcagtcctccaagtggtctcacttgccgctaagtgctgatttgtagtcagtggcaaagcatgagggtaatacttttcttccttttgtgttacaccctttagaaggattttccccagttta

SEQ ID NO: 143576 - DNA, 617 bp, Homo sapiens
  misc_feature (593)..(594): n is a, c, g, or t
  misc_feature (598)..(599): n is a, c, g, or t
  misc_feature (604)..(604): n is a, c, g, or t
atgtagacattcacagaaggcttctgacacttggtcatactgaggcatactgaggttcatgctgaggcagattctctttttggtgtttagaactttacccacccaaagctgtgccatattcaggggctttactcctagagccagtgaagttgagagctatcttgtatgcctctccttactacatatcctaaagatctggagaattaagtttggacatcagagaagcatgtttttaaccaagaagcatgttattaaccaagcaccacccttatggtttgaaagagccaatgttcctctccaagtactgaatttaacacaagagaataatatggccaggaaaataagtttaaagtgtcttaacactgtagataaaaaaagttatgattcccagtctagaattaaagtgctctgaccatctaggggaatgacttttacaaagttggtaacctagggagtttgatttctttgtaaggcatagcccacctctgtgatttctagtatacctttgaacagtgtaaagttccttcttggaagaaaggaggcagctgtcatcacgtgccttgttcttgttgaacagctatggagctgctcannttcnntttcnttttctttccccg

SEQ ID NO: 143577 - DNA, 117 bp, Homo sapiens
ttcttctgcacatctccagatgtgttaacataccgtaagttattgatctggcagctagaaagggaggtgatggtaaaaccttagaggggtgtctgttgccttctaagtaatgggtct

SEQ ID NO: 143578 - DNA, 167 bp, Homo sapiens
atttttgtcccatcttctttccacaatatctcttgtctcatcccaaagtcaaatgaagaaagttgcacctacacttgcccttccccttcctgctcacaacttgaattcccctagcttgggcatcacctacacagtgtcaattgttagacgcacattctagtctataa

SEQ ID NO: 143579 - DNA, 413 bp, Homo sapiens
cccacccaaatggagttcattcctcccatctttatcccactattctatttcttgattaatgtaattatgactgggctgatattcagccattgggcaccacgttggcagcactgattgtaaaattacagaaacacttctgggagagttgataaaaggctgctgtcccaagacctccacatgcctcctttctgttcctcccactccagccagttccaggcctccccaggatgtagtcactgaaggattaatgctgggagcagcaggaccctccccagcaccctggccaaggtcttctgttgctcttacctagtcttggaaattctcaagtgtgaatcagaacaaccaggctctaatttgtacttgcactgaactttgggcaaatcccttagtttctctgagtcttagttttctca

SEQ ID NO: 143580 - DNA, 243 bp, Homo sapiens
ctacaagattagatcaggtaagcctatgtactgtaataccatataaattttggtcattaagtccatccaaataagggttgtaataataaatgaagaaaccctgagatggatacatttccttaactaaaaaagaaattacaaggatgagagaaaaagaataaaaatagacattaaccccgagaaataaaaatgacacatgtagatcaacatcataaaacatttgatttttaaaaatggtgatcc

SEQ ID NO: 143581 - DNA, 253 bp, Homo sapiens
caaatggctgagactgggtaaaaggtaagatcagtgataaagaggaggtccagaaaatgacaggtcagtgtatctgaaggatcttctctaaggatactgaaatcatccaagaatcatgatggaagtaatggtgaagaaagtaacagtaagctagtggcaaaatgttttcaaaaagccaaaaagaagccaggcatggtggcatgtgtctgtagtcccagctactcgggaggctgaggcaggaggatcctttgac

SEQ ID NO: 143582 - DNA, 488 bp, Homo sapiens
actaagagttaaatataaaacacatgcctactaacagtgcatatatagtgcaaaataatactactgaaaaataaaaaaattaaatgatttgatataataagcttatcataggcaagctttatggttcagtggcacttagtgcagagatgtatctttaggcatttggagcacccacttttctagattagggtttaggctgtactctacttgccatacagagaacttggggcagtggagatttcccagctccatgcctaggcatacctctgggtaactggtggttgcccattggaccccagctctcccctgccccccatacctggtgcttgtgccctgctattgggagacctgtaggtgggcctgcctggtctggacccacctgtcttggtctcctgctccagggctgggcagggagctcagacacctgtgcattctgcagatcagccccattgcttgaggcaacagagagcttctctgtaaacaaggat

SEQ ID NO: 143583 - DNA, 333 bp, Homo sapiens
ccctaccctctgccttcccttcccattccagtccattgcaccacctggccctgcccccagagtccctccaggacaatcttcggcaaaccagttgccacctctgctgcagcctcctcccctgtggctgcttctgctctgtcccaccaatcagcatacttccatctagtgaccctctttcaaaagttgggattcatgcctcttatggacggaatgtttgtgtgtgtctcccccaaattcctatgttgaaatgtaacccttgatgtgatggtattaggagatggggcctgtgagaggtgattaggttatgagggcagagcccttatggatgggatt

SEQ ID NO: 143584 - DNA, 235 bp, Homo sapiens
gcctcagcccagttgcccaggtagctgactcatctctccaaagacctccttggtccccttgctcctcagatcacacctttgtgcccctccacagcctgactgcattcattcagacctcagacctcacctgcctggtgttggggctgtcaacaaccagccccacccgtgtcccaccagcctgggtcgctccctgcgtcctccttgcctttgtcttgcgctatgcttgccccgccac

SEQ ID NO: 143585 - DNA, 399 bp, Homo sapiens
ctattaggtaagacacaacagctttataaactttgattttcctaaagatcttgatgagttgtctttaactttttattatgaaaaccttcatatattggccaggtgcagtggctcatgcctgtaatcccagcactttggaaggctgaggcaggcagatcacgaagtcagaagaatgagaccatagtggccaacatggtgaaaccccgtctctactaaaaatacaaaaaattagctgggcatcgtggcgggtgcctgtaatcccagctactcgggaggctgagccaggagaattgcttgaacctgtgaggtggaggttgtagagagccaaaattgtgtcactgcactccagcctgggtgacagagtgagacaacacctcaaaaaacaaaaaaaaaaaccaa

SEQ ID NO: 143586 - DNA, 314 bp, Homo sapiens
tgcctttcaaatcccctctcgaaaatgtgcttacagccatggacagtcggcccaggtgtggtagcagagttaattagcaatgtgcacattagacacatctcagaaggctgcatatctaatgcaaatgttccagtgcttaatgttcattcagacgtgtatagtgattgcagcattacagaggacaaagctaggtgctgtgagcttatgagcttggacagagctttcttgtggattcaggaaaaaactgaaaggggcagaatggtgaaatcttttactgattcctttggaattgattcttattgcattaaccggta

SEQ ID NO: 143587 - DNA, 289 bp, Homo sapiens
ccaaagagctgggattacaggtgtgagccactgcacccagccccagatttcttaatgttaaatctagttcatgtaaattagtgccattttattatctaacagcattattcgactattacatactagtaaatggtgatagagtaggatccctgggttagcttgcattaaaaaaagaaaaattctagaccccttcaactagaagaggggaaatatgatgatgaggggcattgacctcaaaatatttgagtatatacaggtgcattaagacttggactattattactaatgt

SEQ ID NO: 143588 - DNA, 315 bp, Homo sapiens
agtgtcctctctgctgcctacctctttgtcaagagtctcaacagtgccagctacctctatgaggtcatggagcggccccgccatgggaggttggcttggcatgggacacaggacaagaccactatggtgacatccttcaccaatggaggcctgttgcgtggctggctggtctaccagcatgatgactccgagaccacggaagatgatatcccatttgttgctacccgccagggcgagagcagtggtgacgtggcctgggaggaggtacggggtgtcttccgagtggccatcagccgtgaatgaccacgcccctgt

SEQ ID NO: 143589 - DNA, 512 bp, Homo sapiens
ggtctggggtgtggcctgcagaatggcctaatgagtacagtcttctggaaccgaaccaaaagtaacttttcatgtgccaagcttctcaagacgtttggaatctttttccatggggcgtcaggagttatatttagaaactaatacagtttcttttcttctgtctccctctctgtctctctctctctccatccctctctccctccctacccccgattttccattctttttaggaggcctattttaaaaacagagctgtgaggttaggagttctctagctgtgcttttccatctctgaatttgcagtaaaatccatttcccaagtatttattgactgcctagtatgtgactggttcttgggagggtgacattggagttcctgtcctgaaagacaggagacaggacacggagagcagtgaaatagatcatatgccttacatctggggttcctgttgtagaggggaaggcagcactcagcaaagacagcatgctggggttgggggtgacagtgggag

SEQ ID NO: 143590 - DNA, 146 bp, Homo sapiens
aggtggttgaaacattaacttcctctaggtctacacggtgctttgcacctgatttggcttgcacctcatgctattctattaatttatttgcatgttgcctcctcttctagactaggtttttgagaaagtgagagaaaaatcaagaa

SEQ ID NO: 143591 - DNA, 405 bp, Homo sapiens
cagatttcctgagaagcctcttatcacagccagcacagacatctgtgcctttcctcgcctgagatgtcaccagctcagggccactccctgccccagccagatcaatgggcctttcacggcttctgagggtggatcctaggagtgcccctgtgacgaatgctcagatgactgcctctctaggatttctgtttgtttctgcttcgcagtcttccctccacccagaagctcccgaatgtccaggaagaattgactaattctctccatgagtttcttgcccacaggacgaatggagccattgctgtaacaaccttattttccactaagtcagaataagagacctggacagaaagagagtaatggctgaggcacaaggagcgagtattttaaatcaggcttatgaatgtg

SEQ ID NO: 143592 - DNA, 274 bp, Homo sapiens
cacaaacaaaaccaagccattctgttgcttactgtaatgtgttatccaactcaccagggatgcaaaatcatttaagtgaacggttcttagcctttcgtgagtttgagaatctgatgaaaactaccaggaaaaggcctatatgtagctataaatgtgtgtatgtaattttaaatgcctaatcccccagccccaccctgcaaatcactaatccttaagttaagaatctcaactcaagaacagattatgggccaggtatggtggctcacccctgtaa

SEQ ID NO: 143593 - DNA, 137 bp, Homo sapiens
tcctaggagactaacaggagagcattaattttgatagagaaaaagatatgtagtattttgagtgttcctgatataactcattttaaaacgtttaacactttctttttagaccggaggatcctttaccccatgttaat

SEQ ID NO: 143594 - DNA, 252 bp, Homo sapiens
aacgattaatataactgaacacattgaaattgaatgatgaatttaataaagtgaggagtaaaaaagcaagtcacagaatagcatttatcataaccttcattgatatgtagtttaaaacatacaaaactaataagggtacctttttagggatatacacatgcatattcgaacttttaagatgaaagcaagggcatgatacacacaaaatttggagaaattgttatttctgaagtgtgaggcttcagagggatt

SEQ ID NO: 143595 - DNA, 756 bp, Homo sapiens
gaaatggctacatttgctttctcatttaacatttgctttctcataccttcccaataaaactcactagtttaaaaggatagttgtattcaaactatgcctttgtaaatggaaaaggttaaagtttatctattccacatgaccaaagcccttactcatttttttctctactagtttctgaagtttgtagtctgatatttgagatgtcttacagaatgtctagcattctgtttgaagttttattgtgttgtttagcgtgaattgaaaagcgcgttaaatgcctaattaggtgatgtggagcatatgaagttagaccatgtggtatatgaattaaagtaaaatgtatgaaaaattacttcatatacatgccatacatgcttattacatatttaatagactttagctcacttagcccagaaaaggaatttaaatatggaaaataatctgttacaatttttcaaacttgatacaactcaaagactttcaatagctagtgggtgtgttgtttctttgtgttctcatgtttaaactattgggatgaagctatattgttgctgataatcaaatcattttcagctggccaccagagtgaaaataatattcaagcgcacaattgaattttgcaacaatataaggaaatctaggatccaaagtaaatataattactttattactcccctagctgggcacagatttaacagttttgttacggagcagcagaactgtattaaaggttgtaaaaagttgaaatgcctcaga

SEQ ID NO: 143596 - DNA, 773 bp, Homo sapiens
gaagcctgagggagggacccagcctttatgagtagcacccttccctttccctggagtaacccctggctggtagtgctgatgtgagagcccagcgaggagggcggcatgtggtccccgacctgctgtggcggggggacgtcagcagcggcagcaggccggggagttagtccctaggcgggggcttgagagtttcttgctggttccaaggagtcggccttgtcctacctctcagatcacctttccagcagaccctgtgggcctgtgctctgtgaggtaaggagggttaccatgggaactgtgacttttgcgtcttcttactgagcttttcatattgtcaattccaaccccaaacatctgccttttgcatgtttagagtccttaggtaagcgtaagggagtgccagctgtggtgtgggatacagattactgtcttgcttcctccagctctccagcctcatcaacatcaatgtatctccaaacatgaggaactggagaagctagggagcttaataaacacgataaattaatcaaattataccagtgtgtcagaggggtggaacgtactgatggcgcacaagcaagattgttgtgtttgaaaccgaagacagaatattcaagatctgcttctcatctcatttcataccagttcttttcagatcatgggggagaagtgtgatcacagaggatcagaattactgggaggggatttaagcattctacacacccctcctctacccaggattataatatgcatgccagggcaggggaacgtca

SEQ ID NO: 143597 - DNA, 811 bp, Homo sapiens
cttgaactcccaacctcaggtgattcgccctcatcggcctcccaaagtgctgtgattacaggcacgagccaccgtgcctgacctgtttttcattgtttcaacaggacaaatacaagaaagacttgactggtatctcatcagattatacttttcctgtgatatcagttttgaacttataatttctttccagctccaagagtctctgattcactgattctaacatgacatactaggaaattctatcaaagcaggggctcctggaacaggtcccgttgaccatggaccacagatgttctcaaggagaaacccacatatggtgatagggtatatgactaaactgcctgtttgagatacacagctttcatgactaccaaatctggcatttgtgtttctcagtagcagatgtgaagaatgagttattacttaatgagcagcaaaatcttattggactccactgcagtgcacagtagctcactctaataagacgaaacaactgtaaaatagtttgtgtgagttcagttccgagtctacttctgacccagttggatggtattatttccccaacctagagatttcaggttactgtgacatccacgaaaagatccaaatgatatttagtagaagttcatatgatgaaatgagaattaaactaaatttggttaaatgttttgagttttacttttgtattagtccattttcatgctgccaataaggacatatctgagactgcgtaatttataaagaaaaagaggtttaatggactcacagttccatgtagctggggaggcctctcaatcatggtagaaggcaa

SEQ ID NO: 143598 - DNA, 749 bp, Homo sapiens
tcatcagttaaggcaggaactggccatctggatgtggcttccgaggcgatcgggcagcgtcagtcttcagccgctaagccgagaagatctgggaaggagtcagagagccttgggccagagttccagggctctgggagtggctgccagaggaagatactgagggtaagaagttgagcagccccctagaagtcacagatttggttttgtcactgaagaactaaatgtaagtaggtatatgtacacagcacaatgatagtatctgctcaaaactgtatttggtaatagccatattgctctcttgagcaaaaattttagccatgcctaacaacactaatttgccagaaacattctaaagatcgattaaatgtatcaaaacatttggagcctagttgatatatgtgattatgagtcaatttaaactattacagaataacaacactggtttttaacaatacaaataaagcaaaaatgtacacaacagcattttataaaccaaaatcaaagtggtggtctaatttggtgtggcctgtgttaaagcttcattcagaactccaaagagagaaagtatttggtatcattctaaaaaaccgggcactatatacttgagaggaataaaacctggaaagcaggcagataacaaacttatttattcaattatttatctaataaatgtctattaaataacttcttcgtgcttgggaaacatttaaatatcaaaccgatcaataagacacacaaaaactcctatc

SEQ ID NO: 143599 - DNA, 441 bp, Homo sapiens
gagttaaaatgaaacaaaggcttggtgttgccctgacggggctccatggctgggtgcgggttgttaataaaacttcgactgagatcctgaggcttttgctgcatgaggacatctaggtgcccaccctgggctgaggggccggccttgtacatgtagttagccattactttcgactggccgctgccgccagctaccccaggcatgggggagctctgtgggctgaatgtctgctgaccaaaagaagggctggggattttctcctgcccaaatggacctggtgatggtccagcagaagagggcaaggctgaccagttggtaggctggtgctgctgctggtgctgctgcatccgggcatgctgctgacgattagcagctatctgtttgagctgctgggcatgggatacttcctgccagcttggcaaggcccggcttgctccggag

SEQ ID NO: 143600 - DNA, 385 bp, Homo sapiens
tcctcggcctcccatagtgctagggttataggcaagagccactatacccagactggattagattttttcacatgacatccgtagagtgcctgtgtgtatgctctgtggatgtaaaatgaacaggcaagagtacagaagtagaatctctagccatgcagtcagacagatggctccaaaattagttacttggttatggagacgatcaagttacttgactttgagcctcagttatgtgccaaatgaggatactaatagtatctatctcaaatgcatatatgggtgttcactgtctctgggagacattttccaaagaaaccaagactaacttgttaagggaatagatttctctcactgatacaggatgtgctctagctggcccacgata

SEQ ID NO: 143601 - DNA, 581 bp, Homo sapiens
gtggcagcacaggttcctaaatctctgagcaaggggatgaggggggatcctgattgcttgtctttttctctctattctctcaccatctgcccaggaggcagaacctcacctggtcagttgcctgctaagacaaaaatatgaacatttttgcataaagtttaaagaaggcccagagtctcataacaaaacattcacagtgtctaggatatcatccataatgacttgacatctgagtaattctcatgtacttgccagggaaggcagccaacagatgccaaccccaagatgacacaaatgttggcgttatcagacaaagattttaaagcagctagtaagaccatgctataagaagtaaaagcaaacattcttgaaacaaacaggaatatagaaagtcccatcagagaaatagaagatacagaagagaaccaaataggaatattagaactaaaaaatacaaacactaaaaatttaaaacttactggatgggcttaatagaagaatagagatgacaaagaaagtcaatgaattgaaaacagatcactagaaattatctggtttaagcaacagagaggaaaaaagag

SEQ ID NO: 143602 - DNA, 332 bp, Homo sapiens
ggttcaagcaactctcctgtctcagcctcccaagtagctggtattacaggcgcccaccaccacgcccagctaatttttgtatttttagtagagaaggggttttgccgtgttggtcaggctggtctcgaactcctgacctcaggtgatccgcccgcctcagcctcccaaagtgctgggattaagtgctgggattacaggcgtgagccactgcgcccggtcagaaatacattttgaatggtagcttaactcatatgggttttattataataagctaatatagatgacgatggtgaccgttttttgcatattttatctactctttgtagcacttt

SEQ ID NO: 143603 - DNA, 412 bp, Homo sapiens
tcgtcggagtagttggggctgattggagtagctggggctggttggagtagatgaggctggttggagtagctgggtctggttggagtcactgggcagggtcatggaggagcatcaagcctcaaagcccctgtagattcagtgttctccctgaacactctgcccctgatattactagatctgtttttcctcctgacactgctgttgccccgatattaaacacaggtgtccatggtccctttccacagatttgacgtcgcaggggaaagggtgatttcaagcacggctgagccatatgcggatgccaggtgcacccccagaacctttccattctgcatgatagaccccctaagctgccggaagtcaggggctgcagaggtgagccaggaagacagaagcctgaattggggccatg

SEQ ID NO: 143604 - DNA, 417 bp, Homo sapiens
ggaacctggagactggggatgctttctcacactcactagtactagaagatggggaaggtgaaccaggctggaggtcgagttaacagggtaaagaggccagggccctagtttcgcatccgccgactggcagctcttcttacgtgttctttcacggaagcccctccttgggaagccccgcgccccacccaccaggagtcgtccctttttgggcggggctgaggcttccaggctgggtcctgagaaagtttggtggccggagactgtggggcgcttaggtaccgacctaacaacttctgcgcctgtttccagggacgagccacgcacggtgccccctgaacacctaacagtcccgggggcagccccacctctggctgggtggacagagacagcctgtgggcgtggcccagaactgaaagc

SEQ ID NO: 143605 - DNA, 440 bp, Homo sapiens
attacggacactagtgtcttggcaagtgcttgtgagatcgttttggtgaaattggaattatgccaatgggatctttccttatgaatggatgatggtaaaattgaagcatgtcactgaaaaaaaacaaaacaaagatgatggaaaataacaaaggttgaaaataacagagataccaaaaggcccatatactgtttatgggagagcagctttgtacagatactttagaaagttgtttggcagcaccagtgcgaaccctctgatctagttctaggaatatacccaacggaaatatatacatatattcactcaaagacatgcataaagtatttctaacaacagaattttaatagctgacactgggagctgccctaatgtccatcaatagtggaaaaaaaaacccaattttttaaaatgttcacacaatggtatactattaagaa

SEQ ID NO: 143606 - DNA, 365 bp, Homo sapiens
gagataatggaaccatgggggtggcttcccccatactgttcttgtggtagtaagtaagtctcaggagatctgatgattttataagcggaaacccctgtcacttggctctcacgcctcttgtttgccaccatgtgagaggtgcctttcaccctctgccacgattatgaggcctccctggccacatggaactgtgagtacattaaatccctttcttgtgtaagttgcccagtctcaggtatgtctttatcagcagcatgaaaacagcctagtacagatgccaacaaaacagagcactgtgtttggctggaaggccctttaaggaggtccaccttcttaaactaaagcaaagaaaaacaaccagagcc

SEQ ID NO: 143607 - DNA, 181 bp, Homo sapiens
ccctcagatccttccccttctcctcaaattccatcatgctaagattatctaaacttttaaatctgcattattatgagcatgttttctctttttctttgatcctagtagttgtttaaaaaataacttttaggctgggtgtggtggctcacacctgtaatcctagcactttgggaggccgagg

SEQ ID NO: 143608 - DNA, 443 bp, Homo sapiens
cccctgcttggtcacctgttggaccaacactaggtacaggaagtgcaggaagctcagtttacaaaaagtcatctggtgcttccagctgtatgtagcttcctctgaaagaaaaggaagcgtggggagtgtagaaagcagttagttcttcacctgaggctgcagttccaaaactgaatggaaactgtggtgtttgggaagtgtgtttgactaaagtttcctttcctcaatttctcaaaggaaactgtgactcttcccccaccatcttccaccccttcagtttccatacatacaagaaagaatgatgtcctggagcaacctctggagaacaactgtggggcctccccattacaaaacagcctcccctgtgtgcaatcagaattgctttcgtctgggcagaaccatacaacacacagctgggctgtgtggagagctgtggccgactg

SEQ ID NO: 143609 - DNA, 267 bp, Homo sapiens
tcaagcattttggggtgtgctgcggacaaacaatagaatgaatctttgtttctggagcctgggccatttctaacgaggaagatgattactcatttttggaagttgggttaactcttccagagtcttttgactctcgcttagatctgtaacgaaaagccgagaagagttcaccttggcatcccaaggtgtttgctttaaagccgggtgactctggttggctgtgtcatttcctctttaacacccctccacccaggtctttgccctaag

SEQ ID NO: 143610 - DNA, 332 bp, Homo sapiens
cttatccagcttgaaccggaaggcggagttgagtgagccaagactgcaccacagcactccagcctgggcacaagagcgaaactccgtctcaaaaaacaaaaaacaaaaaccttagaaaagcccctgccaccccagcacacgcacccagagcagacctggtttggaaatgaaacatcaaggggaaaggctggggctggtggctggaggaagaagtcagaggggctgtgacttggcgtgcctgcctgtggcccaggaccacgtctccaggggaagcacaccgccaggcccagcccctgccccatccccatctcctgcccttcccctagccccca

SEQ ID NO: 143611 - DNA, 156 bp, Homo sapiens
gaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggc

SEQ ID NO: 143612 - DNA, 795 bp, Homo sapiens
aaataaataaataaataaataaataaataaataaagtccaaaccaagaaccttaaaaactttcactctactggaaagttatctgaagtcccctgtacaagttatctcccaatttaagtcttcttaagagatttctccctttcaacctatttagttttacccagttggagccagacagggagaaaatgtgggaggacgaaataaaagggagaaaacaaagggctcggcagaaggcaaagtggtgcagctgcctgcccccagtaaccaagggcagaccctatccatcttaccttctctaggttgtaggtgagctcatagtctgaattcacaaacagaatattttcaggcttgaggtctgtatgtgtcagcttgttatcatggaggactgtaggggagaaggccaggtcaggcttggtgcaggtggccagagctaactggtatcagctgaccccaggcctggttacctagggcaaagccagtgaggagacaggtccagaatcactagggctgctttctgctctacgtctaaatggaatgcctggtctaagaagctctgctctttctaatgtaagatacatatgtagctcaactgatgtaaaaaaaaaaaaagtttgctttgagttgtagtgtgtacacactttgacatgtgtctagctggcattatgttaactcaattctgtgaaactgtattattttgatgactccagaggaatgatatatttctttgaattccccaccttgccccttagctgaactacatactctgtgttcccatctcctttgctgtgaatgaaca

SEQ ID NO: 143613 - DNA, 304 bp, Homo sapiens
cttggccattcatgttccctgagtccacactgcagatgtctagaaacttcgcatttccactttttttcttacaaaaatgtcattcagaatcacatttccactttctggggtaactaatcacaccctctcctctctctgcaaagctccaacatgacttctttccctttttctttttctttctttgctttgagacagggtttcactgtcaccgaggctgtttagtgcagtggcttgatctctgctcgctgcaacctctgcctcctgggctcaagccatcctcccacctcagcctcctgaatagctt

SEQ ID NO: 143614 - DNA, 404 bp, Homo sapiens
ccagaattttcacaggcaatttgccagagaaagctcatcaagaaaacagtactgtaatttcaactttgaactctgaactatacattgtgtgaacttgtcaaatgctcatcccataaataacctcatgctctttctaaaaatcttgccaaatagaatgaatctgatttactggaaaaaaatgtttaaggccaagaaaaacacacacattgtgtacagagtgtcaataattctggaaatattagtttacctctattcatgttttcattttaaaagaatgcaatgttggcctggtgtggtggctcacgcctgtaatcccagcactttgggaggccaaggcaggcaaatcatgaggtcaggagtttgagatcagcctgaccaacatggtaaaacccccatctctacta

SEQ ID NO: 143615 - DNA, 118 bp, Homo sapiens
aaaggatgatgtaaatggcaatacgccattatagaaagaatctaggaaatgtgatgtatattcctttgcactggaaattttactggggaatacttaacaaaacttctggcttgcgatg

SEQ ID NO: 143616 - DNA, 330 bp, Homo sapiens
cttgggactagcctatcccgtgctccaccttcaaaccgcagctagtctgaacagccatgggcagtcgctgcatggctgggatgggcatcaagtcctggagctgccagccttatgatgagaagcaacccaggccgcccgcctggcattggggtttgagcagctgtctgcatttgacactggcaaagcatccctcctccccgagcatctggcccaaataagggagtggggactttgggacccacatatgttctgaggggagggcagcatccacaggggaggtgtgtgttcagccgagccattgacatggtcacatctggttctagttgttgg

SEQ ID NO: 143617 - DNA, 377 bp, Homo sapiens
gtcaccagaggtctcattccatccctggttttttcattactcctgagtgctgggagaattttagaaatgaagaaaaattagctcaaatgaaaagagctgggtgtggccgggtgtggtggctcacgcctgtaatcccagcattttgggatgccaaggtgggcggatcacctgaggtcgggagttcgagaccagcctgaccaacatggagaaaccctgtctctactaaaaatacaaaattagctgggtgaggtggcacatgcctgtaatcccagctacttgggaggctgaggtgggggaatcgcttgaacccgagaggcagagattgcggtgagccaagattgtgccattgcactccagcctgggcaataagagtgaaa

SEQ ID NO: 143618 - DNA, 450 bp, Homo sapiens
tggtacttaatgataaactgataggaaactgttgacaggcacttttgagaaagcaaagctctaggctagatattatcattcattcaaaattataaatcataaagtgaaacaacaaaattcagtcaagcagggttaaatttcctcctccacagattgtaacccttaatctccaggctacagtgattgcaatgcttgatgtagaaattctttttcattcactgtcaaaataaatggaattttctcgaaaacccatttaacccattgaccataagtttactggccacaacttgttataatagtttatcccacctctaacaaaacctctagattattctaacaatagaaaaaacaatgctagcttttgctccctcattagtttgtgcaagttacaaataacgatggtaacaaatttatatttaaaacatgctgggtgcggtggctcacgcctgt

SEQ ID NO: 143619 - DNA, 349 bp, Homo sapiens
ccacagccattccaatgccacccaacataaggaagagtgtaacaaaggggaagtcaggtaaaaagacggcaattttagctgactgtggtttagataacttacatttgcaaattcttcaaagatatgtgaccacatactggcaatgttctgtttcttgatctggatgctagttatatatgtgtgttcagtttgtgaaaaatcttaaactacacacttataatatttatgaattttctcattcatatattatataccaataaaactttttaaaaattaaccaagtgaacacattgctagggtccctcccagaccctcagattgggtcttgaaaattaagcttcaggctggg

SEQ ID NO: 143620 - DNA, 265 bp, Homo sapiens
aaaaaaaaaaaaaaaaaagccaaataatgaacttttggtaaatccagaagttgatacatttttattattaaaccaaaatcttggcaacgatataacattgctttgacttttccaactgtttttggaataaaaatcccacaaaagcaataacggacatgtgctagtcatgttgatggaaaccttaactagtgatactgcaggcaatatctagcaatggtgtttctattttagtatttttttcttttttttctaataacattcaagt

SEQ ID NO: 143621 - DNA, 163 bp, Homo sapiens
cccaatgccctctaggagctgccctcagccaataatgaatgggagctgacatataaatacccatgcttccttgcccttctggtggggcaacactgaggtgtattccacgtcatctcctagaaatccgtaagccccagttgcccacagcagtaacctgcacatg

SEQ ID NO: 143622 - DNA, 474 bp, Homo sapiens
acaggcatgagctactgcacctggcccatggaagaaaataatttttggttgttaatttttaacatgagataatgctaaatccactagttacattaaaattccttttgattcaaatatgcaggatataatcaaattactgttcccttgaaagagagtccatggttaatacaaaagacatatagttgatttatgtcaaggggtaacacaggtaatgctttgaatactcagcataaaacactttaatggaatattattgctccaaatataccataccaaaattaaaccaaaaatagaaggctacttaatcattgctgacagggagccaagtacagcaagttaaagtacattcctaccgctcatctagttctggctgaactcttcgggtcagtttgggtcattattagtttggaataattccaaatgactccctcgagttctactgttacattcagcggctttaggaattccagaaca

SEQ ID NO: 143623 - DNA, 202 bp, Homo sapiens
acacattcgagctcggtccccaatagagcaatgactcgaaagtaacccgagtccctgaatgactgggtggaagataccattcttggacaaatgtgaaagaaagaaaatcatacatttgggctttaacttattatatcatctgatctctctgttacagtagcaattatgcctaattcaccttctccttatccagtgtagttca

SEQ ID NO: 143624 - DNA, 411 bp, Homo sapiens
agtatccacgaaatctactgtgtaaattggcccacactaaagcatgtggaaaacattttttggctgaaactcgaaaccattcatgtggctttgagactgggaagcttgggctgccaacatcaatagaactttgtactacaaacccaaatggtcatttagacatgtgtacttctctgctcacaaatgcactgaggtcaaatattttttaatcttgggaattttttctctttatacagcctcatatttcatgcaggaaatgagactgagtacaacaaacacaaatcattgagactgacagagcatattgggttcaaaacccaagccttgactctaattgctctccaaaggcccctggctcaaggtaactgttgatttagttcagctgttttcaatcagcactgtaaggtctca

SEQ ID NO: 143625 - DNA, 496 bp, Homo sapiens
ttaattataagtggcaggttaatcataggcaaacagcttaatgagttttatcagagtctacccagacaacagtaaccataccagtcattttaacagggtgaacttaatataaagaactgttaaccagtgaggaattgaatatacagacaatggcaagaccatattcaaaaatagaactctgatcaacaacctctgcagtaaatggccaaaaatggtcagggcttggtcaatgatgaccagtttccctattttttcctctgctttcaactcaggaccaaccagaaaaaggcaactatgttctccaaaccaatcacataagatgccctcttctagttagtccacctccagctttcttatgctaacaacctgcaatcaggacatatctggagcctctccctttttttactgcaaaactttcccactcacatgcctgctgacagcctctaccaaatgcaagtaatggtgggtgactcaatccaattaacaagctctgaat

SEQ ID NO: 143626 - DNA, 510 bp, Homo sapiens
tacatgcagtgcttgtgtccaattcaaaatgtgtagttcagtcagtaaacggttcagtgcttcaattatttcctctagtaaatgggaataatctattcccagtatcatctcacaatgataacctatataacattaatccacttgagaagtgctctgaacttcttagagaaaaagggcatgcagacaaggaaaggagtgcactgaggtacatggtctaaaaccggagataaaatcataagagggtctgcatcaaattccaagagaattcacatctgcatttgtgctacttattttttgtgccctggagcaaactgcaagaataagtgatttagtgatatactttacaattcaatgtctaaaagttccaaatgtataagcagctgtgaaaaatttaggacgtgacactagagcattggttctctggctgacgttagaatcacctagcaaactcgaaaaggaaaaggccaagctgcgcctccagattttgattcaacagttattttcagcagc

SEQ ID NO: 143627 - DNA, 172 bp, Homo sapiens
agcatggctcataacctacaccaggcactgaggtagtcaggaggggtgtgagagatgtaagtggggaaggtttcgtggattcctaagtggctctgatcggctgggtgcaggtttttgcattcacctacatacactcacattttctgcatctttaaaaaatttcttcagacat

SEQ ID NO: 143628 - DNA, 385 bp, Homo sapiens
tcaattacctctccattcagtgagagaagtgggcatgcttttcaagatgaatttgaaggtgcttaacatttttcttcagttttaatgctcatccccccaaacctggatcagaattccctcttccagcaagcagagtccagttttgaagcttccttaatgagagctaccatttcttcttaagttggacagacacttgggggaaaaaattgctagtgatgatgaacaaggagcttcccattgggcattgttggtttttccttaaactctggtatatatttactctaggatatatcctttttatctgggtcacacacatcctattacagtagtgtggtgtcctgaccaatggcattcactcaggaactttttagaaatgtcaactgtc

SEQ ID NO: 143629 - DNA, 326 bp, Homo sapiens
gcaaacttgagaaattgcagattgccttcctgtgattcacccagaattccagatggaaattatttctcaaggtcagtgcaaagctccgtacaaaggtgtctcctatagagaacatgtggtgtgaggctggaccgagggtcaaggcttccattcctgtttgctccttgaccttggcagagttagcctgcctccgagagcttctctctagccgtaggggaatcacatagtttgtgcctttcctccccacacacccttcccaccatcccaccccaagacctgctcctattttctaggcttggtgagggcactaaggaagaaatatgcct

SEQ ID NO: 143630 - DNA, 147 bp, Homo sapiens
ctgatacttggaagttggattttagaagctatttgaaacattaaaaatattaaaataatggtaatacttttgagattaatattgaaactatctgaaaatgattgcttattgaagtaaatatttcttagctctggggtgtcaatacta

SEQ ID NO: 143631 - DNA, 545 bp, Homo sapiens
ccccctcctcctggaagcccgcctgggcctaatcaccctctgctcctgacccagcctccaagcccagtgcccagggccttttcctccctgggttcctgtcctcaccttcctgctgccatgtctaataagtcaccacgcttcagatgcaactgtgtaccctgcaccagctgcacactgcacccctctccacccagggccatggcccagctgggccacacaatctccgtggacccctgctctcagccctcggtcctgcagctgcagagcacacctggtcctgccactctccacgcagaccttccaggagaggtgtggcctccaaaaaagcccacaccctcacatgggtacacagcccccccgataccattggacccccctctggctgccatcctgctcactccctgcatgcccccaccccaggcacgctcggctcagggctcactcacacatgtggcactaatatgtgcacagggtcctctgagcatctgcgcgtgctgtgccccctgcctggaatgcccttcctcatccccagccggtgttcaaga

SEQ ID NO: 143632 - DNA, 458 bp, Homo sapiens
ccgcgcacctgtgattaaaacctccctcccttggcaacatcccccctcctccctgcacccatttaaaggcctgacttgggcgaccaatgccttcctccattcactctctcgcaacagcaaccgcagaacatgagcactacgacagacgcggagtgcgactttacaacttcctgtcttatctcagggaaaccagggccattctgggctggggtgaaaggttcttccggacagtggcccaatctttagccaggcaaaggtttggtaacctcaggacaaaatggccctgaatttccaagtagggggagaccgtaacaaaccatatccgccatgctgcctggttcatggggttgttattgtgccacgtgaggtttgcattcgtgcctggagccctactgcccaattctgatgtttctctagaggtaaaattaattcatggacccccacgtatatgagcagtc

SEQ ID NO: 143633 - DNA, 126 bp, Homo sapiens
taatgaaataaagtcattgggaggggatttgtttcataattttttggtcagtgctataatacatgcatgtatctgagtatctgaatggcctgggtttttgttagtgggttgttttttttttgtttt

SEQ ID NO: 143634 - DNA, 513 bp, Homo sapiens
ccttctattttctcctagaataacaactcttctggcttctctttccctatgtaggctgaaaccaataggtgatcaactcttctctctttgactgctatccttctaccatacccattcaatgtattcctgaaccaaggatcaatactgtaattcatcatctccattcctgagtgttagcaggaaaaacaaatcagagattctatacaggctgacaatattataaaatcattatcactaacctgagctgacttctcagaactgccctccaatccttttactttcccttggtcagctccatctcaaattcacttcaacataaactgtaagtcttcaccaaaccactctcctcaatgcctctaacctaattccaccactactcacctccctcagcagataatcttgcttttacctcaaaactgatttctctcaatttcctctctacaaacttatctgcatccactcttgtcatcttgggctcaatcaattcctttttcccttcaagtcacacaaagg

SEQ ID NO: 143635 - DNA, 198 bp, Homo sapiens
atctcactatggtcctcaagacttcctgaggcttcatttgttcttccaaaccaagtctaataggacaagctcgtccatctttctcccatgggtgatgctcaagcaggagtcttggtctggaatcattaattcctgcaggtgctactgacattagctttgtagaggctagtttttcagtggtctgaacacctgccatgg

SEQ ID NO: 143636 - DNA, 378 bp, Homo sapiens
gcttgggccaggagctgtccaccagaatcaatcgtaaccaccattataagaacagcttgtgtttccagagcacatcccagtttacaaagcatttcccatacatgggctctgattcctactcaacaacctcttactgaagagctcaaagagaaagaggttggaccacatcatccccaatggacaggtaatgaaactgagaatgaaacttcagagagattaggtggctttccaaggtcacgcagctggtaaatgtgagccagttctctgactcccaatagcagcctcttgcatggattcataccttcaggtctaaggccacggtggggacagaaactacttagctccatgtgcactcctctgccaggacagggaagtgtg

SEQ ID NO: 143637 - DNA, 1319 bp, Homo sapiens
ggcacgagggcggacgatgccaagtccagcagagcttgcgctcggggctagaagagagactgagtctcccttctcagtttcattaggtaatgggcgacatggctccgtctccacagcggggctttgctgagcttagcacgcagtctcccggcggggaggaggcgcgcagtgccgggcgccactccgtctccagtacgcgttaggcccgcgttcccaggtgcccgtctggccgctggactgttggcctttccggagcgagttttactttaggaagaagcccgggatcccggtagtttagcctgaagaaacgtggggcagatgctgggcagggcggggataccgcgccaacacccgctgcccagcggtcgccctcctatgcagcggcgaagggacgcccgctgtgtctccgccctgcccccaggcgccccagtggctggaggtggcattctccactggacgggcgcgcctcaatccgggggacttccacagtgctgttcccgaggactacgcgtctcaactctttgtcgggttccctccctcccactgccagtctgtcttcaccgccgcgcagacctggggccgcccttcacagaggaagggctccttgacctcagccaccgtgaccccctcctttgtgtcacattctcagagagttggagggattatgcgtcatcgtaaacagggggacagagcgccttccacctgcggcgcatccattaagttccagttaccctcgagaggattgttttttccacgaaacccagatgcaatgagagcctggcttgtaccatctctaagcatcgaggcttccccctcgtctgggtggtggccttcgggcagtggctccggaaaggccatcaaggcttccccgtcgtctggatggtggccttcgggcagtggactgtgtccatagctgaaaaccagacttgacagttctggattcaggctgttgtgggagcgggaaggtcaaacacccagaaggaactgatgaatgtgaatttccctctaagaactgctttgcctggccgggcgcggtggctcacgcttgtaattccagcactttgggaggctgaggtgggtggatgccgaggtgagtggatcacgaggtcaggagttcgagaccagcctgaccaacatagtgaaacccccgtctctactaaaaatacaaaaattagccgggcctggtggcgtgcgcctgtaatcccagctactcgggaggctgagacaggagaatcgcttgaatccgggaggcagaggttgcaggagctgagatcacgccattgcactccagcctgggcaacagagtgagactccatctc

SEQ ID NO: 143638 - DNA, 308 bp, Homo sapiens
gttatccatagctttcatcagattcattaaaggcagggtatttgagccagaaaacaattcagcacagtcagaggccaggtcaccagtccctgtaggtgtactgttcactctagcctctacttattccgtatgtctttcctgtaccaacatgtagatgtatggatggtgcaaaagagtatctgctttttaaaatcccagtagagttataaattcttagagtagaactcttagtttagaaacatctttcctgtatatcttcatcaaataattatatttctcctgtgattgtttcgtgtctgtaagttggt

SEQ ID NO: 143639 - DNA, 272 bp, Homo sapiens
gttacttcagactgggtaatcagagagcagactgctgagaaaatgacaaatgagcagaaatccaaaggacaggaagacaggcagcagaaaaccagagaaaaaaggttttcagacagagtcatagcacaaagttgtataataactatgttcaaaaaaatgaagaaggcccatctggctaaaatgtagtgaaaataagcacagtttaagatgaagttgatttggtaggcagggactcagtattttttttaatctaatttaattattcttcctta

SEQ ID NO: 143640 - DNA, 401 bp, Homo sapiens
caaaaccacagacctagctcgaatggaggggactatgtttgagaccacagataaaggtcatgccaaaagcaagtgatctgaagttagaagttctagtcctattcccaaaacttactatgatgaaaggagagtaagggagagagagtttaggtggaggcactccgtgtgagccgctagcacagcagtggcacacacaggaaatgcttccatccatgaatcctggcactgagtagatgatcctgaccaggtctccaccactagctgcaggaagcctcatccttcggcaagagcaatgagaaatggcctgaagggcactgaactttttcctcgcctaagtcccccaactttttctctattaactctgcctcagtggcataagctccaaataaatttcttcctct

SEQ ID NO: 143641 - DNA, 549 bp, Homo sapiens
aacttaatgcagactctttgccactgaaagcacccagaactaaagccaaaagaccctacgcaacatatattatagacaccttctgaaggggagaaaaatcacatccaaatgaaagcaaattcaaaaaataaggagagacggcttatctagatgagaagcaaccagaggaacaactctgaaactatgaaaaaagtgtgttaacaatgctccagaaggatcacactaactcttcagcgatggatcctaaccaaaattaaaatctttgaaatacaagataaagaattcagaatgttggttttaaagaagctcaatgagatccaagagaaagttgaaaacacacacacatcagaaaaacagtttgggatatgaaaggagatatcactaaaaataaacccaaacatcttttggaaatgaaaaattcattgaaagaattacaaaatatagttgaaagctttaatactagtctagagaaaggagaagaaagaatttcagagctggaagacaggtcttttgaattaacccagtcagatgaatttaaagaaaaaaaaa

SEQ ID NO: 143642 - DNA, 168 bp, Homo sapiens
aagccacccgtgtacaacctacacccataccccaaccacagactcacgcagacggacacacaccagcccgatacctcatacactattgcgttggggactgcgctttcaacacatcaattttggaggacacattcagaccatagcacaactccagcaaactaatgtaga

SEQ ID NO: 143643 - DNA, 345 bp, Homo sapiens
ggctatggaggcaacccacctgtgtgggaatccaggctccaccgcctactcaggcatgtcactgaactctcaactaagtctcagtttcctcagctgtgaaatgaaggtctggtaattaatacttatctttcagtggttgagcattaaatgagaccatgtgtgtaaaacgtagcacctggtacatagtaagctttccgtgtattgcaccaccaaaattttatggccaggatattaggaggcctctagattgaactggaaggggaaaatagctcttgttccaattgaatatttggctcactcactcaacaatcatttacttatttatgataattatatcgcacagaa

SEQ ID NO: 143644 - DNA, 655 bp, Homo sapiens
atgatggagaagacgaatctgtgccctcagggagcaccgcagacaaccccctgttgtggcttcactgccaagtgcagacgaaacatggggctggagtgtgacattagccagggaaagcttgttcctgatctgggtctccgtggaaacagtgaacgtgcatgtcaaagatgaggcaagatggtaatcccgatgagggaaaagtcatccacttagctggactagggaagagttgggagtggttgggaagggttggagtggtgggggcttcagttccttccctcctccattctttcgttcaacatttacttccttgccaggagcttctcttagaagctcacagttctgtggtagatgaagagtttcatatctggtctcaggagttcaacttagatattacaataagcagaactgaatcaggattcaaatctgagctaaagagctcagttagctatgtaacctagtagtattaatcatttggtatctgtgggcacattctttgttaggtgctaattaggctgaaaggcatgctctccaggaacttaaattataatcactgtaacagaaagtaagaatgttattttcccctaaaagagtcaggtgttaaggaaaacacactccgtggcagtgtaaccctttaactgcatctggaaactgt

SEQ ID NO: 143645 - DNA, 225 bp, Homo sapiens
cacacgcacttgtagtccatttgcaccttacttataaattctgtttgaatccaattcagtcgttttactaatatattttcaaatgaattggtaaaagctgcagtcttagatttttgcccttttacttgcaacctaagatgtaaaaactgaacttcgatcaagaaatgtaataacatttttaagagacttaatgggtgtgtttcatttttaatattggaatgcaaa

SEQ ID NO: 143646 - DNA, 359 bp, Homo sapiens
tccctgaaaaatcaagacgctgctaaaagagtcaaactctgaaagaaatcccaaagatacatcactgcttgacgcaaacatttttaagaagtcactgattataatgaacacagcctttaatggcagtttttcatctccttttcacaagaatgtgacagagtgtcattaaggttttagaaatgaatgctcctaaggaaaggaggatcactaggactacaatgatgctcagtatgtggccatgggattctctgttgggctctttttaggtttttaatcaggttggagaagggagttagagaggaaaggaataggaacagacaagagctttaggacacctgtacaccacagtattttacttt

SEQ ID NO: 143647 - DNA, 192 bp, Homo sapiens
tccaaggggagaaatactggattcacaacttaaagacttctggagtttgaagagtgccggaggtcgtttatcagttgagctaatagcaatcccaaaaccttgccattcagcccctgcttgaatgccttgagcaacaggcccctcaccatctcttgaaccattttatttttctttgagtaatccaagccttat

SEQ ID NO: 143648 - DNA, 317 bp, Homo sapiens
caaagttacctcatcagcaacaaggaggaaggaataccagaaaagctcttgtgggggctgaaattccatgtaaagagtgatttctctcttctaggttatctattgtggggtaacacctagagcagtatcttattcatgatttttatactcattaagggaaaaaaggaatctagccattcaaactacacatgtgtaacaacacatattatttacaaagcaacttaagttggttaagtctaatggcaggtgaattcattttagaagcaaccgagggaatgaattcaatttgaattttttcaaatgaagagaatgacata

SEQ ID NO: 143649 - DNA, 442 bp, Homo sapiens
caggttacaatacattactcatgatagccaagataatatatgtaaacttctaagtaaagagaaagcagatactattataaaggagaggactttcacagctgctcttaggaagtggagagaacgttctcaagagttgtataaagcttttagggttttttgtgcccagttttattggctgttttatccctagtttagagattctgcctaaaaagtgactcctaagttagtaaaggcctaagatcgaaatcctgttcataaatcatgctaggtaacgcagttcatatatgtgacaaaagtataaccatctttttctttaaaaaataattattcttaaaactgacaacacagatgcagctagatgcagctaatttgaaattcctgtctcctttttttcttttgattaaaaaaaaaatgcatttaccagtactgtcagaaaaaaaaa

SEQ ID NO: 143650 - DNA, 514 bp, Homo sapiens
cagatgcgaccgaatgcgatatcaggagagaaggctggttgtattataagcagattctcaccaagaaggggaaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccgtggggcatcaacatcatcaagaaaaataagaaggccgctccgagggcgtttagggtcaggctggaggagtgccagccagccacggagaaccagcgcgtcccctaatacggctgcatgctatcgcattcggtctgtaacctctaggtcag

SEQ ID NO: 143651 - DNA, 355 bp, Homo sapiens
tctgcctcctgggttcaagtgattctcctgcctcagcctcctgagtagctgggattacaggtgcgtgtcaccatgcctggctaattttttttgtatttttagtagagacagggtttcgccattttggccaggctggtctcaaactcctgacctccggtgatccacttgccttgtcctcccaaagtgctgggattataggcatgagtcaccgcagctggctgaggtgcttcttattgcaatgccccatccagtaaattaatatttttgaggatcctggggtttgtcagttactctcattatttataacatggtgcaaatggagagtacttctcattccagccagttagattcactc

SEQ ID NO: 143652 - DNA, 768 bp, Homo sapiens
agacagttgccaacaccatcaacaagttgcaaaagacaaactcctaaggtagctctgccagatcacaatgtgctgctcttactgacatcttcctcttgtgcagggtgagttccaccagcctcttttgattttcatggggcaagctaaggttgatagggtaaaccacagtgcactcactgaccatcacacatcctgcagctccattacagtaagactttagttaatgtgtataaaactttaaatgcttaatcttcacttaatgcttttttcaggactttatgtatttgttattactgtgctatacagtataaagcatgttcacagtattccgtgttatgtgagtactgtatatgtatgtgtattgtgtgcatgtgtgtacttatgactgagaattaaactagtacagtcataggagtacataatgctgtaactgaaacacagtgtttattataaagaaatactgcatatgagtacttgtaagaaatttatattaaataagctatcttcaaacaaaaatacacataaaacaaggttatgtattgattggttggcaaaatgttctggccagagtcttcgtggatcctaacgctatatttctcctcagagcagtgttgcatttgtcagtaattcaatgatcaaggtaactttctagaacataactaccacaaataatgataattgactctacatttaagagtattaagccataagaatctaattgctatgatttttttctgaactgagttaacacaactattatgagtacac

SEQ ID NO: 143653 - DNA, 1063 bp, Homo sapiens
agaagtcaaattgatagaagcagtagaatggtggttgctaggggttggggagatggggaaatgagttgtttaatgagtgtagtttcagctttgcaaggtgaaaaagtcctggagattggttgcaggacaatatgcatatacttaatgctactgaactgtttccacttaaaaatgtttaagatggcacattttatgtgatgtgtatttttaccacaattaagattgtaggacaaatctgcattgcatggttgactctagcaccctgttgcatatagaagaagaaatctcattaatccagggttagggttttgctgggccagtgtagaataaggtaacaaggggtactattgagggtaggttcacgtgagtagttagttctgatggaggagatggatagggaaggaataagaggttaggaagaggtcttaaagagtaggcatactgggaaaatgccaaagacataggagattgtaatcagactaggaaacagaggcttgtgtgtattctgtggaagtgatacttatctacattcattatgaatggaaatctgttggatgggaagcttcttaatggttggttcaaatttttttgtacttcgtgttaatttagggaatgaggccaaatacctggaatgtgctcagtgaaattatcagttaaataatgtgtgtgtattgtcacatatctggaagtagcatcccctacagaaaatgcctttggcttgctcttcttttccctctgtgctcttattctaagccacacatttctgaggtgtttgctgagtagtggacagaattcatatggttcattcccatacccttcttgttgtctaagggggattgatattccactgagatttggggataaaattatagatattgacttcacccttgtagattctgatttcattgcttttgggtagaacctgggcatttctacttttaataagcccttcagatgattctgatatacaccaaagttgcatgactgctgtttgagagataccaatttgtctttctaaagttagaattgccttgctagatttccctttgctgtataacatcac

SEQ ID NO: 143654 - DNA, 990 bp, Homo sapiens
cagaaatttcccccatgcgttctcattaagagaattgagtaaagtcatgaacacccttgcaaacattattacagtattaacaataaagagcttcttaggaatctttcttataatgaccctcagtctggccaatgacatcatagcaacaaagtgaaatacattaagaacaattcctcaggtggggaccagagcaaactctggtttagaccccaagaaactcatccagtagaagggctgagggatcaaccctcaaagtaggtgctgttccaaatcaatgctctaggggtctggaagctcaggtgtggaagtgaggatcagatatggtaggtctggcctgcttttagtcttttttcaggtatgtgatagtatcttcattctacttggtgatctgtctaggttttagtagaaatttagactgtggctagcactacagtggaagggattctctctgctgggaacaaggcagagtcccaagcattgggctgaagttacaggcatagttcttgttttggttggaaacagaggtactgatcaagaaaccaaagtgaacagccagtcacatgcatagagttagggcagggatggtgggggatgtgggattagcttgatggacttagggatgtgctggttcactcagttaggatgcaccaagtatcacgattagtaaggatggggctggaaatatacctatgccaggctctgttctcattggctcagcagtggtccccagtgtgtagaacggaatcgcctggggatgcttgtcagcatgcacatccctgtgccctacccaggacctcctgagtcaatgtctttgcaggcagctgcgggtttaacaacctccccaagtgcttctgatgtagactaaaatttgagaaccattgaattagggagtaagtggatgaacctacaggtttgagatataagtatctgttcttaggctgacttgaagctaacattggacacagagcaattttagtgggacttagagga

SEQ ID NO: 143655 - DNA, 1097 bp, Homo sapiens
agcgggccgggctggctcggggagcggccagccgcctctgcgggggtgtgccgggagcgggtggagcagccaccaacctcacccactcaaagaagcagggatggccaggttccaacagcctgagtggctgccacctgatggctgatggagcagaggcgtgaggaaaagctgatggcactgctttgtagtgctgttctttgtctctcttcatctttttcagttaaagtctgttttatcagagactaggattgcaaaccctgcttttttttgctttccatttgcttggtaaatattcctccatccctttattttaaacctatgtgtgtctttgcgcatgagatgggtctcctgaatacaggacaccattgggtctttactctttatccaacttgccagtctgtgtcttttaactggggcatttagcccatttacatttaagtttagtattgttacatgtgaaatttatcctgtcatgatgttgctagtttttaatttttcccattagttaatgcagtttctttatagtgtcaatggtctttacaatttggtatgttttgtagtggctggtactggttgttcctttccacgtttagtgcttacttcaggagctcttgtaacgcaagaatgtggatttatttctggtaagggtaaataagtggatttatttctcaatgctgtattctatgtcctttaccccaagaatcattactttttaaaatgcaattcaaattagcataaaacatttacagcctaggaaaaggcttgtggcattagaatacttatttataggattattttgtgtttttttgagatacggtctttgtcatcgaggcagaagtgcagtggtttgatcataattcaccacagccctgaactctgagtccaagccatccttttgccttaatctcccaactagttggatctacaagcataaggcatcatgcctggctaatttttttacatgtttttttttttttttgtcgagattatggtatcactatgttgctctggctgatctcaaattcctgacctcaagtgatctttctgccacagcctcctaaagtgctaggattacatgcatgatgcaccatgcctag

SEQ ID NO: 143656 - DNA, 439 bp, Homo sapiens
tcccaggcaattaaataccaaggacttcctgaggacactaagtgtccaggccacagagttggtccttgaggtgggtgtgaccaccctcacccctgggtatccaggaatgtgcccgacgccccaatcgccgtctccgggcattaagagcttcctccccatttccagcagtttccttcagtcacccctgagcagaatcactgggtcagaggctggcctccttgatagatggtgtttttttttttctttttttcctgagatggagtttcactctgtgtggcccaggctggagtgcagtggtgcggtctcagctcactgcaacctccgcctcccaggttcaagtgattctcctgcctcagcctcccaagtagctgggaccacaggtgcgcgccaccatacccagctaatttttatattttttaggagagatggagtttcgcca

SEQ ID NO: 143657 - DNA, 234 bp, Homo sapiens
ttgttccttttctcgatagagctattaatttttctctataaatgaatcagggcaatggactaaaggtctcgaaatactaatagctgaagtgacaagcctggcaaggagaagttacacacagacctctgagccttaacagaatctgaaaatccctgcatagtaagtgatacctatcacaactttcctaagattacagatgctcaggaggctactttcaagaaaacaggcacctaa

SEQ ID NO: 143658 - DNA, 208 bp, Homo sapiens
agtaagatacagttttgtaattcacaagtataattaaaatctgagattaaatcttcattggaattagtgcattaaaaaaattaaaagactgtataagattggaagttgatatattacattattcctgggtgacttaaaatttatcctctatcattatgtactcctatttttatagtctaaatttatttctccatgtcattactgcctt

SEQ ID NO: 143659 - DNA, 101 bp, Homo sapiens
gctggtcgagggtctcgtctcaatgtggatggctgctgaaggttggggggctgtggcagtttcttaaataaagacagcaatgaattgattgattcattgat

SEQ ID NO: 143660 - DNA, 231 bp, Homo sapiens
ctctccatgttgcggaagtctggaggaagcagggagtatgtgcggaccacacagcttagggagagctaggaccacagccctggccctcccaacttccaggccaagctgtttcccaagactctcaagacaacaggaccccatcctccacatgggaaagggacacagcaacacccccactcccaaaaaagtctcatgagccgggcgcagtggctgacacctgtcatcctagca

SEQ ID NO: 143661 - DNA, 451 bp, Homo sapiens
aattactgatacaattagtataaattaataatagtaaaaattaattattactgaattacacagaatcatctcacaaaccttcagcacaacaagacgtgacagagatcagctctcaagaccacaggattcaaagggaaggggttggagagttggaatggggaaaaactgaaataatggctgaaaagaatagaaaaaaacaaagctcatcaaagttaattaatctcaaataccagccatcaattacagtattagtcagtggagtaggacaagatagggaagcttaatcaagaagaaggaagagtttccaaggaataggttctgggttcatggagacttcaaagaaaagagtaaaaagagggttactgccatgttcgtgcaacatgacctgaagctcaggaaatctcactgggcaggtaagagagtgctttcctttcaaggggacccaaaaaaa

SEQ ID NO: 143662 - DNA, 121 bp, Homo sapiens
ctcttatcatgtaacatctgttataacacctcaaaaacaagagtgattttcctgctgtgaggagtgctgtgctggatggaaagcataaataacccgggactaagtggttcagctgactttt

SEQ ID NO: 143663 - DNA, 818 bp, Homo sapiens
tgagtaacaactctgtacgagtcaagatctctggtgaaaggtgccatagggaggcatagagacaaactgatatggggaaaagtgagagacaaacagatggaaaaatgaaagggaaagagaggcatgagaggaactggatgatgttttacacaggcaacagaaggagaaaacaagagtcaaagacagaataggagagacaccaatctaaattcaaagagtttagttcaacagatttaacacagtctaattcagcaggattctctgagatgtccacccagtgtgcacaattctttccaggatagcactaaagaaatcccctaaaggcccacaacagcaagtgttctattactcctctaagttttccacctgctcacctaatttactcaacagattctaactggctaaaactgataccttaacaagaagcaaaactcaagggagacttcagataaaggagagccaacattgtcacacaagacaagtgcatagaaggtgttgtgaaaggaagaaaacccaggtgtgaaaagagccatgatttgaaatctttcttcttttcctttttgaattagatttgtctgtctgtaggagaccagttcatttccttgtctctccatctggaagtatggctgctgctaccatgttggtcttcagggcattatattcttcggtatgtacttgtacctttatgaggatacctactgattaaaaacttacgctggaggaacagcaagcaggctggtacacccggaaggaatggacaaggggcagactctgtccatgtcacttgtgtgctgggactcgtcagaggtggtaccacc

SEQ ID NO: 143664 - DNA, 333 bp, Homo sapiens
agtagaaaattacctgctcttgatgcaaaaatccacacgccctcaggagcaaagggggaaccttttggactaggaagagaagccgctcgcggtggcgtcattacaccagcacagagaagagccgggcagaggagcccgaccctgccgatcgggcaggaggacagcagaacgaaagcccgccaccaacttgcaaaggactggagttttaggtcttaaatcttttacataatctggcgaaagttatataggagtcccctcctaggagaaagggccttctccccatactccacccctaaagcctgatagggctcaaagaccctgacctaaagctgc

SEQ ID NO: 143665 - DNA, 244 bp, Homo sapiens
caccgaggagggaggatagcttgagattcctaagggagggtattatccattcatgaaagtccatccccatgacacaacacctcccagtaagccccacttccaacattggggatcaaattttaacgtgagatttggaaggggcaatcattcaaaccatagcaagagttaaatttccttttaaagaaaatcactgatatgattccatttcgccatagataaaaactagtatttcagcctaccattg

SEQ ID NO: 143666 - DNA, 461 bp, Homo sapiens
tggggggtataattcgtatactgtacaatgttctcatgtgtcaaagttggtttagttttggcaagtgcgcaccccttatgtaacacacaccacgtccaggtatagacccatgccaggcccccggaaatcgctctatgctctgtccagtcaatttcctccatcacaaccaaccactgtcaacgattttttccaccatagattagtttcacctgttgaagaacttcatccatgtagaattatacggaatgtgcgtctgtctgtgggctggctccttttctcagcctgatatagtctgatggtcatctgagctgcagtctggtactgctgtgcattacctttctttgctaaggagcttccctttggatggatgaaccacaatttgtttagccattctcctgttgataggcacttagttgttctcagtttttgtctactatgaataaagctactataaacatttt

SEQ ID NO: 143667 - DNA, 223 bp, Homo sapiens
taggtctaaaccttcaactgaacacatttcaaacgtgtatggaactcattgataaaaactgcattgattattttccccaaaaagactaagaacaatccagagaacaaacaaataatagaagaataacctgtctgttcttaagccaggttactcagtatcagaaactaattcaaaatacagtaatttctgcatgtctgagtctgacagctgtttcattattgta

SEQ ID NO: 143668 - DNA, 329 bp, Homo sapiens
gccccgtgagcatatgtgaatgaatagggcgtccagcttggagttcagtaggtggcgtttgtctgtcctttgccactttgcctaggagcaggtgattcatgaaaggcagtcctagggaagcctcagattccctccggccattcctggttgccaaatagttcctctaagagcaggtagccaggttaaaggaatccctggtgcatcccttccagccatgctgtggtatccatgagttcatggcaaggtctttggcaaacgaatgatactctacataaaactggctccagtgttctgatttctgtgtgtttgggagtaggtggggcagaacc

SEQ ID NO: 143669 - DNA, 691 bp, Homo sapiens
ataatgcccacctacacacacatacttctgttcacccatgaaagaaggactcaaattttggtgaagtttctaaaccaaatttctaggttcatcagaacactgaattttaactttatatctttggatcattttctaattcttacttcaataacagggatttggaactacagaattaacttcaagatggaaatgttttcttctttaaaaactctcctgctaggggtaggaggagtcactgactattgtagttgtgcttcacagtccccagagagtagatcctacccagttccgatgcagaaccttagaagccggctaagatggcttcccgtatttcccaggaaaaaactcactaagtcttgttccaaattctagaagtaaagaggctcacttcattcccagaaaagtcctgcattttaagactgacaggtggccgggcgcggtggctcacgcctataatcccagcactttgagatcacaaggtcaagagataaagaccatcctggccaacatggtgaaaccccgtctctactaaaattacaaaaattagctgggtgtggtggcatgcacctttagtcccagctgcttaggaggctgaagcaggagaaccacttgaacctgggaggcggaggttgcagtgagccgagatcgcgccactgcactccagcctggcgacagagtgagactccgcctc

SEQ ID NO: 143670 - DNA, 915 bp, Homo sapiens
gcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccttccgctctccagtgtctcgtctcctcgtcaactcggttgcgaggtctgggggcctacggaggtcctactcgtctgtccgggttctgagggagggcccgggcctgggggccggctggggggccttgggccccccctcgtttcgggccctttggccggggccctacccgggggggcggggcccaatgctctgggggttgctcgtttgctattatctcgtc

SEQ ID NO: 143671 - DNA, 401 bp, Homo sapiens
agacggagagtgataccggcacgaggttgtacctcgaaagaagagctataaatgactggactagaacagcttcactggttgagatgatgaagatgtgaaggctggaactgccaggagccatggctgctaccattagcagttctagcctgaggccaaagctagcacagaaggcagatccatgagaaatataaagaaatgagcctctaatgtaaatatagttaacctgctggatcaagctgtttcctaagctagttgcctctggccttcttagttaagtaaatacatagattatcttttatgcttcacccagtttgagtgggattttctgttagttgcaaatgaaagcatttttaaagaatccaaaaccccatgataagacatagataaaaccaggttctccc

SEQ ID NO: 143672 - DNA, 285 bp, Homo sapiens
tgccactggctgcttcttagggcctccaggtagattagtttacctacagaactctgtctatggtcttagaataagaggacctggaagagttagaggcttgttgggggccatggcaggcctttgctgcagttcttggaggtttcttggccactcctgacagtgggagcagctcttcggatttccccatctaccctatttgcgaaggatgcctgctagaccagcatggtaagccatggggcatggagagagcccaagggtgtagaagatcttgtctggacaatctag

SEQ ID NO: 143673 - DNA, 184 bp, Homo sapiens
ggatttgctggtgcagtacaactaggcttaatagggacatgggtaattggtatattcttcctgttgtgatattgtgttacaataatctattcacctaaagtctcttcttatctaaatcctgatttgctctttatttgacatacttcagagtaaatatgacctataaaacttaagtttttcctga

SEQ ID NO: 143674 - DNA, 437 bp, Homo sapiens
agacataatgagggccggaactacaggagttggaattatgtgcaaagacaaatgctttctctcaaagcaatcccctctccctgctgaaagactcccctagggagtcttccaccaccaactctagacacactacagtttgtcagcccagaaattacatgatatcctaggtttccagaatgacacgtaaacataaaatcctaggtgtggtctgacaggaacagcactatcacccaccaccccagatcaagatacttctttgaaggtagcataaaaaccttaaacatttttggcagatacatcagcgtaagtcacgtgctagtaacacacccaggtcctttcacataggtgctatggggtagttagttcatttttggatccaaatgcaagatgcaggattctattccattttagctgttaattttaattaaagatcttaa

SEQ ID NO: 143675 - DNA, 730 bp, Homo sapiens
gtagttttctgctagacaaaaatctacaaagcattttcagactaaagtcctagtggctttccagagtctaaaaatatttttttttctagtagtagcattttctttcacttcagttcttcaatttttttttcaatgttttactaagatgattaagagtacatagatcaataatgtatgtttttctttttctttctttttttggggggagacacagtcctgcactgttgcctaggcttgggtatagtggtgcgatctctgctcactgcaacctctgcctctcgcgttcaagagattctcgtgcctcagcctcccaagtagctgagattacaggcatgtgccaccacgcccagctaatttttgtgcttttagtagagatggggtttcaccatgttggccaggcttgtcttgaactcctggcctcaagtgatctccctgccttgttctcccaaagtgctgggattacaggcgtgagccacttgcgcccagcgttttttcaagtactatggtagaattttcaatctgaaagaaatcttagggatcttctgatccaacaacacagttacttttcaggtgaaggacttctcagtagaattttctgtagtgatagaaatgttttatatctgaaaatgtgtttctatgtgttcagtacagtatacttcatagatggctcacatttcaagatcttgaagtatggtttccaaatctctgtgtgacagtgggacttattttc

SEQ ID NO: 143676 - DNA, 129 bp, Homo sapiens
ttacttcctttgttgattctttggcatatattaaattcttctgaagttgcttttttaccctaataagtgaccgatagctgctaatgctccagtgacaatatttcccatgggaaaccaaaacaccatcaa

SEQ ID NO: 143677 - DNA, 312 bp, Homo sapiens
gattactatattatctacctccttcccccacccgcttattaaaaaagtttacatttaggcatttgtattactggagtctgaagcctcaggatacagattactttttcagctggaagaatgttatatttatttctcagtaggagaaattagttgtctttgtgcttgcagatgggaaaaaaaagagtttgatttgtgaagcatgttgaactgaccagatctgtggtggccaactccaggggataaatttcctgtatatggagaatacctggagcattgctgggccctgacctattatatagtcacacacggtaa

SEQ ID NO: 143678 - DNA, 473 bp, Homo sapiens
gcatatttacatttgagtctgtgaaatctacagataatcagcctcgtttttcctttttcagtaatatctcccacggctttccatcacccacagaaaagtgagatgagggacgatgtttgcttcatgcatgatttgaagaaaggacagctgctttagtacaaaaaccaagtaattgaaataagggaccagtcctgtccatattggtccttctaattttcagttgaatattacctgaaatataaaggcatacctaccgcaaaatgaatctagaggaaatgttagtgtgttttcaggaaaggttgtagctctcatattaaaaattgtaagcttagaatatttaggatgatcactgatgaagggaaatcaggtttatcctgcttggaggatcacctgagcccaagaggttgaggctacagtgagccatgattgcaccattgcactccagcctgggtgacagagcaagaccctatctc

SEQ ID NO: 143679 - DNA, 367 bp, Homo sapiens
gattagatgagggctacctacattatggagggcaatctgctttattcaaggcctacaaatttcaatattagtctcatccaaaaaatactctcagcagaaatatccagaataatgtttggccaaatgcctgagcactgtggcccaggcatgttgctacataaaattatcacaaaagatgaggacttgtcctcagggacgccaaggatggggtttaagatagataatggcgatggaacatgaacactgtctcggaggccaagaactatgaaggaaaagtccactggattctgcatctgagattcgctggaccacatttctcttcctactaagtgtaaaatactggttaagagcaagcatgggctttggg

SEQ ID NO: 143680 - DNA, 1088 bp, Homo sapiens
ggaggcgatctagaggatcccttttattctattttattgaactatgaatactttatgctaaagaagatcatgttccaattcctcttgctttgtaatcttttccatacatcaaagaacaatcctgtttttcaagctttttggcttttcctacaattcattctcagagatgacctttagaatagactcaccaggctcttatttccaaagcctgtagggattatgactaaatctgcatttaaatttaacctcagtgaactgcccactgaggggggccactcaatccagctggcttgaacaatctcttgatgaccagagactggggggtcactccagctgctctccccgaccccagggacatcaccatggcccactgagcattcctggggccccaggcctgcctcatcttccttccaattgtctcctttctaactttctttggggaaggtggcacctaatttgaatgccctagaggttgattgtttacctgccggctttacccagggacttgcagcttccaggtagggtaggaggaattttttgttggaggcatttgctggatgccttctccattgtttcagtggtatttcctcttaacaaatgcaaacgtaacagctcacacaatagaacttcagttttcaatcacaccaagtccaaaatcagcactcttgttcagagagtggcttccagggacttcagtttttctataaatggcttctcagttctccttcaggtttccaaggtcaatctgctcattagcagaaagggagagaggatggagaaggcacactggctttttggccacctcacctgtggcaagtgatgcaacaattctgccccactggtgacaatgtgtcatgaaggccccatttgtgcaaatggctggcaggtctcatctgcctggacagttgtctctgtcatctttcctctgctctggtcctgacaggcatctaggcaactctgttgcatcctaaggctttgctttcccatcttacctgtccatttgtccagctgtctactcacgtcctgagggccaaaacctagtcacctggccacagctagctaacaggaaagtggagaaatgaactctc

SEQ ID NO: 143681 - DNA, 580 bp, Homo sapiens
aaatgtgtagtttattgtacatcagcactaccttaataaggttgttttttttaaaaaaaaaaaaaaaaccttcagctgctccctactgttcatcaaataacagtctgatattcaaattcccccagtatctggccctaactgccctatatagccttaatcaatcatgattctcctctacaatcccaatgctctagtataaccgagccagtcactaaagctgccctcctcctactgttccctatgtttcatattcctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttaagttgtaattatctgtatagtcatcttccccactaggataaaggattgctgaatgatacaatttgttgtatacttctgtaacacccctcctcttcattatctggcatgtacatcgatattaaaaatattcattaaatgaatgaatagctgattgactcagatga

SEQ ID NO: 143682 - DNA, 894 bp, Homo sapiens
tttcttcttcggcagcacttcctcaccgtctactgcaggcagatggacttatctgttatctgcattgcctggcaagcaggtcggctgcacaagcacctttgtttagttcccttaaatgcatcccaagcacccacaaagccttgctggccacctggtagactgcttaatcaatgaactaaacgaactcgacctcagagcccctgtgcagcctgcgacagctcctcccaccttccagaggccaagcagctctctcatcctcttcctctacagcaactatcttcatcccccatcaaaatgacttcatgaagccatcccctcccagttctcagggccagtccagcaagctgaagcccaaggaagggatggaaactgccccagagtcttaccccagcagagtacttgaaagcaagcatccagcagtacacaggctgccccaggacccccgacactggggttatcccagcattccactggcagcagctgccctgaacacggtgcacagggacagcgaacgggtttccccctggctcccattctaggtgattactagtgtgccgcccaacctggcatggcaagaaaacacaccatgatagactagtgatgtcttggctgggagtggcaggactggaaggcatgccactgggccgccatccccacaggccttgcagggactccaaagcagtgccgcccaaggggattctccacgatgatggaaatgtgctatgtcagcactgcccgattcagccaccaggagacacgtggttcctcaccacttcagatttggctaacgtatctgaggaactgaatttttatttaattttaaattttaagttaaaatagtccctgggggctgggcacggtggctctcgcctgtaatcccagcactttgggaag

SEQ ID NO: 143683 - DNA, 344 bp, Homo sapiens
tgtgttaaataacccagggtacatggtaactgcaatttgcttctagtggggtggtagtgggagtggggtgtagtttgtgagatggagagaaagtgagaaaagaaaaccttagttcttagacactgcaacctaggtagatcttaattttaccattattggaagtctctttgtcttctggccttgtctgcttggatttcatgcccattcttctttccattccaccccatgccaggggaagcacatctcgtctcctccctcttaccccaaatccaccctacaagcctctcccgaatgagctccatgggctcaccttaagccaggacagtgtggtgtgtagagaccca

SEQ ID NO: 143684 - DNA, 576 bp, Homo sapiens
ttattttttcttgagacagggtctaactctgctgcctagggtggagtacagtggtatgaacacagcttactgcagcctcgacctcctgggctcaggtgatcctcccaagtagctgggactacaggcatgtgccaccacacctggctaatttttaaattttttgtagagatgaggtcttgctatgttgaccaggctggtcgggaactcttggcctcaagcagtcttcctgccttggcctctcaggcgtgagccaccatgcctcgcactggcctgtattaaattctttgaatcatcctaaattccttcttaccttaaggttttcatacatcgtcttaccttcacttagataactctcaccctatccccacctcccagactgacttgttaaggtatctcatgtgagaaacctgcagtattttcaaccctcactccttgttgctttgtgcaatggtatatgttttcacagaatattttattttactttcatattcttagaaatatatacctatgtattgtttatgtaatacgtatcttcttcagaatggaggttatttgaagaacccctatgtgttttgc

SEQ ID NO: 143685 - DNA, 209 bp, Homo sapiens
tgacctgtgtagctaaaatataatgagcaaaatagaaacatttgaaatgaaatagtagagaaatgtattcattagcggcaaaattaatcaatatgggtataattttgattaaaatataaaaccagaattctactcttcaaaaaggcctggctcatgccccacgtggtggctcatacctgtagtcccagctacttaggaggctgaggtgg

SEQ ID NO: 143686 - DNA, 362 bp, Homo sapiens
caaaaaggtcatttaaatagggaaccataatttcacagaaaacaatgagtaaacatttgattgaaacttgatttttaaaagaagcaggccaggtgtggtggttcacgcctgtaatgccaagcactttgggaaactgaggtgaaaggattacttgagttcaagaccagcctggacaacatggccaaaccccgtctctacaaaaaacacaaaaattagccaggtgtggtggtgcacacctgttgtcccagctactggggaggctgagccgggaggattgtttgagccagggaggtagatgctatattgagctgtgattgtgtcactgcactccagcctaggtgatagagcgagaccctgtctca

SEQ ID NO: 143687 - DNA, 1393 bp, Homo sapiens
tgctgttatatttgtagtacttagtatttactttaatccatggcatatagttggtgcttaatacatacttatatcatgaaagccagaactctgcttcagtgtgggaattggaagcccctttcttcctgttgcagcctctaatgccattccccctctaccctgtagttgggaccaagatgaagggtaagtttgtgattatctttggttagcagggtggggatatgggctactacttgtttcttcctttccttggtatgttctctggaacaatgagtactaaagtatgtctaccaaaacacagttttcttttattcattaaacaaatatttgagtacctgcaattgttaaggcagtgttacctgtatctccttgagttatatttctgcagtgaaagcttgagaaatcaagtgacaagcatgcaatcactcattaaaatgtagtggccatctctcagtttctgtttctcagctgagttctgcagggtgccacaaaaatgaaaaaaaaaacactgtcttgcctctgaaagaacttgtgatctggagggtgagagggtaatgcacttgcttcctctctgcttggcttctaaatgttgaagtgctcagaaacttggagttctgtccttttttcttttctctccactgaccctaggtgtagttgccatatatgtgagatgactttcaaatttacatctctggattcatatctagcatctgacatcttcatttgaatattgaataggtatttccaaaatgacatatccaaaacatgattgtcaccctctcaacctgggcctcctctagccttccccacctcagtaattattatcaccatttactccattgcttatgtccagaaggttagagccatccatgattcatttcattccttcccatattgagtccctcagcaaatcctgttggttcaatctccatatccataatttcctgcatggataattgcagttgcctcctgttgcttttcttgcctccttttaggccttctgtaatttattaagtatgcaacagccagaattaacttttcaaaagtataggtcaggtaatgtcattaccctgcttagaaccttccagtgttaatcagtaaaatccaatgacttggtcaggtgtggtgactcatacctgtaatcccagcactttgggagactgaggcaggatcacttgaggccaggagttcaaaaccagcctggccaacatggcaaaaccctgtctctactaaaaatacaaaaatcagctgggcatggtggcaggtgcctgtagtcccagctactcgggaggctgaggcaggagaatagctggaactcaggaggcggagactgcagtgagccgagatcacaccactgcactccagcctaggtgacagagcaagactccatctt

SEQ ID NO: 143688 - DNA, 372 bp, Homo sapiens
tggtgataatcgatgtgttcgtatttgaatatgcaccagaaagtaagggaatggaaatattttgtatttaaataggtttatttattttattttattttattttttgcgatggagtttcgctcttgttgcccaggctggagtgcaacggcgtgatctcagctctctgcaccctctgcctcacgggttcaagcagttctccctgtctctactaaaaatacaaaaatcagctgggcatggtggcaggtgcctgtagtcccagctactcgggaggctgaggcaggagaatagctggaactcaggaggcggagactgcagtgagccgagatcacaccactgcactccagcctaggtgacagagcaagactccatctt

SEQ ID NO: 143689 - DNA, 285 bp, Homo sapiens
ctactcacgttccctttggatctctgagctcacttccaccaccgagtcttgtccacagtggccaataccctcagattattcacacctcctggaggtgcctttctcatcctccctgtggccatggaaggtcagcaggtgtctagtcatttggtttctgttggcactgcacgtgacaatgtcaccctctgtgttcactcaaaagacacatgataagcaccttctatatgcaggacaggacctagactctatcctcaaatagctgaggtaagaaagaggtaacagcag

SEQ ID NO: 143690 - DNA, 248 bp, Homo sapiens
tttcgatctgtgaacaccagaatatttctaaactcattgctgaagggtctggcagggatcagggttcctgaaactagagtcaatggttccttatttaaaaagccaatgttaccttggacacaagaattagatgaaatcctttctgctaatgaatttattttgttgtagatacttgcttttccccagggtatatatttatgtgactatatggtaatcagtattatccctaaaaattaaaacacaacact

SEQ ID NO: 143691 - DNA, 603 bp, Homo sapiens
agtaattaaatgctgaaacctttcagaaatagccataattttgtattacatacaagtaagccattttaaggagtttcatgaaagacgtttggcacttcacccattatttcttgctgatggtaatttgactatctttttcaagtagctttttgcattgactaggataatttacaaatgaaaattactttctcatcattgaacagcatgataggtatttgtgccgcattttttatcttttaaatgaaaaatatttattaggtaaatggaactgaaatactacctagttacttcttttagtagaatacttctgaggcaagaaactaaaatctagttgtcatattttccaaatgttatttatcagagtaacacgaaatgacttcccaaacacacttgaaaacagtaagtagattcacttggcacacataatctaaaggagatttattttctgtttactagaagttattgaatcttaaatattacccctcatgccctctccccctgcttttttaaaaaataagcgtgggggggaatcagctaaaatacagcatagaaaatgcaggtttacccccctcccccgccagcctgctttgttaacatcttgta

SEQ ID NO: 143692 - DNA, 778 bp, Homo sapiens
tggagatgaacacactcttccgcttctggtccttcttcctccgagatcacttcaacaaagagatgtatgaggagtcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggaaaggggacaatgaagggacaggcctggagttactaggacaggcctttgtgctgagtagcaatgtatacaccatttgggctatcagaggtacccctgggcaggagcctctacatccccttccccctcctctctccatga

SEQ ID NO: 143693 - DNA, 735 bp, Homo sapiens
cttttacattataatgtaaagttaacaatacttaaatattatgatatatcatatgatatgttcatgataagggattaaaagggaaaaaacagacatttactttatatacatatatacatattcataacaaaatcaagatgaagtactcatgacaattgcaattctcatttgtataactggtcacgtgatttttaactggtctttataactgccttattcagttccagattacctttgcccacagcactcacctcagcttgttgtatattctctggtggggtgacccaaagaccattagtggaccttcctgaattgggcattgtcgttttccattgagtttaatcacagagcatggtattactaagagacatcctaagagctctcctatattccagaaatactcttcttccttatatctattttggaggagcaatccagtttccccatagtagtcaggatcagtcagtccagtcagcatagtaacttccttctttgcctgttgattcagaggcttgagggacccaaggtggctggttggcagtcttaacttccagttcagtggaatcactatgtttcctggtagacacatttctgcctttggaactgagacctctaggccagcagagcataaggtcacaggggcaagaaacaaaaattttgctagtgggtcactggagtgagtggtggcactccagtttccaccccatgaatcctcactataaaattaaaagcacc

SEQ ID NO: 143694 - DNA, 507 bp, Homo sapiens
ggggcagagcgggagacagaagaaagcctaatttacacagatctgtaaagttttaccttagcaggagggtcaacaggctggttagttttatcggggaaaaaagccttctcaaaaaggtggattcagctaagattttaaaggcagagggtaaggtgagtcaggagaaggctattttctgcaacttgaaccaacatctagactcaaggcagaactgagtggttggcatggtcagaagtcaaatgtaattcagagactgcaatacaagataccccctagatctggcaactgcatttgtcattaaacatcgagcacagagagttcttagaatcccccaaagcaggggccaagtaggaatatgtgtgaggcaagtgagacccaatgtaggcaacagagagggtcaaatacaaggctggagctattgaggttaaccaagtggtgacacagagtacacacatcccatgaagcctgatctgatttttcaaaagaaacgacatgtaatgaaactcc

SEQ ID NO: 143695 - DNA, 295 bp, Homo sapiens
gagacctcatcaggatggaaatcacaattttaaggcagatacatgtttttggaagatcaaccttatgcaatattgagttcatgaaaatgaggaggtctaaaagtagggtgaccaaccatcctggtttgacaaagactgatagatatttcctggggtgcaggaccttcagtgctaagactggggaagtttcagaaaatgcactgatagtggaaatctaaagtatactcagaaatatgttgatcgtcttatctaaaagatggtgacagattgtggtagctagtctccaaagacggtt

SEQ ID NO: 143696 - DNA, 211 bp, Homo sapiens
gacataagaaaggtaaaagagtaatataatgaacacccatgtttccacccccacctccccaagaaataacacattaaccataggcctggggtggtggttcatgccagtaatcccagcactttgggaggcagaggcgggcggatcacttgaggtcaggagtttgagaccagcccggccaacatggtgaaaccccatctctaactaaaaatac

SEQ ID NO: 143697 - DNA, 770 bp, Homo sapiens
gcacttgagatacttcagatcaaatgcaccatctcttttctttagatgtcaagaaattataacttgaccctagagtttcacatttcttaataaccaaggaggtaacaataagcatcaaataattttgtatgaatatcttataaaaactaaaattgttttgcaattgggcttacagtaatttatttttcttttaaaataacaatctaaagatcataatttgagattgtctttagaccatttgagattgtcattagataattggtaataattctgacagctattcttttttgcggactttggaccaagtatattattgaaaaaaaaaaagtacttagcatctactttgtaaaccttaggataagatattgagtaaaatatacaaatccataccctcatgggttgggatgcttttttgttttaatgggattagataataaaataaatacataacatatacgggacattggctggtgataagtgttctggaaaaaaaaggaggaaaataaggaatattgggggcaggggaaagttgcagttttcaataggggatcaggtgacatttggctgggcaccatggtgcacacttataatcccagcactttgggaggctgaggcgggcagatctcttgagctcaggagttcaagaccagcctgggcaacatggtgaaaccctacgcctacaaaaaatacaaaaaatttagctgggtgtggtggcgcacacctgtagtgccagctacttgggaggtaaggtgggaggattgcttgagccc

SEQ ID NO: 143698 - DNA, 263 bp, Homo sapiens
ccactgcactccatcctgggtgacagcaagactttgcctctaaagaagacaaacaaacaaaaaaatgataactctccagtcagacttataaaaagagaaaaaagatgtaaatcaccagtatcaggaatgaaggagtagacatcaatatagatcttacagattaagataatattttgaataactttatgccaagaaattatacaatttagatgaaatggagaaatattttgagaaacgcaaactgctgaagatcacacaagaag

SEQ ID NO: 143699 - DNA, 289 bp, Homo sapiens
tgctggaattacaagcatgagtcacagcgcctggcctcagcccacttttatgtattagcacaatagattctaaactgattccctaattctatttagtcagcacctaatttttttccttaaaatcatttattttactatctccctttcccctttaaaaacctaaaaaacatttcttaatccccaaacctccttaatctattcccaatttgcctttatacaactttactactgaatcaaaccctttgttcaggtgaggccttttgccttactactgactcctcattccacc

SEQ ID NO: 143700 - DNA, 748 bp, Homo sapiens
agcctgtgtgacagagcgagactccgtctcaaaaacaaacaaacaaacaaaaagataaaggtctgttgctcaggctggagtgctgtggcacaatctcggctcactgcagccttgaactcctgggctcaaacaatcctcccacctcagtctccgaagtagctggcaccaccggtgtgctccaccacacccagctaagttttaaatatttttgtagagacaaggtctcactgtgttacccaggttgggcttgaattcctgacctcaagtgatcctcctgccttggcctctaaaagtgctgggattacaggtgtgagccactgcacctagcccagaatttctatttatttatatatatttttaaaaagaatctcactctgttttccaggctggagtgctgtggcaagatcaaggctctctgtagccttgaactcctgggctgaaacagtcctcccacctcagtctccagagaggctgggaccacaggtgtgtgctgccacacccagctaatttttaaaattgttttgtagagacacgatctcactatgttgtccaggctggtcttgaactcctgggctcaatcctcccaaagtgctgggattataggcgtgagccactgtgcctggccccacccagaatttttaaaacatgaaaaagcttatgttttgggccaatctctaaaatatattaagtgaaaaaaagcaacctgcaaatagtgtaaatgatatgccaacattcctgttaaatattt

SEQ ID NO: 143701 - DNA, 339 bp, Homo sapiens
ggcaggagggtgagataggctgtggggcatgacagtgagtgagggcactgggagcaggatacaaggaagatgtaggaaaaagaagtaagagtttgcccaatgcccccctcatgccagtgtgcctggcctatgcctccaacctggagagtggggtggggcaggaatcagggaggcttcctggaaggggaggtgctggaactgggccttgggagtggagtgaatttccacaagtggggagaggtggagaaacagcctggacaagaccctgcaggtaggagggggagcttgaggctgccagttagggagctggggctgatgattcgaaagtgagcctgaatg

SEQ ID NO: 143702 - DNA, 807 bp, Homo sapiens
caaagtgcttagtttgataataatttaatgtggatctaaccccttttctctcatttggaaaatttccaaacaggtcacattttaaaggcaacaaatttgagcagaaagaatgagttatgtatgttgggggaggagaaaagtagaaatacttttaattgtgtaatctagaggagcactgccatagaaaattattatgaactaatagctgagtttttaaatgggacatttaataggaataagaatagcattttcagttaaaataagtaagatcaaatcttagactgtctgggtgagttgaacagacagtctaagtttaaccagatagttaagtttaatccagtaagcaacatttctatggtagttaggtattgcagttctcaataaaacattttggggattcagttttttctcacaaacagatactgagccattctttaaaatgtcttgacaagatagacttatctttctatagttgggatttatgtggaaaagtagaatatctacatcttttactcactttacagtctgagcaactaagattattattattattattattattatttttaggcggagactcattttgtcacccaggctggagtacagtggcgcgatctcggctcactgcagcctctgcctcccgtgttcaagtgattatcctgcctcagcctccctagtagctgggactacaggcgtgcatcaccatgaccggctaatcttcgtgtgtttaacagagagagggttttgctatgttggccaggctggtcttgaactcctgtgatctgctcacctcagcctcccaaagtg

SEQ ID NO: 143703 - DNA, 364 bp, Homo sapiens
ataaagcccagagttctcacacaaaataaatctcctggaaaaaaattaaaacaaaagcaaatagtagctttgagaaattatattgttttgaaaaacaggccaggtgaaaaaaatggcaggctgtttaagtgtaggccagaatacttagcaagaaagtgtgagcaaacaacacagacgtgagatgtaaaatgattaaattttgacttctttctcaggatcatacaaaaatgtctggcatgcatagtggccagaagttcgatgctgttcttaaattgactgaatgctttgatgcacaagtctactactaattttggttataatctttctagatatatgtggaagttgagagaaaagctgtgaataa

SEQ ID NO: 143704 - DNA, 485 bp, Homo sapiens
caacatctgagctgaggtgtaaagatcaagaaggagcccacatcgtgattgggtcacctttgaggaggtgacatctgagctgaagtgtgagggttaagaaggggtccgcattgtggaaatccatggcaatagagtttttaagacagagggaacagccaagtataaagattctcaggtgggaatgaattgtgcatggtcaaggaacagaaagaaggccagtcactagagattatcaactaggagaagagaaacatgaaatgagatcagaaaggaaggcaaaggccagatcatatatacaaatgggtttataatgtacctcaatagttttcctgaatagttataaatcaacccctttccttcaacttaacattccatgtttcacacattacagtaatcatttttaatttactgagacagctatttaaatcatgctatgaggcagatgtgtctagatgaataagtcatctagtatgtgaacatattag

SEQ ID NO: 143705 - DNA, 237 bp, Homo sapiens
cctcctgagtagctgggattacaggcatgtgccatcacgcccggctaattttttgtatttttagtagagacggggtttcatcatgttggtcaggctggtctcaaactcccaacctcgtgatctgcctgcctcggcctctcaacatgctgggattacaggtgtgagccaccacgcccagccctgataaatgacatcttgactgcaatgtgcaccttcctgaagatgctagataccaag

SEQ ID NO: 143706 - DNA, 538 bp, Homo sapiens
ttactgaaagaaaacaaacgaccattctagaacaacagggaaaagcccattcatggctttgataaatacctgaggtaaatttttgatgtaacttaagattgaagaagaggagatttgagaggataaccacataaactgtccagtgatggaggaaatgattctgcaactgaggtgataaaacttcatcatgcaacttgaattgataaagttttatcaatttcccagtaggcagagatccaaaaaacaagaaacactacaatcaccgatgttacagatgacatatatgtagctaaggcaaagacaactcctctgtgtcaacttcacaatcaagacaaacagccttctcaatgaaattttaagcagaattaaagctaactttttgttttctctgaacaatttggttttggtttcctatttgtttttcagaatgaaactgttaatttttgtatataaaaaggaagacaaatcttagtaaaagtatatttttttaattttatgtaagaaaatctattttcagtgcaataaaattaattgtatg

SEQ ID NO: 143707 - DNA, 384 bp, Homo sapiens
gtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagaaaaatggtaaacacttcatatacatcatctttttaaacacaaaatgtactattaatccagctttacatataagaaaactgaggctcaaagaggctaagtaatttgtatgtgaacatgctttacactatgtaaaacatcttattagtagatatcactattattaagaacctatcagccggagaggaagaatt

SEQ ID NO: 143708 - DNA, 660 bp, Homo sapiens
gaggagggggcttactatgcaagcgcttggaggccaacgagcactgaaaatgaggagagagttcaaaaatcaagttagatcctgggatacgccaacaaatccagacactacagttctttcggagaaacctggggacgaaaagtaaggctttgacctcagaaaatgaacatacaggaaaaataatgtgtcctaatgtgtcctaatgaaatttctctagtattcacatgttataaaatgttaggaagaaagaagatgtgtcctcctacaagccataaatcagaattctaataatctaaagctaattagaaaaatattacatgttaaatattaaatattagaatagaaaaatgtatgagggaaaaaaattgagacacagctgaatttttcaggctgttccagcactaaaaaaaaaatacaggagaagaatgtcacatattttcctcttcctccccctccagattccataatatcaaattcataacttttcatttgcgcatgccttattttccattccttgtttgtcactaatcctgttagtaaaaggattcccccacctatgttcataattaagttttggtctaaaaagaactacaaacagaagcacagttccctagatttctaatttttttttattttatcacagccagttaacttattaca

SEQ ID NO: 143709 - DNA, 156 bp, Homo sapiens
caaaaacatattttaacaaagaagaaaaaagacttctttccatcaaagctcaatagagatttctgtctattgaagatcatggtgaaatatttcattttccactagaatagtttaaaattattcatttgctttattccatgttataaaaactcagaa

SEQ ID NO: 143710 - DNA, 427 bp, Homo sapiens
cagctagtgttctcaattctttcagcagagctcagctgatggacaaaaatagagaggagttctattgcttaaacactatttggacatgaagaggtctttctacgtgacacttggaatttaattgcaaaataaaaaaaaatgaagaaacactttattcacccaggacaatccagtgttatgactaaggcattttcactgtgcgctcgctaaccattcacagctcacacaggaacaaaaatcatgggtagatgtggcacactgggctcatctcaatagctaccaggatcacatacctagaggcataggaaacaactattttcattccctggaactctcaccattgggaaattaagcactgctcatatctggcttataccctcatgactgtatctgtgttcctctagtctctcctgtatggtatgtcttt

SEQ ID NO: 143711 - DNA, 3697 bp, Homo sapiens
gggcggggcggggcgctttgctctggactctggggcggctaggctcgcggactccgcggcggcagactccgacctcgcagtctccccaggtccgcccagcagccgcgcttcagccagaatactgggatcttcagtggcaggaggagtaatcagaagacggagatgaattttaacactattttggaggagattcttattaagaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgtgcattggtggagagcaagagataaatatgggaatgaaggatatatcccaagtaattacgtaacgggaaagaaatcaaacaacttagatcaatatgaatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaagctgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtattttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttaaaaaaa

SEQ ID NO: 143712 - DNA, 3643 bp, Homo sapiens
gggcggggcggggcgctttgctctggactctggggcggctaggctcgcggactccgcggcggcagactccgacctcgcagtctccccaggtccgcccagcagccgcgcttcagccagaatactgggatcttcagtggcaggaggagtaatcagaagacggagatgaattttaacactattttggaggagattcttattaagaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgtgcattggtggagagcaagagataaatatgggaatgaaggatatatcccaagtaattacgtaacgggaaagaaatcaaacaacttagatcaatatgaatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaagctgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtattttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctgggccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttaaaaaaa

SEQ ID NO: 143713 - DNA, 2329 bp, Homo sapiens
aagaaaagaaaaaaaaaagacaattggtaaagattatgtaataatgccttattgcaaatacaactttctgacctgcctattcatttttttcaaatacacaatggaaatacttccataggggtaaaaacaacttattaaagggtgtttccactctctgcaaatgttgactaggttacactaaatttaatataaatagaacttacattttcctacttaaatgatagaatttttaaactaatataccatcataatgttgttttccaggctgccagaaattgtctagtaagtgaggcgggagttgtaaaagtatctgattttggaatggccaggtattttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttaaaaaaa

SEQ ID NO: 143714 - DNA, 1607 bp, Homo sapiens
ggacatgtagatcattttatttatgtgtttccactgtataagtaaaatgatctacatgtccaagtgctcaataaattaaaagccacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttaaaaaaa

SEQ ID NO: 143715 - DNA, 478 bp, Homo sapiens
gcattatcatataaaggaaacaacaacatctccaaagaagtattacctagctgaaaaacatgcttttggctccattcctgagattattgaatatcataagcacaatgcagcaggtaagtgagctgtgaaaacctacttcaaatataaggtagtgattaaaatgatcagatactgtgattaattccttgagcagttttattttatagttagttcattgtagaatgtggttgattttaaattactgcatattaaaggaatgatatatacaaagaaaatttagaaataatatcaagttttataaaaagctctgtcttgaccttaggacatgagttattccagtggtatatagtaaatgttcacattacatttatacactgttggtggcagtgtaaattagttccgccattgtggaagacagtgtgatgattcctcaaagacctaaagacagaaacaccattcaagccagcaatcccattac

SEQ ID NO: 143716 - DNA, 2820 bp, Homo sapiens
agagtagcagtcttctgcacaggatgttgtccattcaccttggaactgccatccacaaacctagcaactcttggtaggataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaagctgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtattttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttaaaaaaa

SEQ ID NO: 143717 - DNA, 1514 bp, Homo sapiens
gggcggggcggggcgctttgctctggactctggggcggctaggctcgcggactccgcggcggcagactccgacctcgcagtctccccaggtccgcccagcagccgcgcttcagccagaatactgggatcttcagtggcaggaggagtaatcagaagacggagatgaattttaacactattttggaggagattcttattaagaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaaggtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgtattaatagccaatttttgttcttaacaatctttcaccattatttttaaagttggtaaatttaacttgccctgtaattttaaacgaaagatctttattcaatctaatgatttacttagttaatatctccaagcaagtttccatgttttaatttttcgatctccataagaatcccatgagatagctactcacagtggattctcttaccatcattcttgtacagatgagaaaattagcttcagggaagtcaaaaggctcgcctactgtgataaatagggaaattggggttggccttgactttctaactagagcccaagttcttttccacctcacacactataaaaagaaactataagagaaatcctttggatttttaaaaaatctctcaaatcactgggaaaacatggaggttcatgttaacttctcaaaatgctagaaaaagaaatccgttaccagttctaaattatgatggagacaatttttcccttctcacctgttctcactctctcctccattcttcttttccttctgtttttcttctctacctgttctttacagatgctttcagctatcagtagcactctgtcccctgaaaataatcagctgaaaatgtctgttttcagcatatcggtagcactgtctgtcccctgaaaataattcttttaccaagaagagtgtaattttcatttgggactttctcccatattttagttttagctttctagtgataaagcatggacacatttcttttagaaagcagaaaaactttaaaaaaatttttttttcctttgagacaggtctcactttgtcttccaggctggagtgcagtggcgcaatcttgg

SEQ ID NO: 143718 - DNA, 290 bp, Homo sapiens
gctgtgttcgtgtgtgatagtgagtgatggtgtgtgcctgggactatggccacaggtatctgtaggacattgtgagtctttcttgactacacagcattgcgtactgtgtgtgcttcctcttatgtgattgtgtggctcgcatgcagctgcccccacaagctggcttccagtgaggcccctcctgccactgagtcagtggcaggcaatcctgggtgaggagccaggatcccaggacccaggagctcaggactgagctcttgtccctccctaccctgaagccccaggcaggc

SEQ ID NO: 143719 - DNA, 157 bp, Homo sapiens
tgctgggattacaggcgtgagccactgcgcccagcctgtggtgtttgttttttttaatgcctgattcaacttttgatctcattcttaggtctatttaaccttgtgcactactcttaaggcatttaatatgctgttatttagacattttccattgggt

SEQ ID NO: 143720 - DNA, 366 bp, Homo sapiens
agagtaaatgagaaatataaaagattatttgaggctccaaaacacatcttaaagggatttgagaatttaagagtaaatggaaagacaggtaagcagttttctaaaagggcaaggtttttccagaattataacaaattttcagattaaatgtgcatcaggtcaggtatgttaaataaacgcacatttagaaccattacaatgaaactgaaaaggatgagagataaagcaaaaagacttaaaagctaccagacggaaagatggatcagtagcagagcactaacaatagagtgagaacagatttcaacaaacgattctgaaagacagtcaagtaaaacgaccaccaatttaatactttttattcactaa

SEQ ID NO: 143721 - DNA, 510 bp, Homo sapiens
caaaaatcaaaaccataacaaccacactgttggaccacagctcaagcacaaccagcttctgagtgacttttggttaaagaataaaattaaggcagaaatttaaaaaaattatttgaaactaataacagacacaacataccagaatcttcaggacacaactaaagaaggatgaagaggaaagtttatagtgctgtacacctacctcaagaagttagaaagatctcaaattaagactctaattattgcacctagaggaaccagaaaaacaagagaaaacaaatcccaaagccagcagaaaaaaagaaattacaaaaattagagcagaactgaacaaaactgaggcatgaaaatccatacaaaagatcagcaaaaccaaaagttgattcttcagaagattaaacaagtttgatagcctggtgcctagatttataaagaaaaaaataaagaagacccaaatacacccaatcagaaatgacaaaggtggcatcataactgaccccagagaaatac

SEQ ID NO: 143722 - DNA, 386 bp, Homo sapiens
cattgaatatttttattatggtcatttctcaatatttaaacatttccattatgcatttctttatagcccatgagtgtttattaagaagtgtttaaagtttttcaaacaaatggttgttttggggttagcttaattctactctgttcagaaggcatgttctatatgatatagattcttttatttttgttgagatttgatttgtgtgtaaaacatggttgtttcatagaaggtccaagtgtgcttgagaataatgtgtattctttttttcttgggtgtattgtattagatcaaattgactaattttattgatcaacttttctgtttttttatttgcttacttatcggttatcaaggaaggtatattgaactctcctagtatgcttgta

SEQ ID NO: 143723 - DNA, 154 bp, Homo sapiens
agcctgtaaaagcacacccaagggtggaactcaagttatctaaatccaaggtcagaatgtattctcccatgtagctctctacttcctttaatgtggtacgttagcacagtgatcctaatgtcagtgcctgtggaggtcacctataatagtataa

SEQ ID NO: 143724 - DNA, 423 bp, Homo sapiens
ctgcactccagcctgggtgacagagcgagaccctgtctcttaataataatgtttatacaaacataagtacataccatgcattttctttaaaaaaactgggtttatacacattctcttctgcttaatagtaattatatgctacaaaactgtactatttttcagcatggaaaaaatatactccagattgaactggagaagaaaggtttactctacctgatggtttttgttgatcgtttacttctgcaatcaggcagtagaaaaggggattgtccccaaagccatctctgagtaaatctgaaatatcaattcatatataggatgtcagaaagtttatagcagagagaaggagatggtggataggaagcactaggaatttctctctccacctggatagcaattgtattggcggaaactgaagtgaat

SEQ ID NO: 143725 - DNA, 252 bp, Homo sapiens
gctcggttcccgactacagtcggccggcgggaatacaagcctgagactagcaggggtttaacaacgacaacacgtggtaaatctctgctgtttcaaatgtctccttctccagcaagctagcccaggcatgctctcatggtgacctcaaaagagcaagaaagcaaacagaaatgtgcaaggcatcttgaggccctggctcagaactgacgtgacagcccttctaccactttctgttgtccaaagaagattcca

SEQ ID NO: 143726 - DNA, 291 bp, Homo sapiens
tggtcctgtagtcccagctactctgaaggctgaggcaggagaattgcttgagcccaggagttccaagctggagggggctatgatagcgcttatgttgggtctgtgccactgcatgcctgggcaacatagcgagaccctgtctctaaaataaaaaaatgttcaaatgcctagtccagggtgacagagctgggattgaaagccaggtctgcctatctccagatagttcagtggctcctcaaattagatttgcctggagaatttggataaaaccggattctaaagtcccaccct

SEQ ID NO: 143727 - DNA, 133 bp, Homo sapiens
gacataaagtgccagagagtgacagaaggtcttgcagcagtgattggcccaagggttggatctggccaccagctttttttttaaatagagatgggatctcactatgttgcccaggctggtcttgaactcctga

SEQ ID NO: 143728 - DNA, 420 bp, Homo sapiens
ctcggctcaggcagtcattaattcctcattttagttattttatgtcttctatctggtttgtttgtttttctagtcttggccccgtctctcctacccaataatccttcctctatactgctgctgaagtaattcttctccaaccttgcttaactaattcagcaatttcccattaccttcaggatacagttcaaactccttaacacagtttacaaaactcttcatcatcttacatctacatttcccatttctcctgctgcatacctgcataccacaatgtttgcttctatggtatgcttacctgcaaaatatacttacctccacagttcatagacaaggaaatatatacaaaggtatatgttcctttttctggagcatactcatgtctttccttagcttggtcaattccaatagattcttcag

SEQ ID NO: 143729 - DNA, 304 bp, Homo sapiens
ggcatgatgtagacacaagaagagtgtctcagcaaggctgaccctccttcttcgtgtctgcatgttccttttcccatagtcttctgaacacaaatctcttaccaaaccattttcactggcccctctggaaatcaagtttcattgtgaacaaatatccctatgtccatagtgtcttaacagagtgtatctttgcccgcacatttttagtttagttgaaatctgacccttctccagggacattcctttccttttagccctgtaggctgctcactcacaaatgtttcttatgtcacagggtcacgat

SEQ ID NO: 143730 - DNA, 244 bp, Homo sapiens
  misc_feature (214)..(214): n is a, c, g, or t
gaggagagaagaggcgtgggtctgtagagggattgtggccagaggagaggaaaggtgcggggctggaaagggagcatggccaggggagaggagaggcaaggggctggcggggaagcatggccaggggaggggagaggagaggcacggggctggtggggaagcgtggccaggggagaggagaggcgcggggctggagagggagcatggccagtgnttccccgccagccccatgccgccgggtacc

SEQ ID NO: 143731 - DNA, 263 bp, Homo sapiens
gaggagagaagaggcgtgggtctgtagagggattgtggccagaggagaggaaaggtgcggggctggaaagggagcatggccaggggagaggagaggcaaggggctggcggggaagcatggccaggggaggggagaggagaggcacggggctggtggggaagcgtggccaggggagaggagaggcgcggggctggagagggagcatggccaggggacaggagaggtgtggggctggcagggaagcgtagccaggggagaagaga

SEQ ID NO: 143732 - DNA, 228 bp, Homo sapiens
ggaggggaggggatgaggtctcctcccgcagatcagagtatctagttgtctggcatttaaccttctctttactcccccctcccctaaatttccctttaaaacactcctctaaaacatctggacttcacacattcctggtcccctaggtgtctgtctggcccctggcctgatcctgtagtccctaaagtcctcttctaaaacaggacctagctctctcatcccttcccc

SEQ ID NO: 143733 - DNA, 415 bp, Homo sapiens
ggcaacaatgaactcacaggacctctgtctatctatcaggattattttaaaaacttgacattaaagggatatttctgttttcttgagtttagttaatattgtgggatgattgggatcatgccgtttccatcacgattcagttttgacattaggtgccctaattagtctatgtgtctgatttttttctatccctagctaaaaagtatagttcacaagagctggaatcacaatccctgcagctttccacaggaggacaggaatgcctcacatataaagagcttccaaagtcctggcctctgagctttgagaaagaagactgactctccaagaagatcacttctagaaccagtgcagaataattacaactacagggactgtgctgatgtaggggaaaggggaggtagacagagaagag

SEQ ID NO: 143734 - DNA, 289 bp, Homo sapiens
aaattctagttgagctgcacaaaaacatgtgtgatagtagggagacaggctggaaaagtagcctggagccagattctaaataaaggctttgaatcacatttaacagcctgggcttcccattatagacaacagaaggccctcgagattcttaagcagaagagtaccatgatgagacttgtgatttaggaaaggatccattatggccgggcacagtggctcacacctgaattcccagcactttgaaaggctgaagcggacagatcacttgaggtcaggagtttgaaaccac

SEQ ID NO: 143735 - DNA, 428 bp, Homo sapiens
tgctagatgaaaaaagtctgtcatgattgggtaatgaatttgactctaagttcactgatacatacaggagataatggactgacacaatgaatatgaaattttggctaaattattgaaggcatatttgtctgaatagagagtagggtgggaatctcagaattatagggttaaaaatgtcttgttccaactcctcttgccattttagtaaagaatacacactgaaaatgcaggtatgactttttttttttatactagagaactgatagggacatggtcaaacacaattgttactgttggctaatttatgtagaatcaattctgtttccaatcagttttcatttctaaaaagactaaagtgaagagcaaacataacgacccttcccattttgcttggttagcaatagtaggctgtttggctttattttcca

SEQ ID NO: 143736 - DNA, 439 bp, Homo sapiens
aaaaacaaaggatgaacattggaaatgttctaaaaataccactgaattgtatactttaaaatgattcattttgctatataaattttacctcaataacaaaaaaagataaaatcaccagtatatgtctatattatttccaagagaatataatatttatgtgacaaagagataatatagcaaatctatgcaacaaaattctaaggttgttcaactcaaacattataacaataaaaagtcatatattcatgattaatacatgagatctgcttcaaaagaatatagaggagtccaggcgcggtggctcatgcctataatctcaacactctgggaggccaaggcaggcggatcacttgaggtttgggactagcctggccaacatggtgaaaccccatctctactaaaaatacaaaaattagccaggcgtgttggtgcacacctg

SEQ ID NO: 143737 - DNA, 477 bp, Homo sapiens
gtacccgggaagagggagtcacacgggggacggggacgcgcgggagtgcaagggcatgagcggggcgcgctgcgaccgccggctcccaggtacaggggattcttctgcctcagccgcccgagtagttgggataacaggcacccaccaccacacccagctaattggggtattgggggttagaggcgtttcgccatgttggccaggctggtctcgaactcctggcctcaagtgatccattgtgcttggtctgttacttttttaaagcttttatgattctaaggaaaatttctctctaattgttctgacgcgtttttcttttagttaagttggtatctttttgttaattgccatttgcttccttttctctgaattttcataccttttccagtttcttttatttttttttttggccttttttgcttagtgattgcttagagttaacattacaagcaagctatcatcacatattgaaaaaat

SEQ ID NO: 143738 - DNA, 269 bp, Homo sapiens
attttaagccaaaggtgatgtttatagagaaagttttggtctcaataaaacaaagatttttctaacaacaaggctgtcccaaaccacagtgggctactcaggtgagggtaggcatgagtggtcttgagctcccatccctgcagtggctccagcagaggctttatgcctgcctgttagggactgacagtgcagggagcacatggggaatcagtgttgatgtgctactatagcgccacctcactctgctcaggcaaccatttcacaagagc

SEQ ID NO: 143739 - DNA, 296 bp, Homo sapiens
tattttttaaagacttcaaaaatatggtttcataaaggcctctacataggccccagtgcactggtgtgcttgtgcacacacactcaactcagcagtgtggcacagccacgtgactgcgcagtgggtactgcctccaggctcagttgctcttctagagtccacaaaggcttagcctaagcttccaccctccacagagccagaagttcaccctctcctgaagttcaaattcaccacattgtaccccttgtggcagttctcacatcacactgaattgcagttactggtctacatgactg

SEQ ID NO: 143740 - DNA, 265 bp, Homo sapiens
tgagcattgcatttctcaaacttcagctgataaataaaactcatatatttgtcatgaataaaaatgtatatttgtattcaaatattaatgaatgtataagaaattataacactgggtaagtgaagacctgatttttggcaaagtttaaaggtaagaactctgggggagttctacgctagtctggtggagtaagtgcttaagatgaaccttcccacagataacagctaaaaagctacaaaatacctacatgcatacatacatacat

SEQ ID NO: 143741 - DNA, 608 bp, Homo sapiens
acaggggtgggctcaggaatcctagggctgtgtgcacaccgagaaaggctgtgtgcaccacagctgggccatgtgttggagacaccatgtacgcaatcccctgctttcagtacggacagagccctgcagcaggggagtggcagaactcgcacttacgcagagggccagaggcccgtggggttacaaggaagtggaggggtagagatctgggcttgcgcctccctctccgtgggtccctctccccttccaacaggacggacctcccaactaggcaagctgttcattcaaccaaactatgtctgttgaggggcagtgcctcagtgtccccatcggtaaaatggagagagtaacagtatctaactgggttgtacggatcactgataaaacctgcatagcatagcccctggcaagaggaaacacactaatcacacgagtggccgctgcacggtcactactgtgactaactgcctggtcctggcgactcggagatccctgcactcctaagccttccaatctgtgacatcccgggctcccggctggccggccagtccttagtctctctgcatcgtaaagcaccacccgccccagggtgcatgggtttacccagc

SEQ ID NO: 143742 - DNA, 285 bp, Homo sapiens
ggggaaagtagtcaagtaagtgaagtattacataaatatggaagaaaagttttgaagaagtcattttattgtggaagtttcaataatctacctcgggtcaagttttttatataaaaggccagatagtaaatatatacatatttaaacttaaacacttttaccactaaaagcttatgtcaaattatagttttgcctatttacatctgacattgtctgaagaacagagccaaatataaaaataggaagaaatacctatgatgtgaaagtcttggaacgtgtcttagt

SEQ ID NO: 143743 - DNA, 460 bp, Homo sapiens
gtacacatcctactcatattcacttaataatacctgaatgttttttgttttttgtttttgtctctaccatgtggtcacaaataacccaaggagactctgactgctttctaagaatcaacttgttggtgatgtcaggcaacccagggaccacacaaaaccaaatactatgccaatcagaacctaaaggctcagagtctcttttttccctcactggtttgagagtctgagaggaaactagaggaaacagtctgtgtgttctcaaattgaacccaggtgagtcttcagagcccagtgttcaaagaggatgtgtaaagctgacctctgggtcaacctctgctgtgcaatagctttggctgcttggcccctgagtgagaaagagaaaggtcaaggaaactaagtgatctaaggaattgacacgggttaagtaaggactaaagccatacattttcttattgaaact

SEQ ID NO: 143744 - DNA, 334 bp, Homo sapiens
tgcaaccattcatgtttaggtcctgggtccaaacaagtataggcacatgaatttgcctcatggtttgtaaaacctcaccatttagggtactccagttgtaactcagcctttggctacatttcttaaagttctgaagccacctccctacagttctaattttaagaaaatctgcactcatcgactctgaacttcacatcatctaggaaagaaaacaaacaaacaaaaaactccaccagcatatgctgccagcatgagttacagatgcctgctgtttcagcttctggataaagaggtaactgcagttcagtgacatagagctacaaaaaaaaaaaaa

SEQ ID NO: 143745 - DNA, 859 bp, Homo sapiens
ccctgttcctgaagtttcccagaaatagatggagaggtaaggccagctaggctggagcgccagcatcagtagtaggggcaggagctcacgctaaacccggttggtgtgtcctggagaagcacaggtgtcatctccagggacctttctcgaccaactaatttatggaaatgagacatttgtaattgattttaattccctcttagggactgtgaaattaaaatggattaaattttgtccatcaggagcctcagggatttaatgtccaattctaaaacctgaacaggcccttttgttttgcaatttgtggaccaatccctggcttcattttatttggctttgctttcacttccccattttctgttattttttttttttttgtgctgttatgtacatctcttaaagctggtcaaatcatattttgggatggaatggcctgataagttaataaattatattaaactgccaaaaaaggaatgtgttttcgattcttctggcttcttcctggttacaccaaaagcatgggggagaaaaggaagggaagtcatcgagacacaggttgtcagggagattggggccaaggtctcaagccccttgtgctgggcaggtgtcttcttttcattgttccctgtggtccttcagacatgggtggctcttcaggcatgtccacaaccccaggagccatggcctcagtggccggtgcaactggccggagccacagtggctccgggtgtcggggctgtccttttgtccctttgatcttacgcagggtgagggagccaatcacgagaggctcacccctgacgtcacccagtccccagggccagtgagggccctgcgttccatggggccccctggaggg

SEQ ID NO: 143746 - DNA, 104 bp, Homo sapiens
  misc_feature (71)..(71): n is a, c, g, or t
ggttgaaggcgatcttgagtggggccccagcaattcggttgagccttctccctccactcgcttccgccggnccgggcccctcccgcccagcccctcgggcctcc

SEQ ID NO: 143747 - DNA, 411 bp, Homo sapiens
acgactatagtagtaggcattggtctgaacacaagggatgcagtgatgaaaatgctgaatagaatcctgtattcatagacctcgtagtttagcgtagctcatttagcacaaaccaaatctcagttccctggatcctagtttaggaaatcctattctaaggatatctgtcttaaatcagtaaatatagtccaagatagtaactgggtatagtaattttctataatgtatgtaatacatgtttgttttttggcataaatacatttggctgtttaaagactggctacatattgatgagaggaataatgttatactttgaaaattttttaaatagtagtagtagggaaagatacagtacaaatgggtgctaagttacttttgttcttgaacattcctttctgtgttgatcaagaa

SEQ ID NO: 143748 - DNA, 307 bp, Homo sapiens
caggctagaatgtcaggggctggagggagatgagtctgggaagacgggctgagaacaccttgaagcgttttgaatgccaagtatctacttttccaggtagaatagcaggtccgcattacaatctttcgaattgtatgttgacgtgactcgttagagttgtggtttttattttggaataatgtcatgtttcagacaagttgcaagaagagtacaaagaattcctttgtactcttcacagcgattagcaaattgtaaacaccccactgcgttcacccctaaccgcatttcttgccaaacctccctccct

SEQ ID NO: 143749 - DNA, 525 bp, Homo sapiens
agaaaggaggccacgaccaggcatggtggctcacgcctgtaatcccagcaatttgggaggccgaggtgggcgaatcacttgaggtcaggagttcgagaccagcctgagcatcgtggtgaaactctgtctctactaaaaatacaaaaattagccaggtgtggtggcgggcacctgtaatcccagctactcaggacgctgaggcaggagaatcatttgaatccaggaggtggaggctgcagtgagcagagatcaagccactgcactctaacccgggcgacaaagtgagattctgtctcaaaaaacaaagacaggtgtactgtggagttgctgagagcaactggtggcggggacacaggccctgcccttgagtacttcttgaactctcagctcactgccctccttcctggttctgggaaaatggaagcgcctgtcccagtacctgctcttggtccatgcgctctgctcccctgcctttgccgaggtgactgtccatgctgccacctggaccctggccctgctccagcg

SEQ ID NO: 143750 - DNA, 416 bp, Homo sapiens
atgaggaacgtcactcagccttaaaaaggaagggaattccagccaggcacaggggctcacacctgtaatcccagctactcaggacgctgaggcaggagaatcatttgaatccaggaggtggaggctgcagtgagcagagatcaagccactgcactctaacccgggcgacaaagtgagattctgtctcaaaaaacaaagacaggtgtactgtggagttgctgagagcaactggtggcggggacacaggccctgcccttgagtacttcttgaactctcagctcactgccctccttcctggttctgggaaaatggaagcgcctgtcccagtacctgctcttggtccatgcgctctgctcccctgcctttgccgaggtgactgtccatgctgccacctggaccctggccctgctccagcg

SEQ ID NO: 143751 - DNA, 179 bp, Homo sapiens
ctttaagcccaagttaagggacattttgaaggtggaacttagggcatatgtaggccataaggtgcccatgagattacaagggtgatttaacttgatttttcaatcatgccttgtgtgtggagtaaatgatgtaataagaatctagaacctgctcagttttctttacattataaaaatgt

SEQ ID NO: 143752 - DNA, 223 bp, Homo sapiens
attttttgcgagctcgctactacccagcagtacattagactatcaatcacagttcccttcatacttagaatatatacagtacagttatggatgtaaatctataggccttcagaacagtgattaacgtgaatcagagctctgcaaaaaaattactcatgaattaaatcggcttttgcgttctatgaaaagactcaaaatgtaaaattctacatgaatcattcat

SEQ ID NO: 143753 - DNA, 148 bp, Homo sapiens
gggttcttactatgtgccaggcattgttttacatatattattctcaagtgttttgagagcagagagaaaagtaaaaatgattataattacctatactgctgggagaaggtgggggaaggaaagaaaaagcttgccctgaagagatgac

SEQ ID NO: 143754 - DNA, 517 bp, Homo sapiens
ctaaacccctgtacagtctaccccctacctgcctctcagagctgaggtgtactcttctccatccctatagtactaggctcatatcaccactcccttggtagccccatcactggacttcctacccttcacccctccactgacctaccaccatctctattctggtccctggaatgcagtccaggggatctttctaaaacacaagtctgattatgtcagtcctctacttaaaaattttccgtggctttccactgtccctaaaataaagtctaaacttcttaacatggttaacatgattctctccaagtttcatcttcaacacatccccttctgcacgccacactccagcaatacttcttgctgttcctccaatgtaggtgctgtcttctctctctggttgtttccagtgcttgaaacagatcttctgacttttcttctggctaagtccttccacatctttagatctcaacttatgtcacctcccctggaaagacattcctcaacccccagtaagggttaa

SEQ ID NO: 143755 - DNA, 972 bp, Homo sapiens
ttcagtctcacacagatatacagttggaatacaaggaagtattttaatagctttttcaggtaattttgggatatattttgattctacaaaggcagatggcagtttcttaaaagttaattgtggtgtggatctgaaagcattatcagtgaacatttttcaaatgctattacattaaagtgcactggttgattttgtactttgaatgattttttttactaatgcatgattttgtgatatcaggcattgctcatcttgaaaatatttattcgctgagttaagcaaatattccaagtgttgatgcattttattgtatactaccatgaaatcattttgttagtgtcttcaccaatctcatcaggaaagtattgcagtattgggaagctgtcaagctcacagtgaaaaatatgttttacaaaattccatctcccccccaaaagctcatcttatcattgatgacaaatgttgtcagttgctttctttgaagtgatagattcactttcctcatttttaggaaagtgtttactatataactgtatatgatgaactatagtttgtcagtcattatttcaaataaaaatgatgttccaagaaaaaagtgtcaagttcagcctgaaactcagacactcaaggaaatgcttttctttgcagaagtgctttaagtgtatttcccattttgtcccacagaataataaaatgacatctacatagatgtccataattaatacaattaataacatactgtttcatttagaacattttaaagtccaactggctttttaaaagccctgaaagttcatgacggtgaaaaatacaagagttttgaatgtagtttggtgccactgctttggttcatgccaaggtgcaagttgttttacccatctttgcttttacacctttagtacaagtgtgaacatggtagaaaaggaaaataacatcttagtattattataaaaacagtttaacccagcagac

SEQ ID NO: 143756 - DNA, 951 bp, Homo sapiens
agcggactgttacggtctggaattatgggacgctggtcacaccgcgtttctgaagctttcgattcctcttcggctctgctctctgcagccgccctgccttccctctgcgcgtctgagccgagtccccggcgcccaggggcggggcggcggggtggggacactcatggaccccccagcgaggacctgctgggtgcgactacatggtcacccgaaggaccctgagagaggggcagctgtagggggtccttgaagagggtctgactgcggggtttgtgagcgtcagcgcgggggaggcttgggcctggaaagatgggggagatctggccgatagagacgtgagtgccccagaaaggggggccgaggtggtggaggcgggcgcgcggctagctggggtccaggacaggaggggcgggaggcagccgggaaggcctcaggcagggccagcgagcagcacctcctgcagcctgccaagtgcaggtacgaggccacccctgccctcacctatgtgtgacgcgtcgaggtaacctttctgagcgttgacttgtccacatatgccagtggggcaatctctgagggtgatgaacatgtgtaacatatgggaagctgtatagtggccttcccagcgtggctgcttcataaacttagtccctttccctcctggaggaaggaagtcaacccagaggcttctcactaatgggcactttcctagcacaggtaagcgtcaaatggaatcaaacagaagaggcatctcagagttcaacagaacaggtgcctggcctagctggcctccgtttgggggatgaataagaatccccttacaggccaggtgcggtgggtggctcacgcctgtaatcccaacattttgggaggccgaggcggagggatcacgagctcagaagtttgagaccagcctaaacaacatggtgaaaccccgtctctgctaaacataca

SEQ ID NO: 143757 - DNA, 155 bp, Homo sapiens
ctccaggagtgaccaggggacacccaccacagtaaccagccacagaggccattgggtaggttggctctcctgtccctcctggctgcatcctgatggccccacagcatcctggggagtcccgaccttcaggaacacacaatgagcttgaagctcag

SEQ ID NO: 143758 - DNA, 502 bp, Homo sapiens
tcttccattttctcaacccctgccccatcacacacacacacacacacacacacacggctggagaagagacagtaaggctttgactaatgctttgtatctgattcgagagatggcactactgttattcatgataaagctgttaccaaggagaaactctagctggggaaacctggtcctaagggaagagcattccagatggaaacgagcaatgtcaagggcggaagactaagatcttttcgaaaaactggttttgagaacctaagaaaacaacagattgaacaacgtataacccctacacgaggctggctgataacacttccctcacacacacatcacacacagacatcaatggtcgtagaatatgacacgtgagggaaaagactaatgctttgtatctgattcgagagatggcactactgttattcatgataaagctgttaccaaggagaaactctagctggggaacactggtcctaagggaagagcattccagatggaaacg

SEQ ID NO: 143759 - DNA, 211 bp, Homo sapiens
ataattggtgtcttagagatgggagtgggattgggagtgggttgaagggttagctgagatttcacatcttggtaaacctcatcataaatcggtaaataatatgaacacttatcactgacccataaaatacagacagaggctcttcttgagttggaaggagccattttggaaattcaaaccagatgcttattctgtctactgtataaatatt

SEQ ID NO: 143760 - DNA, 237 bp, Homo sapiens
ggagttccagaccagattgggcaacatagggagcctcagtctctacaaataatttttaaaaaggctgggcacaggccaggcacggtggctcatgcctgtaatcccagctgagggggtcggatcatgaggtcagcagatcgagaccatcttggctaacacggtgaaaccccgtctctactaaaaatacaaaaaattagccaggcgtggtggcgggcacctgtagtcccagctacttgg

SEQ ID NO: 143761 - DNA, 257 bp, Homo sapiens
cataaacctaactaaatttgctaaaacaacaaaaactttctaatttttactagttttgttttttaaaaagtttgtttccttttaagtgcataacactttaaaatgagctcagctgtattagcagataaacatgttgattcatttggtccagagctactgaatgaagcttgcaggagcacagtttgttctttatgccgcccaggggcagaatgtttctcttcctctcctccttattgagagaaggggactggaataag

SEQ ID NO: 143762 - DNA, 541 bp, Homo sapiens
cccattatacagattaaaaactgagagactcaacccgaagatttccaattctggatggatctagtgatctcactattgcagacgtgctgttcccaggcccagtttgcctggaggtctcaaagactatgaacatgattttgtaagcgtttgttctctctgcagaattctagcacagcaaaatgatttcagtggtccctgaggttagttctttatagtcttttaaccagacatggttcttgttatggacatgggagcagagatgctcggaggatgggtgtggtgacttatttcttcacaatcctgccctgcacactctcaggactaagtgtaatgtagcccagttatagaaacacacagagctgcaaagtcactttttctttgctcagatgcattgtcaccttgttttagtctcaagcaaacatgtagtatgttggggcttgcgtgcaagggaacaaggacctgactgcagtcatgctgaaatgcaggctggcaacagacatgcatgtacatacacacacccagaaacacagacacatacaca

SEQ ID NO: 143763 - DNA, 223 bp, Homo sapiens
cggcactctactgcttcttgagacatgggaaagtggcttttgcctggaagaacacgagtggttgcagttttctaacaaatgcttgataagtaacattctcttgagtaacctaatggtaataagttgaaaagagagaattaggccgggcacgatggctcgcacctgtaatcccagcactttgggaggccgaggtgggcggatcacctgaggtcgggagttcgag

SEQ ID NO: 143764 - DNA, 239 bp, Homo sapiens
ttaacctcataccaattcattaaatagagggtgtttttgaaaaagctcatgtgaggataggctatatagtatttttggattacatggagaccttttactttggtccctactgatccttgtgatttttaacaatgcatacttcgaaatttcagtggatgtttttctttatcattgtatgaataaggttttgaagtacaatgttttgtgcccctttatttaagagagtcagaggtagatga

SEQ ID NO: 143765 - DNA, 414 bp, Homo sapiens
aaagagagctcagactctcaaacacttccataagcccaaatcctgctttccatttctctacaagctcttttttggaggggagagctctaggcctcttgcatttggccaggtgttcagggggcatgctgcagcttggaatccagcagtcattcgtatccaggcatcgcatcccctcgtaagacctgttctcaggtggcaatgccccaggcatgggccgcctgcaatcagagctagtgagttcatttctgatcactgtgtaattatcccattaccaacacacgctgaaaatcaagaataaccggagaaaggcaagactcccttctttgttcctcctgttacacacgactaaaatccggactatagtcgtcaccaccagacttgtttgcccctcaacacctgctagcagttgaatca

SEQ ID NO: 143766 - DNA, 977 bp, Homo sapiens
ttctttagaccaggtagtcgctgcccagccggtcaggacgtgggacgcaaggggcaatcctgcccggttcgcaggtccgaggcgggcgcggtggcccttcgggccccgccccgcctcgggacgaagatacaggtccaagggtgcgacattgttaaccaggattccatgcacaaaagtcggggagggatagcagtagcattaacgaggaataaaaagtcaggaagacagaacaaatgggaggacgtgagtggagccccaagagtgatgggacgctaaactcgcagacaacagcggtggcaacagaacggcatgcgaggcgtcgccagagagggccggacgacacagaggtcacacacaaatactcaccaaagtgacagggacgcaaccaagaggcatgcgcagaccatggccgacaataaagatgagacccacgaacaaagcggtgctccatgagacgcgaccctgacgcggccgacagcagtcgcctcagagcggcagaaacccacactagtaacaagaacattagacggggacagaagaggcaggacacaagcaacggaggacatacactgggaactagtgagcgggagaaggatagcggacgcaggacagacatcaacgaagcaactgttgcagctggggagacacacacgagcagcagaggagaagaaggcgagagaccacagctaccccatggtagggaccaacaagcaacgggggccagcacgtggacaccaaaggcagcagtcccaccagtgaccaggttgcggaaccaggcagggatgcactaaccgcaggctgcacgatagaggctaaggggaccacgtagaacacacgccaatgtagtgccgacaaacaactacgggagacaaacagactgaagacaaatacgtggatcagacgggggaccatccattaacaagcggcgacacacccgtgacgagtggggtaatcacgcaatcgatcgcaaacggaca

SEQ ID NO: 143767 - DNA, 413 bp, Homo sapiens
atcagctaatcagaggtgatcctccaccagaaatgtgaatgcttgagggaaaaattgaaatgaacataaatccttagaactatatttttgagagaggtaaaaaattatggttatatgagtatttccaaagatagcaattaagttgcaaaaatcatattgaaaatgatgatattcaaacaagtacttaacccttacatgttttggtctccatggctatagtggcagaacttgtaccccattgttgtattgatgatgtcatctgacgtgtaacaggcattggaagagttgtccttatgggtttagtgtttattcagctcagtgtggagaaaaaaatgtttttttaggaaactgtgcttattttctttcctctcacaattggataataaaaccaagttttacaattcagagaagaa

SEQ ID NO: 143768 - DNA, 162 bp, Homo sapiens
ccagctccatggtgaagcaggcagctgtttgctaatagggcggcagagagaagggaggtagagcgggaaattaatttagggtgatgcccaggagctttgttacacaactgcgctggcgtgctgcccctacagaaatagggaaagccttggggtgggtgtggg

SEQ ID NO: 143769 - DNA, 422 bp, Homo sapiens
atttgattaagtcctccacacccctgtactgtttttcacagcttcttaagcctctatcagcttcccctgtgtcactctttgctatcacaggcttgttgctgtctcttaatgctcttgaaggtatgagttgtctgtttttatttgttctccttgttggatttatgacttttggaggagtatgagtgggaagattcaagatcagaaaggcatcattaattgtcctccaaaccccttctcccataggaacagtaatcttttttttcccccattgatatatcttgctcctggatcaaggtctaaagcatagtaagaactcaacaagtttactgaatgtcatgcatctggggtcctcaggggttggggtggctattctgaataagaagagcctgctgccacctagtagctcttcctcaagtttgacc

SEQ ID NO: 143770 - DNA, 135 bp, Homo sapiens
cataaagcagatggtagtgcttaacataagagtgttgtagccgcagcctagaaacaaagcaacatgttttagtttggctgtaattgatgtgatttatcttatgccggaacaggtgcccacgtggtatgatctgag

SEQ ID NO: 143771 - DNA, 1005 bp, Homo sapiens
agcggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacag

SEQ ID NO: 143772 - DNA, 431 bp, Homo sapiens
gctgagattacaggcgtgcgccatcacaactggctaatttttgtatttttagtagagacagggtttcgccatgttggccaggctggtctcaaactcctgacctcaggtgatccacccgcctcggcctcctaaagtgctgggattacaggcgtgagccacctcacccagcaatattcacagtttcttgagattaagatgtggacatctttgagaagctagtattctgcctaccacaaagactaaaaaggaatagtcaaagagaaaggaaagtccctctgtaaccgagagagtgatatttcagaggttaagtgaagactttcaagagttaaaatgagaacgaaagatacactgttggcaggagtcattggcaatctttgccaaaaaagtttcagcagggtgggatgggcaaaaggtaaattacagtggattga

SEQ ID NO: 143773 - DNA, 264 bp, Homo sapiens
caggggagagggcgatgaagtgcagagtctatgtgacttgcttcggatgtcttatctatcaggtggtctggctggcaccgtcacgggcagagctaggttgtaagttgaggcaatctcaatttgcctcctggtaggagagagttctggaggttcctggtttgctttaaggttcggtctctgtaacttctaagtaaacatgtagttagataagcttgctgtgtagggagtgtctggtggagagaaggtaaagtttataattgcatt

SEQ ID NO: 143774 - DNA, 248 bp, Homo sapiens
taacattccagatggtgatgtaaagactgatattgtatataattggtagagacattaaaagttatataacccaggtggttatactatcaaattctagtaatcatctgatcatttattttgtttcacgattcacatgtttacataagcacttatcatgatgaataacgataagaaacatattctattgtattgggtgtccatttatgcaaattcttgagaatccttaaattaagggcacaaataatgat

SEQ ID NO: 143775 - DNA, 350 bp, Homo sapiens
acaggaagtggcaacaaatggtacagagggatcctgtgtgcccttcaccccacttccccagtgttaatattttatgtaggtatagtatgacatcaaaaccaggaaattgacaatgctacagtcttattcagatatcatttgtgttatatgtactcatttgtgtgtgtgcacatgtgtatgtagtcctgtgcagatttgtataatgaccaccataatcaagaaaacctttgaggctgggcgctatggctcatgcctgtaatctcagcactttgggaggctgaggcaggaggatcgcttgagcctaggagcttgaaaccagcctgggcaacataatgagacctcatcgctat

SEQ ID NO: 143776 - DNA, 138 bp, Homo sapiens
caggggaatggcagaaagctttcgtgcagtttcctagtcacgtttttaacttgcctcctttcaataaactgaaaaaaatctgccctcagcgaagaaacgctgcattttctgttatccttaccaaccggaatagtcttt

SEQ ID NO: 143777 - DNA, 306 bp, Homo sapiens
ctcattctagtcccaaccctcttaactatgataaaaactctaaaccatcaacaccacccccatcttgacttgtgtcaccttaggtagaatctgagcccttcaccttggggaatatgtgagtagtaaactttattttatatctgtaattcctatgttttattcatcctagcattcataaatttctgaggatgctggatgttcatataaataggtttattagctttagatagactaatgatgctttattcaaatgtgtggttatttcagatcaaagaaaaggaagcattgtgcttgacacagggctaa

SEQ ID NO: 143778 - DNA, 516 bp, Homo sapiens
tcttgcacaaactcatgagatgggtaagtatgataagtatcaccatttttcaaaggaaaaatatgaacagaaagtcatttgcccaagattcacaattatgaggtagtaggggcaggattagtttcatgtatactgaaatccagaacttaagtaaaaggccccatgaatctgaactggtgttagtggaattacaacctaaaagagattgaaaaggggggaaagtagcataaaagatgaggttacaaatagcataagatggcaaagtatgtgctcaaaactcttccagctgggtacagtcgctcacacctataaacccagcattttggggggttgaggtgggaggattgcttgagtccaggagtttgagaccaccctgggaaatacggcaagaccctgactgtacgaaaaaaattttttagttagctgggtgtggtggcatgtgcctgtggtcccagctacttgggaggctgaggcgggaggattgcttgagcccagaaggtcgaggctacagtgagc

SEQ ID NO: 143779 - DNA, 747 bp, Homo sapiens
cttttaaatgaccagatcgcatgagaaatcactcgttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagcctttgtttcctcactggtaaaacaagtatttggaaatatcattgtgaagattagaaataatacatgaaaagatcctaggatgctgtctgtcatacagtagtagtagtaagaagttattcttgccaaagattgttgagaatggcagaattatctcagttctaagagctatagtttctaattatttgagcctagactcagattcatttggagcagctaactgctcaccaagagcttattttccatcttaccaatgaggttatgtgccctgtgtttttaaaatcagtctacttaaccaagagaacagaaatgacatgagaattaagtaatctcactttctctgttatttaggatttattcctactcaaaacctgagagttgctatgaattcaccattaaagcacttattaatatac

SEQ ID NO: 143780 - DNA, 237 bp, Homo sapiens
catgggttttcaaactggagtccttggatttcagatattatgtaagccctggaattgcggcatttggggggttagctattccttaacttttaccacatgctcaaaggagtctacgaatgaatgggctaaattgagaattattttaaattataaggcgcccatctccattgatcagaatggaggctgagatagttccttttgtatgaggtataccactagtgcctatttgctgcagga

SEQ ID NO: 143781 - DNA, 577 bp, Homo sapiens
gcggggcggtgtccgggttggggatgctttgtgttgtctcgcgttgggtaacaggcctgagcttttggcggagagctgtggaagtgtgcggtttttgtttttgttttcctttatttttattttggggccttaggggtgagttaggacggaaaggagggtgtcttttcgagggttgtcccatcctgtgacagccgagaaaaggcgaaaggagagtggcgaggaaagaggaggagacgtctcctgagggagggcgcttgtggagtctctgtggaaggaagaacactgtagggggagtgccccctgggcgagggagggtcgcgggacgcggcggagggggctcacacgggcgtctgcggacctgaggcggcgacaggaaggggcttgcgctctggggctgtcgcttcggaacacttctccttcagtccattgctgcgctcgccctggctgctgaataaatggtttcggagtgaaaagcatctcactgaagaacttgtctgtgtctgtgactgacgggcggtggaacaccaaagggagggtgtcgcctgattgggactggaaaaattggaattcagggcgc

SEQ ID NO: 143782 - DNA, 458 bp, Homo sapiens
cctttccaatttagatgctatttatttctttctcttgactaattgctgtgtctaggacttctattactgggttgaatggaagtggtttggggatccttgtcttttttcagatcttagaggaaaaacattcaacttttcacccttgagtatgatgtcagctgtgggcttgttgtatatggcctttattgtgttgagggtgttgaggtacattccttctgtatttaatttgttgagagtttttttttttaatcatgaagggatgtcaaactttgccagtgctttttctgcaccaattgaaatgatcatagtttttgtccttcattctgttgatatgatgtatcgcattgatttgcacatgttgaaccatcctttcatcccagggataagtcctaattggccatgatgaatttttttttttaatgtattgttgaattttgtttgcttgtattttggtcgac

SEQ ID NO: 143783 - DNA, 592 bp, Homo sapiens
cacgctgtggatgcaagagtcaatcagatgagtgtggtctctatccttgtggagttaacaggctgaaaccttaaacttggtaagagagacaacattttaagtagctgctgtccatgtgttctgaattggaaacaagccaaagaaattcaagttggaaaaacatcaaaaaatacctgaattctctctatgatataaagttaatatcactttattttaactttgtaataagacattttctggccttatataactctggaataataaaatagctttagtaaatatccattgagtatccttctgtacagggaccatgtgttacagtaggtacagaggtgagggagtaagacaccctctctatgatgggagtttacagccagagtgcaaggcaagccgacagacatccatgatacaaggcagaatacccatgctctagaggaaggtttcacagagctgtgggactaaaaagtagaagagatcatgttcctgttgtaaagatcagggaagatttcacagaggagctgccatttgtggtgggccttgaaggatggataagtgctcaaaagacccagatgggaagggcagagggaccctg

SEQ ID NO: 143784 - DNA, 346 bp, Homo sapiens
attgctaaaagactaggaagttatacatcaaagtatgagcactagttgttccttaatttgaggattatttataattttcattttccccacattttccacaatgagcaagaattagtttcgtaaatagagactataaagcaaaactcctgaacattatttaaaaaaggcaataaatgcaaaaaaccctcaaaacatgctacatgtcattgaatacacacaatatacacacatacactgtcatatacgaagtaaaaggaaactggtgactgttgatccatgagcattggcttttgaagcccttgaatacatgtgtaggcaagaagctgtactttactcttcgaacatc

SEQ ID NO: 143785 - DNA, 739 bp, Homo sapiens
tagagatagaatgaaagaaagcaaattagcaaaaatttagcactagtttaatttagatggagagtatacgattgtcatgctattattaccaactcatttttttctaagtacagaaattttcaagaccaaaaattagggtaaaaaatgaacttagaaaaaaaaagtatttctactaaattatatacccacatatttacattatattatagtatttttatgtatcttttctgaaataaatgaaaaaatactttaatgcaatcacagttctacagctttttaaatgttctgtgtataacattttccttaattggcagtagggtaagatttatgtaggtaagtgcttccttttggggtttactatttggttgttagttcaagagtttcctgttctgtaggtacaatgaaattcaattaataaatggctcaatttggggacaggtgtagacactttgtgtgtcattaaatttagagacactaatgccagcaatttgggaggccgaggcaggcagatcacctgaggtcaggagttcaagaccagcctggccaacatggtgaaactccgtttctactaaagatacaaaaaattagctggccatggtggtggacgcctgtaatcgcagctaccctgggggctgaggcaggagaatctcttgaacccaggaggcacaggttgcagtgagccaagatggcgccattgcactccagcatgggcaacaagagcaaaactccatctcaaaag

SEQ ID NO: 143786 - DNA, 240 bp, Homo sapiens
cccaaagagctaggattacaggtgtgagccatcacccccagccaaaagttctttaaatttatcttcatttttctcattgtgcggcagtgctctaaacttcacagcctggcccccttaaaggatggcagcccttcggtgaagccctttaactccgctgcaggccgcagtcctgtgtgctctctgcctgactcccctctagcctgtgttgacatgggggtgcactcaggatgcccactggtg

SEQ ID NO: 143787 - DNA, 308 bp, Homo sapiens
caggtttgatttcaagttggagcatgtgtcatttctacatgcttctgagacacttacctcccggacacccctgctttcttcctcttccgtctgtcccagcctgtgtattcaaatgaaacttttagagataaacatagagaaagcatgatttccattttccatctccgtgttctcagagctgctgtttcctttccctatgtgcaggggagttattagcttgttatgattggtaatgccctacccgctactctctttcccaatatagatttccttttacttcctccttcccatcacctatggcttttctt

SEQ ID NO: 143788 - DNA, 687 bp, Homo sapiens
cttcattaagaggtaggatctttatcccttttccttgaattagggccttgtgactgtttgactaatagaacacaatgaaagtcccactgtgcccatttctggcttgggctttaagaagctagcagcttctatttcctatctcttaggatcattgctcttggaacccagctaccatgccacaaggaaacctaagcagccagtgcaaaacccctcatgggcacctgcacatagctctagttgaacttctagttgatagccagctcccacttgccagccatatgagtgagtcatcctgaaagcaggtcctccagccctccctcagctgagctgcccttgatgacattgtgtggagcacagattaatgattcctgttgatccctgcccaaattttagatttgtaaggaaaataaatgattactgttttttaagccactaagttttgaggtgtcttttttttttttttctttttggagacagagtctcactctgttgcccaggctggagtgcagtggtgtgatctcagcccactgcaacctccgcctcctgggttcaagtgattctcctgcctcagcctcccaagtagctgggattacaggcacctgccaccacgcctggctaatttttgtatttcagtagagatggggtttcaccatgttggtcaggctggtcccgaattcctgacctcaa

SEQ ID NO: 143789 - DNA, 390 bp, Homo sapiens
aaaccagagagaagcctctgaagaatagtgagtgaagagaaaggcaggcctgggtcagaatcctagtttagcatttttgtgaaagaatagaagaggaggccattcaaaaaaatacagggacattgagaagggaagtgtcctagatataggacatccagatgggagtagtcagccttgtcagatgctctagggattataaggaaaaagagttttgtagagagacagaagaagctagattgaatactattgagtggtagagacatttgaaaatgaaaagcttgaggtaagttatttggtcagtgagtttttcttgaagtcgaggataggaagctgttgctggagggaaatatgagatgtttattttaaatgttggagagattatgttctttt

SEQ ID NO: 143790 - DNA, 815 bp, Homo sapiens
gagttcaagaccagcctggacaacatggtgaaaccccgtttctactaaaagtataaaaattagctgggcttggtggtgtgcgcctgtagtcccagctactcgggaggctgaggcgggaggatcacttgaacctgggaggtggaggttgcagtgagctgagatcgtgccactgcactccagactggatgacagagcgagactccttctcagaaacaaacaaacaaacaaacaacaaactgagccaaggcagaagcagggactgaaagagaaaaagggaggagagagagaggaagcgggaagcacgggcacagagagactcggagagagggaggagagagagaggaagcgaggttcagagagactcagagggagaaagagaatcagcaaaacacacagagacttaaaggagagaggcagagggaaaggaaggagagcaaaaggcagggacggaacagagaaaagccagatgaagacagcacagagagatgggaagagacacagaagaaaggcagagaggtccggacgcagtggctcacacctgtaatcccagcactttgggaggctgaggcaggcggatcacctgagatcaggagttcgagatcatcctgggcaacacagtgaaaccctgtctctactaaaaatacaaaattagccaggcgtggtggtgcatgcctgtaatcccaggtactcgggaggctgaggcaggaggattgcttgaacctggcaggcagaggatgtggtgagccaagatcgcaccatttcactcagcctgggcaacaggagtaaatctctgtctcaccaaaaaaaaaaaaaaa

SEQ ID NO: 143791 - DNA, 763 bp, Homo sapiens
gtcctttatctgcaatttggaagcccaaaaaactctgaagccaaaaggattttcctgtatttgctgcccagactcttctgtgtgaagagtggataaatgtggaatcaattaatgaatgggaagaggagtgaggagttgaacaggtgaacaggagagtgaagctatttaaattatatatttttttggtttgtttgtttaattgtttgtttctttgttgagatggagtcttgctctgtcacccaggctggagtgcagtggcacgatctcggctcactgcaaccttcgcctcccgggttcaagtgattctcctgcctcagcctcccgagtagctgggattataggcgcccaccatcatgcccagctaatttttgtatttttagtagagacggggtttcaccatgttggccaggctggtctcgaattcctgatctcaggtgatccgcccaccccggcctcccaaagtgctgggattacaggcgtgagccaccacgcccagcctatttatattttttaataataatttttattgataaattttaaaaattagggggaaaaggtgtgaatagccatacccttattagcgtttcattgttttgtaacaatacacatttaccaagtagcaggagtctgagcatggcttgactgggtcctctgcttatggtctcaaaaggctacaatcgagctgtcatcagggactgcagtctcacctgggttcagatggggaaggactcacttccaagttcactcatgttaatggcagaat

SEQ ID NO: 143792 - DNA, 134 bp, Homo sapiens
acgtttaaatgatgtaaaaatacattaatcaataaatcatctcctgtctgtgaaatggggtagtaacctaagtggactgtgtgagtcctctgcagtactaacctatgtaaagtgcctgagtgaatggaacagaa

SEQ ID NO: 143793 - DNA, 479 bp, Homo sapiens
cgtgtcagagttgacttcacagtgtctgcgtcattgtatacctgctacggtgcaggctcagccatctgcaacttccattgtccccctggaacccggagggaaagagcccctccctccattgggcatccgtatatgaaccatgcagacctctcctccctgtcatagacaaggcactgaagcccctagaagaaatggccaccagtagtaaggggctgactcaagcatctaccacatgctggcgctttgcatcactgaccctcttcaaccttcccaaactgtgtgacatggtgacatcaccccaaccaccctgactcacaaggacacaagctcctggaagggacctgaccgcgggcagtggagtttggatttgaacccaagttggtggctccagaggctgggctcttctcatcataaggccctgtgaccctcccaggggatgttccccactcagcccctttcctttggggacagccacactg

SEQ ID NO: 143794 - DNA, 544 bp, Homo sapiens
cttggtcttcttttcattttcaagactttgacagttttgaggaggactagtcaggtattttgtagaatttccctccaatgtaggttaatctgttgttttcacatgattaaactgagggtatgggtttgagagaaaaaaaaactggcagtgaagggcctttctcatcgcatctaacaagggtgtatgctacaaacatcacttatcactggtgatgtgttcttgttttttagtatcactaaatgcacattgtttttaattttaaaatgaggctgggcgcagtggttcacgctgtaatcctagcactttgggaaggcagcgcaggcagatcgcttgagctcaggagttcaagaccagcctgggcaacatggcaaaaccccatctctaccgaaagtacaaaaattagcagggggtattaggacacaactgtatccccagctactaaagaggctgaggtgggatgatcccttgagtctgggaggtcaaggctgcagtaagccgtgatcgttaccactgcactcacaccagtgtgggtaacacagttgga

SEQ ID NO: 143795 - DNA, 816 bp, Homo sapiens
acaggtgtgagccaccacacccggtcgagggtttcaactcttttccagtcaataacattagaagaaaatgacattctgggaggaaaataatccattaacattgttcatgcaagtgttttaaattccactgccctaattttaaatactgccattgttcaaaaaaagttcactgtgcagtggtgcgatctcggctcactgcaacctctacctcccgggttcaagtgattctcctgcctcagccttccacgtcaccatgcccagctaattttttgtatttttagtagatacagggtttcactgggttagccaagatggtctccatctcctgaccctgggatctgcctgccttggcctcccaaagtgttgggattacaggcgtgagccaccgtccctggcccactgaacttttaaaattggtatataatgtacctctattaaaagcatctctatgtgtgggtcaaaggaaaatctagtaaagggccatgtgaacagccatcagtaactgaagagaggtgttgctgagtggcactgagttgtggggccagaacacaggttttgaagtcattgggagcaagatgaaaaaaatcctgttattttcctatggaagagaatgtattgggtactcagctgatttgaaacagtaaaatgctgtggaaggctggaggagtagctgctatctactaagaatgaaaggaaaaagtaagttttaagtgttcaggaggagttagtgagccttaggaaaagacatgtaaaacacaagaacatgtttaagagagaaattgtggacacctttccctttaaaattatgtttccatt

SEQ ID NO: 143796 - DNA, 371 bp, Homo sapiens
tggatgaggcctctgcgatatcgacaaacttgacctgagtgtgtactcatgggtgtcaccagctccggacaccttcccaaaacacccgccgtctggtctacaccaggagacggcatcccgtctgctttagtttcctatcaagacgtgtttgcctccagaactcggatacagctctagccccactggcctggagggaatgtcagggacaaggacacacacagtccacagatcgccagatctgaccacgccgagcactgtccccagaccacgtctgattgaggagaatgtccggggtggctgtggaaggacagggttggagtgcggtggcacaggtggccacagcgccaggcctctgaagccacagagctttg

SEQ ID NO: 143797 - DNA, 357 bp, Homo sapiens
aaacaatgttttaaagaggaaaggggtgctaatattctccccttacaaagtgagggacgtaagagtcatgcattctgtcagcatggctcaattatacagacagaaataggagtcagagaaggcaattagctcaagttgtttcagggtaaaagtgtatgagaataagacttccagttaaataaagtggcttgaacacacatatctagttctgttaccactcaaaactcttctaaaatgacagaaaagggagttttaaaaaggtttaaaacagtggttctcaaggtggggtgcaaaagtccagcagcgtcagcatcacctgagccctcgttatgaatgcacactcccgagcccactgaa

SEQ ID NO: 143798 - DNA, 313 bp, Homo sapiens
ggaaattcatagcccttagagatggggcatctgtgaagggtaagtagaggaaagggcttcatgagaaccccttcctgtgcaggaattgagaacagagttccagggatttccaccctggcaccccttgcctggtctcttctgaccctaatcatgcaggtctgaggtttgctgttcccagattactgggccctgaatccagcttaggaagctatttgtggctgagaggaatagagcagttgtgttctgagcccttggccactctgccccttattctgacctgaccctgggtcccaggcctcatcctttctagaag

SEQ ID NO: 143799 - DNA, 298 bp, Homo sapiens
ccttctctaattggtggcagctcttgactatgtcttcctgtgagaggagcaagttcctgggccaaatggggtcagagcatagccaccctcccattctgcctttctctctccctcttcacctcccttccttcctctctttctttcacaaatatttcctgggcccctgtgacaatgtcagacactgctagatactgtggattcagcgacccatgtcttagcttgcgcagagatgctgcccactctgtgaagcctgtcctgacccccaccctagcccctcccgcagtgggcagtctcctcc

SEQ ID NO: 143800 - DNA, 425 bp, Homo sapiens
atagcagcatccctggcttctgccctcttgatactggtagtacttcccagttgtgacaactaaaaatgtctccagatattgccacatgtgtcctggagggcaatatcaacccccattgagagtgatcccattccggtgttgcctgtggggagaaggaaggagccccatcctctaggctgtccactgtgagcgctttacctttcatgatcctcacttgtgaccagttgaagaaaggagactgtatctgaaatgctaatttggacttcccttcaacctagtcgaaaacattttaatttttataaaaacaccaaaactgtgaaagcatgcagcatgtgaaactatcctagccattaatagctggagttgggaaacagaagtaccctgaaatgttgtgttaacagtatctatgttggtctgcgcgagtg

SEQ ID NO: 143801 - DNA, 308 bp, Homo sapiens
cgttcgtggaagggatcaagctgactcagaagcgtgagctgcattgagggaaaactatggccagagtaaggcctcactgagagaggtgacgttggtgatgctggagctcagtctctgacggggacgacggacgcagccacatatagaagtgagggaggggcggttaggtactagaagctgtgttctagaagctggacgtctgactgtattgtggtcgatgtcactctgtctatccatgatcacagcaggtaggatggagcttagacttcaggaagaacttcccagtggggaagctgggggggagagag

SEQ ID NO: 143802 - DNA, 111 bp, Homo sapiens
actcaagagcccaggttccccatctctgctgtggggcagtcatttggcatgttgtgatggggtctggacagctctgtccccaactttgggtcacatatgagacctatggga

SEQ ID NO: 143803 - DNA, 147 bp, Homo sapiens
gatatttctgtgaccaaatgtgagaggagtttccccacacaccagctagctgtcccctaattcgattcagttcaattcaattcaggtgctatctacctggagacagccttggaccccacaggttgagggctaaatccccccacaaga

SEQ ID NO: 143804 - DNA, 326 bp, Homo sapiens
acctctgaccctcactgggctcttactactcacttggctgaagccactaactcccctgccctggggtccagtcagtgtgggagaaaaagccctggagactttttgcctgttctggttggctcagccaggagctttggctacaggaatggtaaccccctccccgctaatattatacccactgttcttatgggccgaagccaggattattctggagccttttgctgtgcagagtgtgtcttccgtgtgggtcagccataaaacaatatcatttctccctctgaaggctcctcaaggaggcggggtgcacaaatgtagattataaagct

SEQ ID NO: 143805 - DNA, 656 bp, Homo sapiens
ttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagag

SEQ ID NO: 143806 - DNA, 701 bp, Homo sapiens
atgaccaggggacggatacctcccccagcctttcagaaccacaccatgaatttggagacgtaactggtgtcttatcagcttggctgctgtaacaaaatgccacaaactgggtggcttaaacaacaaacatttatttcttagagtcctggaggttggaagtccgagatgagggtgccagcaggatcgagttcttagagtgggccctcttcctgggtgatagacagccatctttttgctatgtcctcatgttgtggaaagagagcaagctagctccatcacccagttatgcctctgcaaggccccacctgcaaataccatcatactgagggggcctggctcatggcgtcccacttttccctcctcttgctgccttctacatcctggatgtgagtgaggtgtctggagatctttgagctgagatgctgcccaggcctgcaagtgcagctatgcagcctgtatccctgcctctttctaaaaacaaggaagaagatccctccttctgctgggattaccatgaacctgttcctgttcaacctgcccctgacccagattgctgggacttaggaatttagacctctgagagtactgccgggaacatgatggtcatcccttctctcagctgaggaaactaagactctcgtggttcgataactttcccaagagctactgaaaaattagaagcacagatagtagcaaaccca

SEQ ID NO: 143807 - DNA, 146 bp, Homo sapiens
gaactaaacccatagactgtttccccttctgttgctaaccaggagaagaaaagtggtatgtttataaaagtctctgttatcccattaacaggccccactttttcctaatctgaaacttcacctgccactcaaacataaaaacaagt

SEQ ID NO: 143808 - DNA, 104 bp, Homo sapiens
aaaaccatatttggttatgtaattctatatgaaaacatctaaatactttcaaatagaacttgaagctcttcaccatctggccatttccatccttttcttctgtt

SEQ ID NO: 143809 - DNA, 440 bp, Homo sapiens
aaatgtgacacagagacatgaagtgagcatacattgttggaaaaatggtgccaatagacttgctcaacacaggattgttacaaaccttcaatttgtaaaaaaggcagcatctgggaaacataaggaagtgaagcacagtaaaaacatatgcatgtataaagcttagtgagttttagtatatagagaattgtaaaactattatcactatttaattccaaaaagattttatcacccccgaaaagaaacctatacccgtgggctatcacttcccttattttctttttctttttctttttttttttttaaattatactttaagttctgggatacgtgtgcagaatgtgcagttttgttacataggtatacacatgccatggtggtttgctgcactaatcaacacgtcacctacattaggtatttctccaatgttatccttcccc

SEQ ID NO: 143810 - DNA, 253 bp, Homo sapiens
acatggggaattctctcagataaggaggagaaggaggcatctacaaaactcagtgaagccaaggtgagggccactgttgcagggaccctgtgggaaatgctgctctttccttgtcactagggtaggctcttctgcgctggcccagctctttctgtcacttgctcccacctacatgaccctctccacaatgggcagcctgctcacctttctttcccatcaactcattcttctgacttgttccaagtcctcctga

SEQ ID NO: 143811 - DNA, 388 bp, Homo sapiens
tgatagaggctaatgttcacggtattggaaaatgataagaaaacagcagccggagagaatgtgagaaagccagtgaaggtgctgctttagcagagtccaaatgtcaagagttatcccctactaaccctgaaattgttctgggatagggtctaaagaatgaaatccaaagaacaacagagaagaacaccagagaatacttggagagaggaaacaaattgctctaaccaatggagttttaaatggtctagtttaaaataggttgaatttacctaggtgttatgagaacttaagaacttacataagtggcattcattggtatggtcaaagaggttaggtaaggcttctttgaggaagtcacaccagaatggtaacacctcgtgccgcctcg

SEQ ID NO: 143812 - DNA, 236 bp, Homo sapiens
ccattttatatttaaatggatttttcctattaaatattaccatagccttgtttttccaaataggatacatattcaaacatacaacaatgcagtacaaagaaaagagtttttaaaaactcactaactgttaagattttttgcagacctcttctttagatctttttttaaattacatattttgtgctgcggtctatttgccggttgttttattttttccctcagtgatatatcaaatg

SEQ ID NO: 143813 - DNA, 294 bp, Homo sapiens
ttcatttcattcacttccagccacccactcagggctagctgaatctcaggagcccctctcctttgcccctcaccagagtctagtctcccagctctgccttctgggataggctttcttctctgatcagatcaacttctaaataaatattaaattatgtctgatgtgtttccctattcctttcaaatctaagtaaatcagttcatccctttgttggaaatcccctagccctgctgaggcctccccactgatgtctcacattcttgacagtgacaagatttttctctagatattaga

SEQ ID NO: 143814 - DNA, 363 bp, Homo sapiens
attgactgaaaaagaaagagacacatttataagaacataaaatagttaaatgtgaattcaaagcatttactaaagtttatttcttagccttagtactcaatgttctaagaaaacattgagaaaagaaaagaaaagaaaagaaaaaagaaaggaaaagaaaattgtgtgggcttgttcatacatgccatctccaagacagtatctatagcacggcaattaagagcatggggtctagggcagacaccctcagtttaaattccagcttcactatgtccacctctgactttaatcatgtcgctttatccatgtatgtcctggctcctctctcattaaaataaggagaacagtatctatactacaggg

SEQ ID NO: 143815 - DNA, 440 bp, Homo sapiens
cctccctggctcgggtgggcagccgtttttgaggatagagtgtggttgaatttccctatgtaacatacatgagttctgcagttgccctctgttagggtttcaagaaggttaatctattagggcttaccagttttcacaatattcttaagcctgtgatttctgatgatattttaaaataaatgactgtagtttgagggttaaggtttggagccggccaggcgcagtgactggcccacgcctgtaatccgaacacttcgggaggccgagttaggaggatcgcttgaggctaggactttgagaccagcctggacaacatagcgagacccgtctctacaaaacagaatttttaaaaaacttagccaggtgtggtggctcatgtctgcaatcccaacagtttgggaagccaaagcgggtggatcacaaggtcaggagttcgagac

SEQ ID NO: 143816 - DNA, 320 bp, Homo sapiens
atggtttattctttttcccaaatacttatgtgcagctttgggaatcattttcttccatattaagcttcccagtatttctgaaattatggcagattctgattcttggaagcaaccagaaccctctgagctgcacctctattgaatcatctctgtttacaatgactctcactcaagttattaaggatgtgatctctgctatttttttcattagaaaacccacacattacataataattgttagggtttttgttagtctgtcttaaaaaaatacatttaaaaaatgtacccagtgttgtcagagaatatcttcatttcaatat

SEQ ID NO: 143817 - DNA, 427 bp, Homo sapiens
aggttgtgtgggaactgagcatgctggcattgctggccactgcccctgaaggaaaacacctcttccacaccacttttctgtatctcctctacttctttctctagcatggatgtggcatttgggcctgttgtgaagactaagccagccatctgaaaaagctctagccaccccatgctggacatgtattacagtgctcaatatgttcaatttcctgaacataaagactgatctttgccaacagccaatcctaaggccttttaatttctgtacatgctgtacttgagggattttatctctcttcttatggctttgatatcctccttggtacaagtgagtctcacacctttatctccagccccaacatctcatctgagtttctgatcaatatttccaactgctcctagatatgttttcctagacattcaac

SEQ ID NO: 143818 - DNA, 382 bp, Homo sapiens
cagcactttgggaggtggaggtgggcggatcatcaggtcaggagatcaagaccatcctggccaacatggtgaaaccccgtccctactaaaaatacaaaaatagccgggcgtggcagcgcatgcctgtagtcctagctactcgggaggctgaggcaggagaattgcttgaacccgggaggcggaggttgcagttagccgagattgcaccactgcactccagcctgggtgacagagtgagactccctctcaaaaaaaagaaaagaataaaataggtgagagttctttcctttgggattcagagcccagtgagagagagatacatgctaagagatcaagaccttattggagcatagaggaggaagttcttaactttgtctggaat

SEQ ID NO: 143819 - DNA, 311 bp, Homo sapiens
tcagttatggtctgaattatggactgaccctgggctagcctccctctgcctttcctcattcagagaaacttacatgcacccccaaggaagtgggggtacatcctagtggcctggattcccaaggaagaaagcaggaccaagaagcactggaattagaagcagggcctcccagggtggcagaattctaaggaagtaggagtctcccaagggaacagaattctaaggatgtgggtgggcctcctaggaggacagaattctaagtggatggaactccccagggtcaaaatatgaaggggccagggcctaagggg

SEQ ID NO: 143820 - DNA, 760 bp, Homo sapiens
gcgcgaagtaccatagcatccccacagccatgtcttgttaagtcatcatctcttatctggattactgcatcagccttccaactggttttccaattggttttcaaatctagcctcactcaaacctatccccaactacatgaatcttctcatctctgaatacttccctcagacttcactctacttacagatatggaatattttctttcacctctaggtctttcaacatttctctctggcttgtacacttcctttcccctgattaataatacctactgcagatctccgcttacatgtcacctcctctgggatgtattcccaggctcttcaaggtctgcaataggtcactcccacagcacactggaaagcccttaatacactgtaatgtacagtcaagcatcacttaacaacaggggcacatgttctgtgaaatgcattcttaagcaatttcatcattgtgtgaacctcatagaatgtacttacacaaatctaaaggctgggtgtagtgattcacacctgtaatcccagcactttgggaggcagaggcagggagatcacttggacctgggaggcagaggttgcagtgagccaaggtctcaccactgcactccagcctaggcgatgaagtgagactccatctctcaaaaaaaaaagtacttacagaaatctagatggtatcgcctactacacccctgagctatatggtatgacttattgctcttaggctataaatctgtatggcatattatgtaccgaatactgt

SEQ ID NO: 143821 - DNA, 692 bp, Homo sapiens
gcgcgaagtaccatagcatccccacagccatgtcttgttaagtcatcatctcttatctggattactgcatcagccttccaactggttttccaattggttttcaaatctagcctcactcaaacctatccccaactacatgaatcttctcatctctgaatacttccctcagacttcactctacttacagatatggaatattttctttcacctctaggtctttcaacatttctctctggcttgtacacttcctttcccctgattaataatacctactgcagatctccgcttacatgtcacctcctctgggatgtattcccaggctcttcaaggtctgcaataggtcactcccacagcacactggaaagcccttaatacactgtaatgtacagtcaagcatcacttaacaacaggggcacatgttctgtgaaatgcattcttaagcaatttcatcattgtgtgaacctcatagaatgtacttacacaaatctaaaggctgggtgtagtgattcacacctgtaatcccagcactttgggaggcagaggcagggagatcacttgggtcaggaattcaagaccagcctggccaaaatggtgaaaccccatctttaccaaaaatacaaaaattagctgggcatggtggtgtatgcttgtaatcccagctatttgagaggctgaggtggcaggatcacttg

SEQ ID NO: 143822 - DNA, 232 bp, Homo sapiens
atccatcaaaaccaccctctcaatcttaaatttgagaaaattgaggctcagaaagtggcacccctaaaaccatatatgcagaggtgggaataatagcatcccattgagtatcttctataatctgctgtttgaacatttaatttctttgtttattaaggtgtcaagtagctgaaattttacctttgaggattattcagctgcgcgctttcagcaataagggtaaagatagcat

SEQ ID NO: 143823 - DNA, 227 bp, Homo sapiens
gctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgc

SEQ ID NO: 143824 - DNA, 337 bp, Homo sapiens
gacatttatgatgccatgaattcgacaagtgactaagtcacagtgttcagtgtagtaaatggaacctgtgaacatgtctgcagctatgtggcctggacagagaagtctgtcccaagggagaatttgttgtctattttgacctagatggaatgggtttgaaatattaccagacagctgtgtccttgatgattctttgcattgggagtgaccaggaggtttataatagcctagccttggttatcttaccaggtgttttgttgttgtcttgcattgtgggatatgatattccaggagcatttaatgaatttttgtttggtactccatgcttgctattaag

SEQ ID NO: 143825 - DNA, 266 bp, Homo sapiens
tgtttgacatacagctgctgggagaggtggtctttcttgctgagggatagctaactttaaggacacacagccactggccatctttatcgtcatggggagaaggatgagcggtagtaggagagagaggccaacactcagaaagcagcagagccaagagctgtaggaagcaggaggcaggaaacagagaaggacaaacaccagatggtaggacttgagccccacccaggactcaacttcccaagcacatgtgccaacaaatgccctgg

SEQ ID NO: 143826 - DNA, 318 bp, Homo sapiens
cagcaaatgatgttgtttgctgttattactggaaaaaccaaggaaaacatccttgcctctctcttctcctgcagaataatggtagaaaaataaaccattatcaagcaaggcgacaaagcaggttagtggatctatgatggagctgtgaggagcttgacgtcatcagctttgggcaactcttattgagagggtaagcaaaggaaacagagatgaatgagaaagtcacctctgcttataatcattcataaaacactagggatcctctaacactgacatctggagtatccaatttctttatcccttagaagatcaaatgtg

SEQ ID NO: 143827 - DNA, 270 bp, Homo sapiens
tcagggaagtcatgttgatgacagcaaatgtttaaatcatatgtcatgttaaactgccttgtatacttcctgtgctggcaaaagtgaaaacaaaggcaagctctccattcctacacacatgttccaaatgcaggctatagttctatcagggattttgcatctcaatgtgaacacaaaggaaatttctctaatttttgtatttttggtagagatggggtttcaccatgttagccaggatggtcttgatctcctgacctcgtgatctgccca

SEQ ID NO: 143828 - DNA, 544 bp, Homo sapiens
gccatcttccagtaattcaccaaaatgacgaacacaaagggaaagaggagaggcacccgatatatgttctccaggccttttagaaaacatggagttgttcctttggccacgtatatgcaaatctataagaaaggtgatattgtagacatcaagggaatgggtactgttcgaaaaggaatgccccgcaagtgttaccatggcaaaactggaggagtctacagtgttacccagcatgctgttggcattgttgtaaacaaacaaggacaagattcttgccaagagaattaacgtgcgtattgagcacattaagcactctaagagccgagatagcttcctgaaacgcatgaaggaaaatgatcagaaaaagaaggaagccaaagagaaaggtacctgggttcaactaaagcaccagcctgctccacccagagaagcacactttgtgagaaccaatgggaaggagcctgagctgctggaacctactccctatgaattcatgccataataggtgtttaaaaaaaataataataaaggacctctgggctgt

SEQ ID NO: 143829 - DNA, 207 bp, Homo sapiens
aacctagtactgaagtaagcacagttcaggatatgactgaaagtcaattagtgattactaaaaagattatcaagcagctaagttgtagctatattatacctaaatagagtttagaccagctgtattaataaatcattaattttttgtttgagatacagtcttgctgttgcccaagcgggagttcatgatcacagctcatcgtaacct

SEQ ID NO: 143830 - DNA, 767 bp, Homo sapiens
tcaatctcaaattttattagacaatcatgaaagggtgtgctgttttgtttaaaagtttatatgtttagttattggtcattggatttaaagaaatcttaagatttctttaaattgaagaaaagttaggtaaaatgattaacactaaaatgatgattaatgatgattaattgtttaactagtcccattttcccagttgcagaatcactacatactattctgaatgtaatgtttgattaaagagatgagtcaaactctcttgtttagtggtgtagttagagcaatcactattgactgcttatcacttctaggcagtcctacccatgaagaagaactgagagctcctcaattcagagcttccagtgggttttgtggacactaccttttcctttattcaaagccatttctaatataaatgcttatcatttattgtttacttatttatttactagacctcatgaattggattggtcataatccttcattcacaacacatcatcatcctcttagatgtaggaactttctttatatagtttgtgggttttctaatgtacttattatatagtttgtttctaatgtacttattatatagttggttttctaatgtacttattcttaattctataatcaacaacccccaaagcactatctaatccaagagctagaatattctaccaaaaatactttttcctaagcacttctcccaatcccacatccctgccatttctccaaaaataaccaatacctgaattttatatctatttcctcct

SEQ ID NO: 143831 - DNA, 723 bp, Homo sapiens
ctcctcatggtagtgtcctgatgacagtttctcatttcctctggctggcacctttggtttctattcattacttcttctcctcctagctttctgttcctcctcctctcctttgttaaaatcctggattttcaatcagctgagagtctcctgggggtaggaatggtggtgtcagcgcagagtgattcatctagctgataattagagctctggaaaacccagaactcatttttgtcagagtcagggcttccggaatccctaggctttttgttttgtcagagagtggagcttgctgggctggggccttctttatgcctgtcttttggtcacccacctcattgaagcccttcaactgagatgagtatgagtgctcgctgggtcttgcaaaaagctgtttctataactccgagtcctcacagtgatcccccaagcgttatccctgtttggacagaaggggaagattgggcaatttgcacatagtcacccagcttgtaagtgatgcagcagggattcaaagccaagttttttggaatccatcagacttgatttgaatcctagccctgccattattagctgtgtgtgtttgggcacattaatttccttctctgagcactggcttcctcagctgtaaacagcctcctacctaatactgtctcaagtgctccatgcagagtgtggcacaacggtgggagctgtcctgattactcttgttagtcagccctatca

SEQ ID NO: 143832 - DNA, 248 bp, Homo sapiens
cttaagagttgccagactaatggcttaaagggccttttctgattctgaaactagatgattccaatttctaagagtttgaccatgcttatttgagaaaagctgtatcacctctaggagaagaagctgttgctggttactttaggactaagagctaaaactcagcacaacagcattccccagacatgagaccccaaatctactctgcccctcttctccaagctttccttccaggtgggagcagcctgcat

SEQ ID NO: 143833 - DNA, 278 bp, Homo sapiens
ataacgggggaaggctatgcatgtgtaaggcaggggatatatgtgaactctgtaccttccgctcaattttgctgtgaacctaaaaaacaaaatctatttctttaaaaaatcttacttcacatgataggatgcaatgagaggacgcaatagtatcacttctgtgatgttcctgccaaagatgcataatctggatctaatcatgataaaacaccagacaaactaaaatggcaggtcatcctacagaatagctagcttggaactttcaaatgtgctaaggg

SEQ ID NO: 143834 - DNA, 418 bp, Homo sapiens
aacaaaagaaccaccaccaaccccggcttttgattgcggacccagcgaagtgacttcaaaggcaccacaaaactaacaagcgctccagggctgctcatcacctggtgcagcccagagtctcacccgcaggaaacaaactcttctttccttctgtccccacattcaacactcaacacagaatgctctgctcaccaaaacgggtggggatttcggcatcagaaaatcccatggcgccagggctcgccctggagactgccccacttgtgacctgtgctcctgaccaccgggtcaggatgctgatcctagcttgtgacctgtgctcctgaccacccggctaagctggggttcccacggtgccctccttgagtttgatcatttgctaggacggctcacagaactctgggaacaccgtctactg

SEQ ID NO: 143835 - DNA, 492 bp, Homo sapiens
acagaaaaagtagcataagaatgtgttcagaataagcactacaaatcagtgtctctcaaataaacgaagagatctttaagtcattcatagtaagagaaatgcacattgaattctcactgtgatgtcaaccactcattttgtggtatcccaacaagcaagataatcagacgttacatattttctatcagaagtatgcagcaccacatgtgaagtggtcctccaaaaaacaaaacaaaataaaacctaaaacccaaatctgattatgcctctagaatataaatacaagtttacacagtagacaggggatagaagaactgttaaaagacaccacccggatgcaatcagcaaaacctaaatggtgggatcctctccagaacaaataaactggtttcttccacatgcaacaaaatttagaaagaaaattaaagagaggcagatggtaaatctgaagactgaaagagattcaagaaacacataaaaatgacagataat

SEQ ID NO: 143836 - DNA, 195 bp, Homo sapiens
attagtacctcagtggtagtattgatatcagtattggaaagagacatgaagaaatatgtcagaaaccagtaacaacttaacatctcctttatctcaagagttctattcctagcacaaagatgcaaaatgttcaccattgtcatttccactatgaaaaatctgcctataatccctgcatgcggggggcgctgaagg

SEQ ID NO: 143837 - DNA, 327 bp, Homo sapiens
gtctgtttctgcggcatctctgcctggaaaagtcactttgcagagacaagctcagggggccaccaagggttgctcccttactcacatctctgggaagaataaaaatgacaaaaatgttaacaaggcagggaataaggcaggaaggtgagacactttccaacactgagtatatcaaaagaaggggaagaatggttttatgaatgagttcaggcaaatgtggaatatcatatataagttgcttcagaatgtgtaaagtgaaaaaaatcttgcccgagtcattttatgagattagtacaaccttgatgtcaaaatcagaaaaagtatagg

SEQ ID NO: 143838 - DNA, 333 bp, Homo sapiens
tgcctgtttctctctgccatccaaatcccacacacatctaggggtgaatcggtgaatctgcactgatgagtgactcgtcttgtgaatcctttctaggatctcagtatttcatcctatcccgagggaaggctctaaagagctcaaggaagacctcacgatgtctatgtgtgagaagaaacctttcaccccttcactatcacaccccatcatccaagcacacactcctctttcatcccataaaccccagtcgacagagacttgacagtcaaggacgttgtcaggaacgtactgtctaaagggtgtctcggcactcggttatattcctgagcgacg

SEQ ID NO: 143839 - DNA, 278 bp, Homo sapiens
tgcctgtttctctctgccatccaaatcccacacacatctaggggtgaatcggtgaatctgcactgatgagtgactcgtcttgtgaatcctttctaggatctcagtatttcatcctatcccgagggaaggctctaaagagctcaaggaagacctcacgatgtctatgtgtgagaagaaacctttcaccccttcactatcacaccccatcatccaagcacacactcctctttcatcccataaaccccagtcagtgtcacctggagtaataaggatggggc

SEQ ID NO: 143840 - DNA, 489 bp, Homo sapiens
caagctccgcctcctgggttcactccattctcctgtctctgcctcccgggtagctgggactacaggcgcccgccaccacgcctggctaattttttgtacttttagtagagatggggtttcaccatgttagccaggatggtctcgaactcctgacctcgtggtctgcccgcctcggcctcccaaagtgctgggattacaggcgtgagccaccgcgcccggtcttactggctctttctactcagcatgtaactatgcttgtctctcctataataaaatacctttctcagtcttgtgtcttcctcttattatcattaccttacttacttttagaagtaaagtcctcggtttttctattcttctttttttaacctacagaaatctaccttttctcattattcctctgaaataaacctgcctaggttatcactgtctacaagctttcccttgtaggaaagctcctccctgtagtatctcaccatgctgatcact

SEQ ID NO: 143841 - DNA, 371 bp, Homo sapiens
gcagttgtggttttggcacttgtgcgtgaaaatgcactttcctcagaactcaaaatatccacccaaccatggcctgcaccacatgggcatcagggtcacaaggaagcctgtctgtcttgatgtccccaaggtagtaaggaaaggcagagagcaggggtgagcaccgagggcatggtctctggtgtcagactcaggtttccatctggcccttacaccctgggcaagttagacgatcccaggcggcaaatggggacgccacccctactgacgtggctgctgtgcagatgagtaaggtcatgaatacacttacaggacacttcctggacaggaggtgatgacctcctggccccctgccagaaccacaaatatcg

SEQ ID NO: 143842 - DNA, 311 bp, Homo sapiens
gtgcaggtacagggaaccagaacaagggaggtatttatcaggaggggctggctagagtcagaaagagcctttcctccaacagacaatgctagctccaatctctctttgccatactctatagtacccctccaatttatttgaataatcaacagatcctatctagaaatctaaagattttaggagaacaatttttttcttttttgagacagtttctctgtatcgcaaggctggaatgcagtggcacgatctcagctcactgtaacctccacctcctgggttcaagtgattctcgtgcctcagcctcccgagta

SEQ ID NO: 143843 - DNA, 989 bp, Homo sapiens
  misc_feature (989)..(989): n is a, c, g, or t
gcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggatgggcatttgatgatggagttccaccccctaatcagattgttcatgattggttaaacctgattaaaacccaattttcgtgaaagccggtgctggtgtgcctgcttgtgttgccggatgggagaggccccgttctgctgccttgcttgtgaatggggatgaagtcaaattcgtcgttttagcaaacaaggggggctcattccaacgggttttggggaagcgctagagggaacgtcagaacagcgtgggtgcacagaggaaagggcgtgtcgcagaccgtccgagatgatcgcgagtgcccctctggacgactatttgagaggcagctctcgttcggctgatatgttattn

SEQ ID NO: 143844 - DNA, 139 bp, Homo sapiens
aaggtcccaccccatgttacaagctgttgtacagtccatacatgagaccttgagagcctgaatcaggatggtgacagtgaggaaaaaaaaggaagggttagataggagagagatttcaaaggaaacaaaatcggtagaa

SEQ ID NO: 143845 - DNA, 454 bp, Homo sapiens
tgcagaccccagattcatagaccccccccccaaaacttgtttcctcaatgtggaaaagtcacaggcactcatcaccagcccagcccatgagggcacccttggggcatataccctgcaaagccacaggtgccaagctgcccgaggccttgggagcccagccctcacacccctgtgtcctggatgtgggacagggtttcaaaaagggtgattttggagctgtaggattgaatgactggccttctgggtttggagtttcatggggccagtaagtcctatctgtgttttgtttttttttctggcaaaattcttccttttggctgggaatgcttacccaatgcctgtacaagcattgtaccttggaagtagttaacttgctttatatttcagaggctcatgggcctaagggactgtagccttgtgtcagatgagactttaggctttggacatttgtata

SEQ ID NO: 143846 - DNA, 403 bp, Homo sapiens
aagaagaagaagaaaaagaagctgaaaagtgtgtgcaagttgcagaagagagcacagcactgatggattaaaagtcaggggaggctgagttacgtaaattcagcttgctctggtgctggtctagcagccaaatcaccaatcaaccaaacatgctcaattttagtggctatctaataggcacaagagagaacatgattatcactaaagaaaaagcccctgttcaagacagctattcccaaaagactgtgcactcctaaatagtccctttagaaaaaaacactgacaaggacattaactttcaaagttcaacagatgaagaacccctcactttctatctcctttgttccctcctgtacaacattcctgaggcaaagaactgtgatgtcagtgtagctgacctagg

SEQ ID NO: 143847 - DNA, 600 bp, Homo sapiens
gtaacactggactatctgacatttccctaaactccctttctttctcttcctcctaccatatacatcatcttgctactcccttctccagaaattctgaatgtcctccagccttcaactgatgcccattcttcaaggatcactaaaacgccacctccttccaaaaaccgacctggactcttcccaaagtaactcttcctcctcctgcagaaatgaccacacacggtatgtgcacgtgggtacaaactgctcatcaaatgatcaaatgagtggctgagacagaccaaccgctcagcaccccaagcctcagtattctcctctgtaactgggatgaataatggcacctgcctcgtggcacgtggggtggccctgacgatcaaatcactactcacagaacgttctgcaaatgcatggaacacggcaaacaccctgccaaatgagaacatgcgtttccactctcctgctggggcggtagtgagcaacaggtgtgcactttgctttgattttaaatgtatttctctgtctctcaccttgtcactggattttaaatgcatttctctacctctcaccttgtcattgaactctgcaggctgtggaagttcg

SEQ ID NO: 143848 - DNA, 189 bp, Homo sapiens
aagtatattctcatatttatagatatattaaaacagcttctggattcaattcttagagtgaacaaagctttattttaagcaagaaaagagaagaaacatgcagccatagattaggattggaaattatacagtgacattttagtttagtggagacttttgggacatttttcttcatactcttgacaccca

SEQ ID NO: 143849 - DNA, 726 bp, Homo sapiens
agcgacccagatctaagaatcaaggtttttagagaaatggctgattctaacactaagcaggaaatatacaagatgcagcccgaagcatcttttggtgtctgccagagattaaagaaatcctcaaaaatcccagtcatggggtatgttgaaaaaacccaggagccaactgaaagagttcccaatggacaaagctgagataatttgagcaacaaaataaatacaaggctattgattataaaccaaagtataaaataaataaccatactgatataaatacatggttgaatacataaataaatggggaagaatagaaaagtagaaaaatatcttttgcaaaatatggaaccagcccaaaagtccatcaatcaatgagtggatagagccaacatggtatatatatacaccatggaatactactcaaccataaaaaggaacgaaataatgacattcacagcaacctggatggaattggagaccattattctaagtgaagtaactcaagaatggaaaaccaaatatcttacattctcactcatatgtaggagctaagctatgaggacacaaaagcataagaatgatacattgaacttttgggacttgggggaaagagttgggggtggcaagggataaaagactacacattggatacagtgtacactgctcaggtgatggtgcaccaaaatctcagaaatcaccactaaagaacttactcgtataaccaaacac

SEQ ID NO: 143850 - DNA, 236 bp, Homo sapiens
ctggaagctgctctgggtgagtcattaagtgagtggtaagtgaatgtgaaggcctgtgacattactggacattactgtagactttataaacactgtacacttaggctgctttaaatatatatttaaaaagtttttggggcaggcatggtggctcatgcctgaaatcccagcactttggatggctaaggtgggaggatctttgagaccaggagttcaagaccatcctgagcaacata

SEQ ID NO: 143851 - DNA, 288 bp, Homo sapiens
taacagtcaaaagttcttattccatataatatactaacaattaatgaaatgataggtgacaaaaagctgattcacaaaacataatgaagagtatgtgaagtacacaattcttatttatctttcccataatttactgtgtgaagctcagcccagtgaagtttttggcttgaaggcaatccatttggcaacgagaaacatgcaccatacttaatttcagtttacttttatcagctgtgtgaaatatttacaaagtatgagaaaagtgcttctaatcttacacaaataaaa

SEQ ID NO: 143852 - DNA, 350 bp, Homo sapiens
aacattggtcatttcaacactggttctgagggtggggaatctaggagtaacttagatagttggctctagctcagaatctctcattagagagcagttaacctgtcagcaggggccagagccatctgaaagcttgaccagggctggaggatctgctcccaagttgtgtcagtcctgtggctgttggcaggaggcctcagtttctcatcatggctcgagtgtcatcattacatgacagctggcttccatggagcaaatgatctaacacagagcaaggtgcaagcaggaagccacagtaccctttattacccactctctaaagctgcacaccattagtagtgagtcactagatc

SEQ ID NO: 143853 - DNA, 657 bp, Homo sapiens
tcttacacctcagtagtactgggtgtgtgttgccaagcttgtttgccttcaagacctgcagagcaagcctgcaggccgcccccttgccttgtggctagtatggaatgcctgggccgcagagcagctctgtttggatgttttaggaaggatggtaggtgggcttctattggttgctttgaaggtgggtggaaccttgttttgattgagagcctgtttgccagagcaaattataatttttgtgatctttttctgaagtctgacatattcagggaacagttgtgaattatgattgcaacaataacaccttaaaattgatttttttaaaaatgaaaggttatgtcacatcagtttttacttagtctcttgccttcaaaaggaagcagactcatcttccttttagagcttatggaaaattctttggcaattaaaaaaagtatgcattgacttttgtgttagaaattgaagtttaggtattttgtttatttttgtatctgttttagaatcggatagcattttttgcatatgtgtatgttgtcatgtgacttggaattctattctcttaaatggagtaaaaagagtagttggtgctgagaaggcagtcattgacaaggcctcatttcgtacccactgcttgatagccagacactagtttcttct

SEQ ID NO: 143854 - DNA, 632 bp, Homo sapiens
gaggaaaagtttggcaaatttgaagagctgaaagtagtttggtgtagctgaagcacagaatgatggagttgtatgtttgagtgggtgggaacaagttttgtacatggcgatcaaaggagaggagtgaggggcaagaggcttaggggcagaacaagaggccagaaaaataggaaccaaatcataaagagcctcttacggctagctaaggagtatgcatttatcctgtaggcaatgggaatccgttgaagaattttaagcaatgggttgacgtgctcaaatttgtattttagatcactgaatgagtggaagatgtattggaagaaggttaaaattggatggagggagccatttttagtctaaagcaagaatgtcagtgtcctgtttaatgtcactgaaatggtgccaaatgtaaggaaggaaggattagcttgttaatcatttatgttttaagagtgtacacttctgacgtataaactcagtgataatgaagtaatttcttagccaggtgtggtggctcacacctgtaatcccagcactttgggaggccaaggcaggaggatctcttgagcccaggagtttgcgaccagcctgggcaacaaagggagactccatctctacaaaaaatacaaaaa

SEQ ID NO: 143855 - DNA, 157 bp, Homo sapiens
ataggaatacttccttctagatatcagggcttgtctcagggcttactgtggacaccccggcttggataaggagaaaggaagaaagagagaggaaaaagggatgaagaagaaacaaaaccaatcaggagtcacttgttcccagcaactgcctctctag

SEQ ID NO: 143856 - DNA, 463 bp, Homo sapiens
ctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctg

SEQ ID NO: 143857 - DNA, 197 bp, Homo sapiens
caaaccactagacctccctataaatgcataagcactatgttccacctccatcatttcccaatattcccctgttgccagaaagctcttcacagccctgtaggacactggccttagattctacgttcagaaagcaatgtagacatcctgttctgcagcagtggagtataataacaaagctgaagcagggtatacagaag

SEQ ID NO: 143858 - DNA, 224 bp, Homo sapiens
aagagggcaaacattagctggataaagggaaccaggatgccagtgccagttccacaaccaccatattgttcttcacaacagctttgggcagaggtgaggcaaaggagagaatgattgcaaggctggctttggagacaggtgtgggtttgtgtccctgccttccaaaacctccctggatgactccaggaagattactacacctcaagatctcagttcgctcacac

SEQ ID NO: 143859 - DNA, 207 bp, Homo sapiens
ctcattttgctgttttatgtatatttgttttgagagacgggagattgttttgtagaaaagaatggtatttgagaccgggcacggtggctcacgcctgtaatcccagcactttgggaggccaagacgggcggatcacgagatcaggggagaccagcctggccaacatggtgaaaccccgtctctactaaagatacaaatattagccag

SEQ ID NO: 143860 - DNA, 547 bp, Homo sapiens
ataccccactgccggtcttgttgaagctgtcttgtttctcaatcaccacactccctctgcggtggcgacagagaagccaggaggcccagggttaataggggcccccctcctctttcttcctccagtgatgtctggccgactttctccccactggggattagtccttctcctcacagtgggatgaaaggttcaacagcctgtttctcgggaggcgcttctggaaaactggctgtattaattctctattgctgccctaagaaattaccacaaactcagtggcttaaaacaacacaaattactatctgacaatgtctggagttcagaaatccaggatcgatcttagtggactgaaatcaaagggtgagtggtctgcgttccttctgaaagccctggggagaatacttctcttgaccattcaaagttgtgaaaggattccgttccttgaggtagaggacccaggcccccgttttcctgctggctacaaactgagggccattcccagtcactagaggctgccgatcagaactgccttcctccatcctcagtg

SEQ ID NO: 143861 - DNA, 354 bp, Homo sapiens
  misc_feature (16)..(16): n is a, c, g, or t
ggatttgctggtgcantacaactaggcttaatagggaagcattttctgcctggttgcgaggtggctgccacacctccaagcatcatatctgagttcacagtgggaagaagggagaaggataaagaacaatggcctggtctttgtgacaggagttcaacctttatcttatggccagtggggacctgttgaagggtctgaggtaggacagagatgataacaaggatggctaacatatattgagcaactaactctgcaccagagaatattctaagtgcacacttatacatatcacctcaactaatccatagagcaacctagatacagaaactatcattatccctagttacaaataaa

SEQ ID NO: 143862 - DNA, 553 bp, Homo sapiens
acaggtagagttgatatgttacacaaacggctttaataaaaagtttaatttccattgcagggatggaaagcatagctagagactcatccaggtatcaggcaattaagagtttggataatgagaattatccaaaggaaaaatgaacatacaaaagatgtcccaaaggagaatggaagagtaagggactgatcagtccctacagggtaaatcaaataggaggtttcaaagacaaggggctttgaaaaatagtagataggatacactgacataaaaaagcaagccagaaaacaagagaagttggagaattccattttcaatgtatgggatgttttggtgatgaagggacaaccatttggaagagaaatggtgatcctctgcacagataggacagtaaaattggcagagtggaggaaacccctacaaaaaagaggggataaataaaaccttaaagataaccactacttagtggagtcaggaagaggaagaaaggttagttttaaaaaaaaaaagagagggacagcatgcgcatccaagacttaagggctgtaccaag

SEQ ID NO: 143863 - DNA, 233 bp, Homo sapiens
ctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgttcccaatttct

SEQ ID NO: 143864 - DNA, 553 bp, Homo sapiens
ttatatcttaacaacaccaggccaaatttttcttattgatgatacatatacatagtgaagtagatttttaaaattgtatttgaatatgtcattctgaaccatactatgacaaaataatcacttcccaccccactgaagaaatgagaagcctttttctggcttgtctagatcatttaataagtttgtagatgcactcaaagttcagaaagaaagctaacataaaggggcaatgaaattaaccatgtcaagtttaatatgtgaattaattctttattactagcacttagaaggcatggatacctacaaagaaaaaaaattgttaggtcaaaaataggacatactgtttcttataagaccggaggagtgtagaaagcctctcctgcttatgcaagatctgcaggcttccttcctcttttcctcccaaattccatgatcttgcctaatgaagattaacttaactacctaattaactttcacaggatttttgtggggtagataatagttcttgtttttagtagtccagatgaaaagaataagctgggcctctgacatt

SEQ ID NO: 143865 - DNA, 314 bp, Homo sapiens
cagtgatttaccagggcctattggttctactgttgactcttgcaactgtctttttctttttgttaccacggctgcaaagctaggtcagactttgttgcctggagagatactatggtggttttgctgtgaggggtctctgcttctaactggcaggtggatgtttcctaggcatctgaaatactactttgcatatgatgtctcctcagccccagctcctgaagaacagtcctactcaacccttgcaggttccccttgagcttaaacagtgatgtccaattcttgcccccgatattcagattctcgtacacgactta

SEQ ID NO: 143866 - DNA, 390 bp, Homo sapiens
caaataaactcatttcccagtcttcctgcaaatcttagggtactgatattgagcattcctaatccaaaaatcctaaatccgaaatggtccaaaatccaaaacgttttgagtgctgacacgatgctcaaaggtcatgcttaaaagaaatgctcattggagcatttcaggttcctggattagagatgctcaagcagtaaactgtgaatatttcaacactcaaaatctgaaacacttctgttcccaagcattttggataagggatactgaacctgtatctgaattatctagtatctgtcctatcaatgaacccacattagaaaaagaagaaagaggaaagaaccaagcactttatacatttattcaatttatttgaaaataatgataaccacc

SEQ ID NO: 143867 - DNA, 256 bp, Homo sapiens
gatcttggacaactgaccctgtcacttggtatctcaatttcctcacatgtgaaatgggaattagaaaattcaaccaagaaaggaggaaacaaaaattcaaggaggtaatgcacaaggaaatgcctagaagagtacccaattcatgaaaaaccttcgagatgcagaattctgttttaagttagttcatggattgaaagaaaactgcctttagttcccagtgcctgttgggttcccgttccaccacccaaacttggtt

SEQ ID NO: 143868 - DNA, 543 bp, Homo sapiens
tgagactattttgtggttcaatttctactttcatttgggccaaaaaaggcctggggtgacaaatcatctctgagtcggatgtatggctatgataccactataatagtgtgattttttttccatttcatatctacctcccaaagatattcctgtagattcagtcttacacacttaatttgacttggaattgtcttaaggatgcttttgaattgtatttctagtgccaccaatgaatttcatttacttcaataatctagagttaatgttttaatctcactgtaatgttaatgaaatagctaccatgttttatgcagatgcttgttttatttaaccaatcaaatcagagtcaccttaatgtttatcttttatttttttactgagtagaaaaagaattatttaaaaataaatgtgagcacaggttgtcatactttgaatatcaagatgaaaataatgaagcctgcatatgaattaggcataagctttttgtcttttatccactaaaaagcactataaatcctcctatcatatttctgtgactaccta

SEQ ID NO: 143869 - DNA, 441 bp, Homo sapiens
gaaaagctagtcttttcaacaagtagtactgggacaagtggatattcggattaaaaaaaataaatttagatcattacctcagaccacacacgaagtttagctcaaaatggaccatagacataatgtaccaggtaaaactataaatcttctacaataaaagataggagaaagttctcatgttcttggtgtgggcaaagagttcttagacataaccataacagctagggccatgagaaaaatgataaatttaacctcattaaaattaaaaacttttgtacttcaaaagacactattaagaaaataaaaagacaagtcacaagctggacaaaaaattgcatattatatatctggtaaaggtcttctatccagaatagaaaaaaaaaactcttacaactcgattataaaaaaaaacccaattaaaaagagacagaaaacactcac

SEQ ID NO: 143870 - DNA, 750 bp, Homo sapiens
agcataacttctctttgaggtgactttgaactttctggctctgctgtctgcagcagatctcctgtgtggctgcctgttggaagcttcctctggagttctctaatcatggtactcacaatctctaaaatgagctgtctacactcattaagaatgttgaaattgcagacttgtctcgggctttggtaatcccataactgtttcctgccctgatcagaattagctaggtgcaaagggaagcagattttgcccctttggcagaaagtctgattctttctgattcttctctccttcccttggctctttagaaactataagtggaaccttttttctgggaaccaaatgctagaaggcaggtttttttttttttttttgattgacaaacatataaagaaaaaacatactttgaacagataaactggtttaagttgttctccatgggaggcagtggagaaggtttgtgacagaccctgtgagccttcatttatggctgccacggattacacacatagacaccatctaaggaaagtggggttgcctgggagaggattgcctcagccttcttccaaggagcacactcctgggcatgttgtttcagttgtaaatgacatctcacaattcacaaatcctttgccagctgtaagaactctatacagctgttggactgtagctttattttcattatgtcttggtatttctgtgggagggcagaggaggatgagcagattactcattttaacagaactggaagct

SEQ ID NO: 143871 - DNA, 109 bp, Homo sapiens
agacactattgtgggaggaagcttctaaaatggctcccaatgacctcagcttcctggtctatatgccttatgtgaatccactccccttagatgtgggtagacacctata

SEQ ID NO: 143872 - DNA, 163 bp, Homo sapiens
gcctattttgttaatcagaatgtactttatttacttcttttctttggcctattgaatccaaatcgttaccatggtctgtggattcttcttctacaatatcctttggctctttcccttcttatttattcccacagctatcacaatagttaagttcctgcaaatg

SEQ ID NO: 143873 - DNA, 498 bp, Homo sapiens
  misc_feature (2)..(2): n is a, c, g, or t
  misc_feature (469)..(469): n is a, c, g, or t
  misc_feature (498)..(498): n is a, c, g, or t
angcgggaccccagcaagccggtgctgagggagctgcctctctgatggacttgctggcacctggctttgagaactggactggccctgtgtgaggatgtggctggaccttccgcttgattcaagcgcttgcttctgtgatgggagctgagctgagaggtgagagcaagtgtggcttctcattaatgtggatcctcactgaagctcaccagctgcccagcctggggtggagggttgaggggctcccagagggagggaccccagcaagccggtgctgagggagctgcctctctgatggacttgctggcacctggctttgagaactggactgccctgtgtgaggatgtggctggaccttccctgggttgtttgcacagtgcagggcttgtttctggtcaagagctggctgggtgcatgggctgcatgggctgcacatgcttgcctcttggccttctcctcctcctctgcctgnggtagctgttgcttcagtcactctggctn

SEQ ID NO: 143874 - DNA, 484 bp, Homo sapiens
gaagtcagcatatgtttccttaaacagctaacggtcatcttttcagctttatggatcttacagttgccatggcaccaactcagccctgccgagttgaagcagctgtagacgatgctttaaagaacaggacacgtgcggtggctcacacctgtaatcccagcactttgggaggccaaaacgggaggattccctgaggccaagagtttgaaaccagcctcccaaagttttaggattacaggtgtgagccgctgcgccaagccccaatgtcttaatttttttcttcttttttttgtctccttttggagatagggtctcgccctgtcgcccaggttggagtgccgtgttgcgcccttcggtttcacccaaaacctatgcttcctgggtcacaaggcgatctccttgcctcaggctcccaagtagcttggacctacagatacgtgccaaccaatggcccaagaataatttaatggggatcctcatagag

SEQ ID NO: 143875 - DNA, 282 bp, Homo sapiens
ccatccacctgagaaataacatatacatgtaagcttaattcaaatattcaggttttgtgatcctcaaacgtgaatgatcagaatcacctagggagctttttgaaaaaattaaatcccccctctacatcagtttctacagggaagtctgggaattcatgtcttaaaaaaaaaaaaaaaccctcataggctgggcatggtggctcacacctgtaatcccagcactttgggaggctgaggcaggcagatcacctgaggtcaggagtttgagaccagcctggccaa

SEQ ID NO: 143876 - DNA, 414 bp, Homo sapiens
gggttgggccctttaggagagcatttgtgtccctgccctggagtctcctcttcctgctgtgtgcccttgctcggggttgttccaggaagcctctggtgtggggggctctgttgccaccagctgatttcctgccccaggtgcgtgggtgggggaggagagggttgaagattacctggagaaatcgcccgctttgcttccgtttcacccctcttctagggaggacagcagagtgcacagaggttctcttctaatcctctcacccccaacctggtcctccacaaccaggctagagcgtatctatgtatctggggaagccagggcttggggaggagtggactgacccgtgttctgtgaaggtcaaggagggcccacttcgatgaggatgagtttggcagggagcgtggtcctgctcgc

SEQ ID NO: 143877 - DNA, 665 bp, Homo sapiens
atagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatggctattttgtactctgcagcagagagtgtcttctctgttatatatcttaggttgtggcagtgaattcctaaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcaaaaagagcaaagtaggacatagggacccttagcaccttcggggtgtcctgctgtg

SEQ ID NO: 143878 - DNA, 240 bp, Homo sapiens
aaagagatcttttcagcatttcctatttcccagggaaggaggagagagtgatcaagaagagctacattcacaagagaataaggtcagcctcccctttgagactggccacttaggatgaaaaatcctgctggatgaaaaacattagaggaaaagctgctacgaaatgctcctagggcaagggccaggagatgggaatagtgggtttagccagtggtgaggcatggtaggaagctgatttgg

SEQ ID NO: 143879 - DNA, 274 bp, Homo sapiens
cattttcacttttctgtccaatttcagagtgcatgtgtttgtgagtatttcactagatcagtgacagctctttatttgcataattatatgctctggtctgaagagaaaactaacccccaaatttcatgggtcaccaaactgcaacaatcaatgttttatcacgtatgctaagcaaaatctaagaagctatatgaagtttcttggggagtttttactcctcagaaaattaaagagttttctctcctgaatagattcaaaatctttccaagttctt

SEQ ID NO: 143880 - DNA, 384 bp, Homo sapiens
caaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatcgcgccgctgcactccagcctgggcaacagagcaagaccctgtttc

SEQ ID NO: 143881 - DNA, 478 bp, Homo sapiens
gggtatcaccgtattagccaggatggtctcgatctcctgaccttgtgatctgcccgccttggcctcccaaagtgctgggattacaggcgtgagccactgtgcctggccccagatttcttattgtattgtgcagttcaacctccaggccagtaggtgaagcttatggataaagttcagctgcagctgactcaaatggatatatacttgattcttgtttactgggagaagttctgctgacttgggcaatgggctgatctgtgaaatgcacagtggtctgagctccctgcttagttctggagtgggggccaagatgggtgggctagactaagcaagctctcctacagttctcccaatggcaggcagaagcattagctctgaggcagggtctggtgggcagctgccaagtgcctggagatgtgcctaggcatagagtctggaaacctccactgtcccaagttctctgcacaggaagtggggg

SEQ ID NO: 143882 - DNA, 441 bp, Homo sapiens
gtgtcatgatcagaaaaagttatttaacatcgacttttactgctttaataacattttcttttctgtagcttactttattgtaagaatacggtatataacatataaaacatacaaaatatatgttgatcaactgtcaggcttccagacgacagtgggctattcgtcacattttgggagagttgaaagttacacaaggatctttgatgcagtctgtgtccctgacaaccgagccctcccttgttgtttgaggatcaactggatattgttagcgtcttttaaattttctatttacccagtcacctgtaatctcttgtcttgcttaccatttttatttctagtgtttagcatagagcccagcacatagcaataacatagtaaattgaaaaataaatgattgaatcttgtcataaggtaaaatcagttccttcatcttcactatag

SEQ ID NO: 143883 - DNA, 188 bp, Homo sapiens
acacgatgcacacacagacacacggaaagacatccacacagacaccaggcaaaacacagagacacacagacacgcacatgcgcacacaccctttgccgcatctctgccttcctgccttgcctcatgccggcagcgcatcagagcccctggtcctacccttccacgctggcctgtcgtgtcctcccttg

SEQ ID NO: 143884 - DNA, 361 bp, Homo sapiens
  misc_feature (11)..(11): n is a, c, g, or t
tagaggatctntacctaaatggctgtacagacataatagtaacaacacaggcacccagtagtaaccaaaatttggcatcatacttcgtgaggaaattgcaattgactagtatggcatggcccaccagttgaaaaccatggtcttaaaatatttttctaggtgctcattttgtagcctgagtcctgtcatttctgttctcctagagcttcttgttctgtgttttatttttcaaattctctattatcttcatgattctacattgtttccgtgtcccacggtaggcagaattttacttaggttccccagcctcttgtaaaagttccccgggtctattttcccagctgtgaaaaatcaattccag

SEQ ID NO: 143885 - DNA, 406 bp, Homo sapiens
gtcccctgaccagcagcattagcaacacctgggagtttgttagaaatggaaattctcaagtgtctcctggaaaaagctactgaatcagagtagtttggtgggaccaaagaatctgtattttagcaagcagcatagatactttctatgggccagggacagtggcccaggcctgtaatcccagcacttagggaggcctaggtgggtggtgggagttctaggtgggcagatcccaggagttcctgggtgatgtggggaaacctgtgtctacagaaaattagtcccaactactcaggaggctgaagtgggaggatcgcggagcccggcgaggttgaggctgcagtgagccaagatcatgccactgcactccagcctgtgtgacagtgtgagaccctgtctcaaaaaaaaa

SEQ ID NO: 143886 - DNA, 361 bp, Homo sapiens
atgcaaaggaagccctgtggtaaagagagagttagtatgaataaacatggaaacaagtccaaaaaagctggagtaagaagtgtcttggtggaaatggataaaagtgggaattaaaaggtgtgcaggggccagatcttttaaatgctctggttcaaccttacctttagaaacattctgttatacccattgagcaaaataaagcatcctttcttctttgtttcttgaaaacatgacttctactttgaatgacatttggttgtttctgtaatttaccttcattggctctattaatttaactcaaattaaaaccccatctctactaaaaatacaaaaaattagctgggcgtggtggcaggcgcct

SEQ ID NO: 143887 - DNA, 481 bp, Homo sapiens
ggaaagaaaactaatctggaaataaagagatccatgacctcaagcctaacctcttgaaacctagattatttttatcttcaagaagtcctgttgcccaccctgcttatcttataattttgtttgagagtcaaaagagagaagagaagtgtgagccctgaattgctgtagaaagtgagaacttactatgaagggggttgtataaagtctcattagaggcagccttgctagtcttacttaacctttgcagtactaaagttgatgttctctgaactctctcttaggctctctcctcacattgggcagtcctcccaggcaatctcattttctcccataggtttcattagcatctgcatctgaatgaccaccacatatttctccagctcaggcttctctctgagcactgccttctagacctcttctcttggatgactcacagacacctcatactcaacatgttctaaactcacctctttgccccaaa

SEQ ID NO: 143888 - DNA, 801 bp, Homo sapiens
ctttgggggtgtggaagctgtttccttgtaggaggtttattctcgtctatctgactctgagctgcccaaagtgaagtctttgcctctgttcactaagacccccaagcccagagcacagtgagcccaaggggacagcgtgtctgcacctgttccaggcgactgccaactggcaagctaaaaccgggagttgctgacactggcactgctgccagcccccaccggcattgtggtgcgtgatccatcctgtcctcagggccatgggggccatcggggaggcggggtctctgcatggaagtggggtgtagctgggctctgctcagtccccgaggctgtgctcggagcgtgctagctgtcggccacaagaaccgagcccaccctctccagtcctgcgtctgcctcaggcccggcccgggcgctgtggtctgagtctccggtcccacgtctgcctcaggcccggccccgggcgctgtggcttcaagtctccttgggctgacctgatgcccctgggtctctgggttcactcccaagatgcatccccctggggtccctgtggcttctcagaagaagcgtcggcggcggggggatgatcatctgaaggggcctcccttgcacttgcctggccgtcgggtggaatgctgggtgggaagtggctccaccttgggatgcttgttggtgccggtgacccccggacgctccagcatgcagccccaggctatggcatctgctcctgctcagctccgggagcatttcccgtctcctcatcgtttctcctgtccttccctgagtgcctcaaattcctgt

SEQ ID NO: 143889 - DNA, 407 bp, Homo sapiens
ggggattaaatgtaccatatcaatatctagtatagtatttgacatatattgtgtaccaaataagtgtagcttgtatttagagcttcttattgaaaacatgtaattatcccatgtctacctctttgggtactcttgcagtcaaaacctttgagctattttgccccattcttttcttccttcccagtgtttactggggccacattttatccattttgggttttggaattgttctctagggtcttttctagttataacgtttcatgagtctatggaaatgtcaacccaagtcatcttttccttttagtttctattgcctcttgtccagttcctcaatacctcaccttagaaatgatttgtaatgaaggtaatagttgctaacatttgttgaagaaattattatagtccaa

SEQ ID NO: 143890 - DNA, 925 bp, Homo sapiens
gggggtaggtggggagagataggagggcccagggactcatgggacacctttcccacagcctcctcgattgctgtgagcagaggccactcggagttaggggcatgggcaatagcaagctggcggcagagtccagcccagcatatgacttgccctgaatggaagctgctgaaacgggtgcctttgggtggtggtcggcttgcctctgaggccaccacggcaccagcagaatacgtatttcttctccttggctgcactggtttgtcgatctagttcagttcaactcagtggatgttctctgaatgcttactgggtgccaggaccacagagagatgttagtcactgcccagttcttagagccccaacacagataccctcatcccagggcccccagacacacccctccgctggactcacaactgtctggagtttctgtctgatggatggtgtgctttcatatgccactggcttccttggacatagatcagacaaaagccccgggatctgtttggtagcaggagaaatgaaggaagatgaaaaagcaggcagggaagggggtagtaaaggactgagagaggagggaggtggctggagaaggaaaaggaacattgctcgatgctcccatctggtggcggcctcaggaacccacgggaacctggaaggaggctctttgtgagacctgggcaaaggatggggcagctcgtcgatgatttttttgtgtttccaggcttcctgtgtgatcctggccctccggccgctagagagaggattgggaaaccccactgtcagctctgcatctgcccccactaccctcctctgccctattctgtccctgcccctccaagctgaagaaggtccttgtggggcgtcctcatttcttcctcaaatataaggaggaagataccaattaaaagctcatagtatcaac

SEQ ID NO: 143891 - DNA, 254 bp, Homo sapiens
gataattgaaacatgagggctgtttctaccttactgttctcataatagtgagggagttctcatgagatctgctggttttataaggggcttctctgttcacttggtgctcattctctctcctgctaccttgtgaagaggtgccttcttccataattgtaaatttcctcaggcctctccagccatgctgggttgtgagtgaattaaatctctttcctttataaattactcagtttggggtatgtctttattagcag

SEQ ID NO: 143892 - DNA, 295 bp, Homo sapiens
aatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgtt

SEQ ID NO: 143893 - DNA, 473 bp, Homo sapiens
ttcatcctcctctgtcctaaagcgtacttctttggaaaagtagagcagtttatgttagtgtacactagagatggtaaactatgccttgtgggtcaaatcgggcctgctgcctgtgtttgtatggcctgtgagcaaagaaaggtttttacatatttaaatggttggaaaaaatatttaaagaatgctatttttggacacaaaaaattgtatgaaattaaaatttcaatgtctgtatctttttattgggacacagccaccgccattcctttagcttttgtatgcaacagctgcagagttgactatttgagacacgttgtatggtccccccaaactggaactgtttccattctggccttctacagaaagtatttggaccctggcctagataaatcctggctggtggttatgttatgtgaaatgtgcacactgtaaaatataggcctgtatgattaaaatttttgatttcagctact

SEQ ID NO: 143894 - DNA, 477 bp, Homo sapiens
caccccttccgggggacaggcaaacctagtgcgcaacggcatccctgtgacgtaatagtaacggagacgttcggagcccaggacatgtcgggaatgaggagatacgaggtggcgctggaggcggaggaggagatctactggggctgtttctactttttcccctggcttcgcatgtggcggagggagcggaggtgaggaggctgcgataccgcggacccgccccgggcatggacgggactcagtctctgaggacccatcggggggaatccggtagctcccgccccgcctcatgccagtgtcgggtcgccccacagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 143895 - DNA, 345 bp, Homo sapiens
ggagccgcttttagaggcggggcggagccttcctcgacggcgaggcaccgcggggcggagtctgtagggtcagctcctccccgccccgccccgccccgcccggctctgccctctctctgcaggatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 143896 - DNA, 755 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaaaaagaatggaaatcctcccaaggggtgaaccga

SEQ ID NO: 143897 - DNA, 425 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 143898 - DNA, 1210 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggaggtgaggaggctgcgataccgcggacccgccccgggcatggacgggactcagtctctgaggacccatcggggggaatccggtagctcccgccccgcctcatgccagtgtcgggtcgccccacagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaagcccaccgtactgacctcctgactctgccgccgctgtcgccattcgagccgagcgcccctccccacacgggctctgttccgtactgacagggcgtccctccctggaagggtgcccttccacgtcaaagcccctcatcagtgtcaggcctcctgttactatcaatggctgtctcccccaatcccaacccccaaaaacccatactgtgagtcgcctatatgaagagaactaaataatcctgcctgttactcccttcctcggagcgaggactttgccagctgtctgaagaatcttctctgctgggagtatatctaaaaacattttaagcagaggtgtaggatgcaggctgtaaatggtaagaggggga

SEQ ID NO: 143899 - DNA, 790 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaagcccaccgtactgacctcctgactctgccgccgctgtcgccattcgagccgagcgcccctccccacacgggctctgttccgtactgacagggcgtccctccctggaagggtgcccttccacgtcaaagcccctcatcagtgtcaggcctcctgttactatcaatggctgtctcccccaatcccaacccccaaaaacccatactgtgagtcgcctatatgaagagaactaaataatcctgcctgttactcccttcctcggagcgaggactttgccagctgtctgaagaatcttctctgctgggagtatatctaaaaacattttaagcagaggtgtaggatgcaggctgtaaatggtaagaggggga

SEQ ID NO: 143900 - DNA, 722 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 143901 - DNA, 1087 bp, Homo sapiens
caccccttccgggggacaggcaaacctagtgcgcaacggcatccctgtgacgtaatagtaacggtccgtttccggggtggagccaggagggcgggagtttaggctgcgctgacccctctcagccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaagcccaccgtactgacctcctgactctgccgccgctgtcgccattcgagccgagcgcccctccccacacgggctctgttccgtactgacagggcgtccctccctggaagggtgcccttccacgtcaaagcccctcatcagtgtcaggcctcctgttactatcaatggctgtctcccccaatcccaacccccaaaaacccatactgtgagtcgcctatatgaagagaactaaataatcctgcctgttactcccttcctcggagcgaggactttgccagctgtctgaagaatcttctctgctgggagtatatctaaaaacattttaagcagaggtgtaggatgcaggctgtaaatggtaagaggggga

SEQ ID NO: 143902 - DNA, 131 bp, Homo sapiens
attccagggatgcaactgagaagtttatttttaatgcacttacttgaagtaagagttattttaaaacattttagcaaaggaaatgaattctgacaggttttgcactgaagacattcacatgtgaggaaaac

SEQ ID NO: 143903 - DNA, 559 bp, Homo sapiens
tgaatttcctcaccattcacattactctctaggcaattctagtttgtctttattcttatggagttactgtttctctgtaacttctgtgggtcaatcattttatctgcggggcaactctttcagctctgactttctaagaggatgctaataacaacatcttacatgttacatgtgttgagagtgtactgtggaccaggctctgagatacacatcttacatccatcatctttgatcttcacaacaaccctacagaatgtgggtatcatcagtctcagttttcagaaaatagtccagacaggccaaagataagcccctttttcagggccatagggtcagcatttaggaagcaggatttgaatccaggtctctttgactctaaaactcacacttattccactgcagcatgttgcttttgatgttaaaatgctttcttttttatgaatggggactcagtttttttttttccactacatgaaaatttttgctgaatggttgtataaatgtatgcatgggaaaaagattggaatgaaatattacaaaattctaaacagtggttata

SEQ ID NO: 143904 - DNA, 114 bp, Homo sapiens
agtgtgggccttaaaactcaccatcatgcacgtgcatgcctgggcagacagtcttaggcccaaccagacctgggttcgtatcccagctccaccacctgttaacaccaaatctca

SEQ ID NO: 143905 - DNA, 281 bp, Homo sapiens
ctgtgaatctagttaggtttctaagcatcagtagcacagtgtatgacagcacatgtgccagcagacctcacctgtgcagagggttctatggagaggcgaagtcgttagcctgctgtggcttctctggggaagattcagactggcagacagttgctccagtgccctcatccttgatctgcttactccctgtgatgaacacatgtattttgtgagatgtctgccacatgggtgggaaacgtgtattttcaccatcgtgaaaaaaatatggctgtattcaatag

SEQ ID NO: 143906 - DNA, 189 bp, Homo sapiens
caggatgcaaaacaaacataggcaaatgagctatatttctatttagttgtaaataactatgaaaacattttaaaaattccatttataatagcatcaaagaataagttattcaggcataaatgtaaccatggtggtatacacaaaactttgctgaaaaaaaataaagagagtggaaataactggaaagac

SEQ ID NO: 143907 - DNA, 233 bp, Homo sapiens
atattgtactattacagatttttctaatgaagtagtttgaaatcaaggctttagtggaaggtaatcttttcagtttctgacccagatttctttttcaagcaaaactcctctgaaagcctctttgctatagaggtgatgaaggcacttgctagcctaagcagaaacataaagtaaaaaattttgtagtagggaatttttgttggtaagaaatcagtatcatcttgtaacacaaa

SEQ ID NO: 143908 - DNA, 181 bp, Homo sapiens
cttccagggctcctggctggctattaaagtgacaattcttcaaaatatctctcctaaaatgacctgaacttacctttccaaattaacaacccactaactatgcttaacatatgtttttagtcaccctaactcttgggattaaacacccccatactttcccttgttcaccccactccatgca

SEQ ID NO: 143909 - DNA, 116 bp, Homo sapiens
gccaaagtcataagcattactggaggttcttataaacaagaacaacaactgtacattagggacagatagaagacagttctggaatggaatcctgtggtgatatcccaaatactgta

SEQ ID NO: 143910 - DNA, 381 bp, Homo sapiens
acagctgacatctcctggtgctatccccaaaccaccactcttaactcttaaataatctttgctggcaaggctatgctgaacctccttaggcactctctaatttgatgtcctaggtcctcccaattcttagtcctttaatacctgtttttctccttctcttattccgtttagtttttcaattcatacaaaactgtatccaggccatcaccaataattttaaatgaaaaatgtttcttctaacaaccccacaatatcaccccttaccacaaaatcttctttcagcttaatctctcctactctaggttcccatgccaccccaatcccactggaagcagccctgagaaacatcgcccattgtctctccataacaccccccaaaaa

SEQ ID NO: 143911 - DNA, 299 bp, Homo sapiens
taccagctgtgttgggtcggaaggttggtaccagccgtgttgggttggaggtgggggatagggcacagacagcctacagagttagcctgcctagagtcacacaggagcactgtgagaggagcaagctcgagagtgaaggtaggtgtggatctgcagaatattagagctgccaaatccccggggagtgtgaggttcgtctaggatagcaccactgcttggcagcagcttaaggagaaaagaagaatcgatcattgaggataatatcaggtaagttcaggaaccactcagcaaaaacctga

SEQ ID NO: 143912 - DNA, 159 bp, Homo sapiens
catggcctgctcctccttctggtgccctggatgcccaaccttctctaaactcccactgttaagttcatgcagtgctttgacccttgacagttggcctgggcctctgcaagtctcaaaagttagtaggaagtacacaccccatgttcttgatgtcttttt

SEQ ID NO: 143913 - DNA, 532 bp, Homo sapiens
taagatcctgaaataatgaaacaacatcttcagaagtttgcaggaaagttgtagtgacccaagtattttatctttttgtaacaatagggagatactatgagaaaatacagtctcagaaaatatactttccatttacttattctgaatagattacttgtgatatgttccagagcacgatgggagagagtaaaaatttagaactcggaattagggaagttgtagaaaataggctttgaaacttgttaaagttattgaaataagtcaaaaaactaaattttacaaaagtaaatgttaggctctttgaaaaacaatttccattttgaagagattagtgagttgctttatttctctatatttattaataaaacatggaacgggagaatgatggcggaggaattgtgaaatttctttcataaaaagcaagaaaaaatttttaatcattctttctatagatacttataccatatattcattttttcgagaaacttttttttactgtctgataaaatgagagattatatgtggttattgg

SEQ ID NO: 143914 - DNA, 141 bp, Homo sapiens
aatgctttcaaagcaagaacattacgcatgtgtaatatccagaagtgaaaacagacccatttgacattgctctgcaagtttctgccctaaattagacagtgaatcagaaggttacgtctgcgggtgggttgcagagagaaa

SEQ ID NO: 143915 - DNA, 385 bp, Homo sapiens
gctttattttttattattcctgcctcttctttcagattccttctctaatcctcattcctcaccaagtactccaagtcctgatattcaccactgccttctttccatgattgcctgccctgagttctgcattagaggcccataccctgctccattaatctcaattttccctttcagggaatcacaggttattacagatcttgccatagagttccattgataaagctgagtgaagatcatcttcaaagttaatgaaaaccagataatgcatagaattgtctcaattatcaaactctgccacctatatgtgtccttaaacattgattcttacccctaattttctgttaggagtacttgtagtatgcaaaaggaataaatatttaaagat

SEQ ID NO: 143916 - DNA, 421 bp, Homo sapiens
ttttaaaggaggtggggtgttgctgagaaagagtcggggaacccgaggattaaaaaaatatctaagagatgtctcaaaccagttacatactgaccttattcggatcctgattaaaacaaactacagtaagttattatttaataaaacagacaatttatgacaactggagaaatgcatactatacaaaattaagaatgtatttttaagtgtaatatcacactttttaaaaagaaatgcttatgttttagaaatgtgtactgaaatatttacagaagaaatgctctgatgtttgagttccttcaaaataatctagggaatgcaaggtgggaggtaaaagaagattgcttatatgcgtgccatgtactgataagtgctatggagagatgttgggtacatcaggcctcattatgctcgtctctct

SEQ ID NO: 143917 - DNA, 417 bp, Homo sapiens
ttttaaaggaggtggggtgttgctgagaaagagtcggggaacccgaggattaaaaaaatatctaagagatgtctcaaaccagttacatactgaccttattcggatcctgattaaaacaaactacagcccttcagattcttggcttagatgtcagttcctcaggagaagactttcctgaactctcaatctatattagaaaacagcaacaataaaaacgactagaggaaaagccacagaaatgattctttgtctgccaagatgaaagaagtctcaactataaccaaaacctcagtcatatgctttctagactattaataaaaagctttcagagtcagaagaacaattctaagaattacccaacagatcttaaattagtatcacaaaatgagtttcccccttatcaaataattcttttaa

SEQ ID NO: 143918 - DNA, 781 bp, Homo sapiens
ccactctttgtgtaggcatttgtcatatacttaagaaaacgctaaaaagaatggaaattgtatgacaataacttaagtctttctccaaagtgcatgcagtcttttgcgatacctcattcagccgagtatttgtactcttcctcattcagtataaggaagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctaattttccagaaatgaaaaaaaaaaaatcagctctaaaaccaaagctgatttcagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttcaatgtgttgtttttgtcttaaaatttta

SEQ ID NO: 143919 - DNA, 428 bp, Homo sapiens
cattgtaggggtcagatgctgatttcagtatgagaataaatagcttgtacattcttggagtatttacttaccctgtatgtttacatcctaaatgtgtggagggtgctctggtgtaaagatgccctctgtgcctgtgctcatttaggccctgctgtggagggtgctgtggtgtaaagatgccctctgcctgtgctcggttaggccctgggctgtggagggtgctctggtgtaaagatgccttctgcctgtgctcggttaggccctgggcttcgttgtccttccgtgcagcgggcactgcctttggcgatggtatgtgcagctgctgacatggctcatgtaccttgctcctgtggacagtgatggctgtggtctgtcacgcccttggcttgggggcagtgtagtcaggagaagggaaacgaggaaatggt

SEQ ID NO: 143920 - DNA, 370 bp, Homo sapiens
cggggtcaaaggagcagggctgcaggacccaggcccaggtgaatcctccctgcccagctgctgtgaaaaccgactttcattagccttgctgcctctaattcctagtgggctttcttagtggtagactgagtggacatccagtgagacaaccaccccatggttcttaggcccgtccctccctcccttggggccattctcctgctgtgcggccctgagccccctcctctgccctctgacgctcctggggagctgcatggacggtgagggtggagttccttctctctctcgggagcatggagcctgggcaggggacaccaagcaaggtttcttggtgtccccaagaaatgcttggctcactagggagctcgag

SEQ ID NO: 143921 - DNA, 397 bp, Homo sapiens
gtcctcggcgcgttcccgccgccccccggtcccgacgcggggctcggggatgcccgccagcatgttcagcatcgacaacatcctagccgcccggccgcgctgcaaggactcggtgttgccggtggcgcacagcgcggcggctcccgtcgtcttcccggccctgcacggggactcgctctacggcgccagcggcggcgcctcctcggactatggcgccttctacccgcgccccgtggcccccggcggcgcgggcctcccggccgcggtcagcggctcccgcctcggctacaacaactacttctacgggcagctgcacgtgcaggcggcgcccgtgggcccggcctgctgcggggccgtgccgccgctgggcgcccagcagtgctcctgcgtcccgacg

SEQ ID NO: 143922 - DNA, 805 bp, Homo sapiens
taaagctggaggaattagtatgtcagtaaaaatttattccccatataggaggcagtcaacatttgaagcttcaacacagtgttatgtataaataagccccttaatcaacaaatttgctaaacaatttgtttagtgcccaagtgatccaagactaataaaagtactgtagatttagtcacccctttctgcagattaagtatgcttaataaccagtcattaagcactctagccacagcttgtttagcatattgatgtgtatatttcttctgcttttctcattgtttctttctttttgcatttttatattgcttggataattccttttttccttcttctattcctaatgttttcagtggtttctttttaagatttcttatttgaaagttttgttaataaataccttgagctcttagacttagaagtattttattcgtcttttttaaaaatctcctatattgaattcttacttataatcagagttaatgaatataattttagtgttcagaaatgactctgaaaatgagaaatttcatcttaataaataaaatgattttaaaaatctaaaaactaatttttcaaatagacttgaaaatagaacattttttagaggtttgtcaacattgtaagtaatttcatgtctagaccccttccttagctttgtattgaccttgcatctattcattgattaattattgcatctcctgtagtggtggccaaataaagtctgtgaattatttttattatttcaaaacacctaaccaaatgtgatttacttcaaaatgatcaaataaagtaactgactcaa

SEQ ID NO: 143923 - DNA, 589 bp, Homo sapiens
cctacccaaggtacaaaatgtggccgtgagccctgggcattgagagctatagtacattttctggcattggtctcaagcccttcatcgggctctggggcctctccagctggcagtaactgttgtcttaaaggagatgaggctgagggcatttggaagaggggcagctgttgaaggcattcttgtatcaagggaggtaggagggccctctgatgccaaaggcagccttctcaggctattgctttcttccaggaagccccacccaccccactgcctgctgcctggacaatactcagatcacagccttaccagtctttacaggagagaggcagggaattgggttcagatgaggatgtagaaaggtgggatccagcgatgccccaggcctgagcccccaggagaggaggctgcaggaagagggggcaggcaaagtctgtgtgcaggaggctcccttgccattcccaggagggcaagccgcagcctgggtggctagggagtttgagagcaggaagatctgaggatgtacatccctgcaatttgctttaaaattgaccagctggaagtgggagattcaggagaccaccccccccca

SEQ ID NO: 143924 - DNA, 243 bp, Homo sapiens
cctgctcaacagtgtgagactgtctcaaacaaagtgttttaaaagtatgtggcaacttccctgctctctgttgcttccactctattttctaccctcatgatgtgaaacaggctcctctttcatcttctgctgtgatcataagctccctgaggcctcaccagaaattgagctgatgttggcaccacacttcctatacagcctgaagaatcagaagccaaatggaacctcttttccttataaatt

SEQ ID NO: 143925 - DNA, 278 bp, Homo sapiens
ggcaatgcagagcgggaactgaaaagctaacaacattcttggatggtgtcctctgactcagaaccctgagagaaaaagctggtatcttcccaggtataccttctgttcagagagcatgagatgaatggacaaaatccacaggcgatcataacaacatccttattcctttcctactcattcattctcaggaatataatcacaattaagaaacctcagttgattgctgattgcccttttccccaaataaacacacagacgcacagacacacacatacaca

SEQ ID NO: 143926 - DNA, 320 bp, Homo sapiens
caaaaaaaaaaaaaaagagagaaaagaaaagaaaaaagcgtttgaggaagaatagatactgctagttgtggctggtgtgaggtctgccttctacggacagcacaaaatgcagagtctctactaaaaatacaaaaccccgtctctactaaaaatacagaaattagctgggcgtggtggtgggcaactgtagtcccagctacttaggaggctgaggcaggagaattgctggaacgtgggaggtggaggttgcagtgagcctagattgcaccattgcatgccagcctgggcgacagagtgaaactccatctcaaaaaaaggaa

SEQ ID NO: 143927 - DNA, 187 bp, Homo sapiens
agtagggggaagaaagtgtatgtcctttactggagccataattgctgaaagcgagagagacaaggaagaaggggtagggaagaagaggggaaagggaagaggaatggaggtggacagactaaaccaggacatgccaaaaacatttttgtggaaatatcaccttgaagagcctttgagactctgcagg

SEQ ID NO: 143928 - DNA, 204 bp, Homo sapiens
gggagggggaggcctgcgtgccgagagaccagcgtaagcaacaacacagaggcagaaatgacatggtttgtgtggggaactgaaagccatttttgaatgctgattactttggctttaatcagtggtcacctagaaaaagctttgtaatcataacacaatgagtaattcttgataaaagttcagatacaaaaggagcactgtaaa

SEQ ID NO: 143929 - DNA, 594 bp, Homo sapiens
agggctctgtatgccaagtgtcagtatcatcagtaggtcaaagacctggaagggctagcatctttcacttggcagctgtgcttggagggtgcagagtgggcaaggaggcgtaaaggaaaaaatacatgaccaggggatcagaaaacttgaagtcaggacccagctccctcaccagcaaagtgttggcaaatctttcagcttctcctcaaggttcctgatctgaaaaatgacggttgtttgggggctcgaaaagacaacacatgtgaaagagtctttaatcaactgtaaaagaccaaataagtcaagtctgatttttggtaagaatgctgaccctgagtctagaagtcctttgtgacactctataaataagaccctatcgaccattttggggggtacaaacagactaacccactgcccaaggaacatgacattcaggatcaaatctttggcaaccctttatgccaattcagcagctaccaaagtcatggaggaaagatggttcccaagagctacatgctcgaatatttatcaaactaaagctaagagagtgcagaggtgggatgatcgtccgatcacacaaggggaaaagtgcac

SEQ ID NO: 143930 - DNA, 157 bp, Homo sapiens
gagcaaggaacaaacaagaagaaaatcaaggggaaagcaagaaaaaaacgaaagccaatggagtatgaagaagactacgtgcaagtaagtcctgtaggtagacattgattagaggcaaaagtcagagagggcatgactatggtatgattagtgggat

SEQ ID NO: 143931 - DNA, 204 bp, Homo sapiens
ctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggct

SEQ ID NO: 143932 - DNA, 330 bp, Homo sapiens
ggccagcacggtggaggccccagcgccccggcacctgcccttccagggctcagctgggtactgcgcagcagccggccaggcccagaggaccccccccaacccctgcaccaacaccccttgcaggaaaggcaattcccaggcctcgcttccaggacataaagctcagtagctggacctggtcactcaggccgagcaaggcaggcagcgcacacagtgactggagacagcaggggctgcccacggtacctctacacccctcggcgggcaaccctggccagcacaggctccctggggcaggcggaaacagagccagcaaggaaaagccacatg

SEQ ID NO: 143933 - DNA, 300 bp, Homo sapiens
tatcttctcctcatagtactgtgagcttttgaaggtagactaagtcatcgcttgatcctgggagcctactgcatagttcttcttcaataaatgtttgaactaattaaattaattaattcaatgtaggtctaccaaggtgcaggggaagaagtgcaaaatctagaaagcatatgtaagttacatttatgagtgaataagttgcaagctccaagtatcaatcttagaaacaagtgcatgagtttattataaagacaaagatataataacacccaaggtccaaatgtactactgaggtgtaag

SEQ ID NO: 143934 - DNA, 644 bp, Homo sapiens
cggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccagagccacaaaaagact

SEQ ID NO: 143935 - DNA, 132 bp, Homo sapiens
gtttagattttagagaagtgaatgcaagcatgagtaccgaggagaggcaggtggggtggtgattaagaggccgttcatgttatcttcaggaatgcacggtgcagagtggtgtgcacaggagcctgactgcag

SEQ ID NO: 143936 - DNA, 172 bp, Homo sapiens
ttttttgagtccatgaggcagtgtatggtggaacctaccctaatccagcccacctgagggtaaataggcactcaagagaagtcactgcatgttatttcaaagatttgattactgaagtctaatctgtagagacccaggcttactgcaacagaaagtccataagtaataaatt

SEQ ID NO: 143937 - DNA, 538 bp, Homo sapiens
caccatgttggccagaatcgtctcaaactcatgacctcatgatccgcctgcctcggcctcccaaagtgctgagatttcagacgtgagccaccgtgctcggcaacttgctggctcttaacttctattttagtctgcctaaaactgtagcagagctgatcctgggcagctgttctctggtccagatctgttaagcgggggtggggtggtagagcaccagactaacatgccagtatcttggtaaaatctcagccctttaacaaagggccatgcagcataagatcatttcatttgcatgtggctgaataagtgatggaaggaaatgatagtccagttccacatagagtgtgttggcacataaacagtttgatagccttgttatatattggaggtgctgatatatttttgtatatttcttagtgttactgtagttctgaagctattggaataagacccaattgaataaggttgaaaccaggagattttgtttgatcttacttagtatgagttaaaataaaaacttagaatttctctatgttct

SEQ ID NO: 143938 - DNA, 408 bp, Homo sapiens
gaaaacagaaaccatgctaagggatttctaacacgaagggtttaatacagaaaataggtgctttcaaaacaactggcaaggctatatagtgtgagcaaaagtaaagtgggctaactccccatctaattcccacagtcattgtcaagagtcaggaagctactactgccatctataggttaggaaactgcaaaaatctgctgccaatactgcagctgctctgcagccctgagacagctggccagtgggggaaggcagaagccactgcaaaaagtcacctcaaaaatctaagcccatgcacacccccaacatacactatggcctgaggaagaaaggttccacctcccttccacttgccacatttcccaagacacatgtcatagggcaaatgacacacagaagcctgctgcc

SEQ ID NO: 143939 - DNA, 252 bp, Homo sapiens
ggaacaccttgtcaagtaacctggcacgtggggctgagcccagcactcttgcccagctgcagaggcctagggacctcacttctttccggctttgtctttggtttttcctttaaggcttctcctggggctgcccgtgcagaaggggtcctgatctccctgcctggccgcccttggcaatctgtgcagagagctctgagaaggcctgggacccctccctcctacctccctgccttctgtgagcacctgtcatct

SEQ ID NO: 143940 - DNA, 160 bp, Homo sapiens
tggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgt

SEQ ID NO: 143941 - DNA, 377 bp, Homo sapiens
cgttcactctcccgatttctgacctttcaaacacccttgtaactaagtccttgtattatattccatctgtttgaaatttatggtatgacctctggtttcttgattgtgtgataatgtaagcgatttctttcttcaatgacttctttcttttttacaattgtgatatatacttttatttctcattgataaatggttacaaatcatactcctaggtttatatagcactaacacttaaacacattgtaaagcttctggaaggcttataataccttgtgtcttccagctttatctcccagactggatctcatttttttctttctacttttcttcccttttttttcataaaaattgtatatatttaaagtgtacaacatgat

SEQ ID NO: 143942 - DNA, 272 bp, Homo sapiens
atacatttaaataccaagaacctaaaataagtacaaaggcatttactgggaagagtctttctttcactctcctccagtcctcttgtccccctccccagagcactagtttttttgttttttcagagaaactctttgtgagtacaagcatgcatgtatcaatgtagatatccacctagaccatgtcaacacaacacaatggtagtgtactgtacacactcttctgcaccttctttttttttcacttagtataatatatcttggagttcatttct

SEQ ID NO: 143943 - DNA, 387 bp, Homo sapiens
ctctttacccccaccccggataagaaacatctgggctgatctctagtgtacaccagaaatttggggggacctgcctgatatctagccactaaagatgaatgtttgtttacaaaacacacaacagcacctgcaaaaatctggccttatatccttggtaaatcttcattgtttcaaattactctagtgagccacaaaataaaacaaactgcttaatccagccagagttgtaactaagcagctgtgctttattgatagaaattggagagtaagagttacaaatcacatatttaatattataaaggcatctacactgtatttgataaatatagacagcctgaagaagtaaagagctaccctataccctgccaagcatacaacgtcaaaaca

SEQ ID NO: 143944 - DNA, 186 bp, Homo sapiens
ttagctatacctgactatatttattttagcagttgctctagcaattacagtatgcatcgtgccagccatgtgagagctacccttggatgactgtagttctggtccatgtattaactgtgacttcctgcgagaccttgtattagtcagagtcctgcagagaaacagaaccaacaggatgtgtatata

SEQ ID NO: 143945 - DNA, 499 bp, Homo sapiens
actgtgaaactgagtttctagaaccttcttttggtttatcattgtttttagggtactgtccttcagtggcccatccaaatgcaaagagattcaccagagctatccaggcttggtgatgctgggccccaaaattggccttagctctgtgagacactttttaaccaccttcccgctcagccacttggcctctcagtcctgcttttagaaattggcatatgcttctaggcacagtgactcacacctgtaacctcagcactttgggaggctgaggcgggtggatcacttgaggtcaggagctcgagaccagcctggccaacatggtggctgtctctactaaaaatacaaaaaattagccgggtgcggtagtgcatgcctataatcccagctgcttgggaggctgaggcaggagggtcacttgaacccggtaggcagagattacagtgagccgagatcgtgccactgcattccagcctgggcaacagagtgagaccctgtctca

SEQ ID NO: 143946 - DNA, 592 bp, Homo sapiens
cttgagaacaagtactgtcctgtcggtttcatggccttcttccatttgtggttcttgcgaagtgggaatttaaatgacatcttatcaagatggataaaccctagtttcccagtgctggaatatagaaaatggatggacaagtaaatcccactcagcacccatagtccaggcatggggacctcaacacacctgagcaccagacatcacctttcattctggacctaccatgaaagacttctgaatccaggaagagaaactgactgggcaacatgttattcagatggggtcttcttatgttgcccaggttggtctcaaattgctaggctcaagtgattccacccacctctgcctcccacagtgctgggattacgggcatgagccagcgcatctggccaccttattttcaattactggctcaatgtaatggctccatctcaggaacagccaatgaaaaagatgcacaggacaagaaacagcaccttgccctgtcactcaggatggagttcagtggtcctatcatggctcattatagcctcaaactcccaggctcaagcaatcctaccatgtcagccttcccagtagctgggactac

SEQ ID NO: 143947 - DNA, 230 bp, Homo sapiens
ggggaggtggaggttgcagtgagctgagatcgtagcactgcactccagcctgggcaacagagcgagactcaatctcaaaaaacagacaaaggatataaaccccacccaactgccatctgccatgtccctgattttgtccaaagtcacacccacagtatagggaaggttttggagggggtgatcgctgcagagggaggtcaggcacccctgctggttcttgtcccggcaac

SEQ ID NO: 143948 - DNA, 676 bp, Homo sapiens
tctttaaaggattgacagatgatttatctcatatgtagacaatgattctcagcagttaactagcgcaacttgataatgtcaattgcttgagaaaatcagataattgcttgagaaaattaggacattgcttgaggaagttaggtagttaaataaattactttttttaaagaatagtttaatattttggcaagtagactttaaaataggttggtaatattttaaaggctacttttaaagaagtagcaatataacatgtttaattatgaaaaataatgttggaaacaattcaattttctatcagatcattcacaaatacagaaataccatctcaataattagaagaagtagcagcaatttctgtcatttttatgcaagttactcttagtccatttatttggttttaaatagtgtttttaaaatttgttttcaaacagggctaatcataaataatagaacatattttacaatagttgaaggtaacaaaaagtaagtgccatttaaaaaattgtattagattgtttaaaaatgttgtgggtacatagtatgtgttgtgggtacatcgtatgtgttgtgggtacatagtatgtggggtccatgagatgttttgatacaggcatgcaatgtgaaataagcacatcatggggaatggggtatccctcccctcaagcatttatcc

SEQ ID NO: 143949 - DNA, 653 bp, Homo sapiens
tctgtgagtaccttcctaacaatacactcacctctgagcctccactgctgtttacaaataccctatcatgtgagttcattttctatccaaagcgtgcacaactaatgccttcctctgtgtgcacacttatggggtgggggggctctctgaatacactcccagtaaaccagggttcacacctctcctgccgctctgcctcagactctgccttcgctctatgtatttaaagtgcctggcactagtgggagctcaacagatgtcaattcttttccccacttttagctgaataactatgtgaatctgtgtctcggtgtccttctgcccctctgtctgttgtacgagaccggttggagtgtgttcctcagtaccgaacgggctatttgtaagatgccccgtgggttctatctcccttccgactctctcctctcctgtaaaacgttacaggttcccccatatggcatatccctccctcacgcgatgtatccactccggtctcccacagtactgcatgtccataaactgtttccccatgcaccctggttaccgcgtcccttctcggtgcttccctgtctctcccattttttttccaacatgaaagcgtctggatttgtagtccaattacagtgtatgtgcgcctatctgagcctctctct

SEQ ID NO: 143950 - DNA, 430 bp, Homo sapiens
gactctcctgtcctgggtactctttaggtagtggctgttctgaagtggctttggaaaccctggaatgaaactgtcatgtccaatgctgagatttgtataaactgtcattttaactgtgattattattccttaggatttgagaaataaaatctgaggagggagcaggacctgcctcagggcctcctctccaagttgagtgacccatcttcccaggtctccttttgttctgtcttgagcctctctcctgaggtcctgaaagaagagaatgtgctgttgtagggggcctggaaatgtcccatggaccatctcgtgactcagtaagatgatgtgtgtcctctggggacagaaggaggtcctgcacagagtgttcctgcccgttgatgccctccccagatcctaacgcgaagtctgacacatagtagcctcccgg

SEQ ID NO: 143951 - DNA, 795 bp, Homo sapiens
tagcaccacaagcagactcagaatcaaaggaaacattccaagagttgaaaaagacaattcattcaactaaataaatggaatggttccaagactggaaaaataccagtggtgcggaaacaaaagctataaatactgctcctggaaagagaacactcaagactgtcatagacatggcaggaaaaatgttgaaaaaccagaaaattggagatgctgcagctgctttgcaagggacagtcttggccactggaaataggggaggtgagagcaagagataaggggaaagggtcaggagttagagccataggagaggagaaatgttttcctctcacaaccgaggctggcatcaggaaaggtggtcctacagttgtcatgacatcatgagttggaacacagaaatgacaaggaacttgcaatcctttccttcaatgcacaaaatgcccaggatagttggcccaccagaaaagtctttctggaatctcaagagtctgtatagtaaacaacactggtgcagtttccctttcctgttgagaaaaagcctaaaagtggttggacatggtggctcacacctgtaatctcaacactttgggaggcagagatgagcaaattgtttaagcctaggagttcaagactaccctgggcaacataatgaaaccttatttctataaaaaatcaaaaaataagccagccaggtgtggtggtgcatgcctgtagtcccagctactccggagtctgagaggtaggaagattgcttgaggccaagaggtcaaggctgcagtgagccatgatcatggtact

SEQ ID NO: 143952 - DNA, 278 bp, Homo sapiens
agggtaaatagtagtaggtgcttaaatgtttggtatcatcacagccttactattcttatctcttaggtgagagactttgcctgtttcatcactcataaaattaggagtaagaataaactacctcataagatagctctgaggattaagctcaacttgggtcttatctggatataaagcctggccagcatctcttaactttagagagccctaaatcaggaccaggaaatagctcattcatttatgccttatcatctccactgcacttaactcctagtcta

SEQ ID NO: 143953 - DNA, 369 bp, Homo sapiens
ttttgaatggaaaccatgagtgtagcagttcttctttatgacttgctacataatcatgcaggaaaatgcctgtcacgggattggatcctaggagattagccccattgctaattaaaagccccattaaaagaggggaagttcttttaggtatctacagcttcctaagatttgaatggtttacaaagcagaatgttggctgggcatggtggctcatgcctgtatcccagcactttgggaggccaaggcagacagatcagaaggtcaggagtttgataccagcctgaccaacatggtgaaacctcgtctatactaaaaatacaaaaattatccgggcatggtggcatgcgcctgtaatcccagctactaggg

SEQ ID NO: 143954 - DNA, 319 bp, Homo sapiens
agtgcccagggctaagtaggatgtgaaaatggacagatggacatccatccaagggtctggaattcaccccctctaaatcatgttgggagctttctttaataaagcatttagcaattctcgatgaagctgggtggggctctatctgctggaggtaattactctaatgagcttccctcaagagtggcctgccccagccaggcctcagctcctccctgccttgcctgacatgggtgccacacacacacacacacacacacacacacacacacacttacacacacttcaatttgctctccacctcttctgccaaacctgcctg

SEQ ID NO: 143955 - DNA, 218 bp, Homo sapiens
agggttcaaatttggttggaaagaaaaaatcggccagtggggtggctcatgccctgtaatctcaacactatggaaagctgaggtaggaggatttcttgagcctaggagtttggaaccagcctaggcaacatagcacactctggcccccatttatacatatatatataaaactagctgggcttagtggtgtgcaccagcaactcaggaggccaaggtgg

SEQ ID NO: 143956 - DNA, 467 bp, Homo sapiens
aggcctcaggtgaatctggaaataaagaatctaataaatgccattagcggttttcattgtctgagaaacaatttataggcaaagtctgaatgatataatatagcttaagagcaaaatgtaaatgttaagacactgacaacataaaagtaaaatatcactatcaaaaactgggaaagcagggaaagaagtaaaaaaagtcataatttctttatcttatataaaagagggtcaaaagatactatccaaagttcagaaattaagaaacagaagcttacaatattatctacaacaataaagtcatcaatagaagtaacaaaaataactttttaaaaaacaagaaaggagggaaacaggttaacatacgtgtggcaaattcctcacttttaacaaggtaggacaaccaccaagaatgctaaaaccagaaaatgtttaaaatgttatttctggccaagcgcagtggctcacgc

SEQ ID NO: 143957 - DNA, 98 bp, Homo sapiens
ggctccagccgcggcctgcctgccgggacctgggggcgggggagaggagagccggcccctgactcacccggccgcccgaggctccaggctggcttggg

SEQ ID NO: 143958 - DNA, 380 bp, Homo sapiens
tctttctcaaaaaaaaaaaaaaaaaaaaaaaagaatgccattatcaggggatttgtcatggagaaagtggctgaggaccctgggcagatcactgtgcatcttcataggtgatttggggtaatccccttagtctggcttgcttcacagggtgtgaagcttaataagacttgtggcagaagagatgaggagagtgagagaggaggggaagagaaagtgaaaagaagggaagaggagccagatgcattacagtggaactagttctccaggatgggtaaaatctgattaggaaaaaagaggggaaaaaaatgagcaatcaggcaattcaaggaaaagttgattcaaaatgaaactgcagctgggcgcggtggctcatgcctgta

SEQ ID NO: 143959 - DNA, 810 bp, Homo sapiens
agacaactgcagccagagaaaatgacagttctagggtgcgaccgtgggagtgagaggttagggtggaggtgaccaggtggacagtaggacacagaactgagaggtacacaaggatcttctgtgtggatattgaaatcagtgtgagataaatacagtgctggagagactgagaatgaactcaaagtcctcaaggatcgagatgagaagtgacctggggtcagcaggtaccttcaagaaggaggcggtcggctgggcacggtggctcacgcctgtaatcccagcactttggaggccgaggcgggcagatcacctgaagtaggagttcgagaccagcctggccaacatggtgaaaccccatctctactaaaaatacaaaaattagccaggcgtggtggcgggtgcctgtaatcccagctactcaggaggctgaggcaggagaattgcttgaacccaggaggcagaggttgcagtgagccaagattgcgccactgcactccagcctgggggacaagagtgagacttggtctcagaaaaaaaaaaaagaaggacagggtcagtggtatagtttgatgagattcgaagggagattcaacccagtggttgtttaggaaggaaagagcaaatggtttggaatcagcaatcagtactgaagaggttattgaccccaccctagggctgaggtatgagggcaggagggagaacagctaccacttgaacacccgagctcaggtgatccacccaccttagcctcccaggtagctgggaccacagtctggaaaggggatgttaacagcttcactaggacacttt

SEQ ID NO: 143960 - DNA, 465 bp, Homo sapiens
gtcacgactattattattaccaggctcaatctaaaaggctggtctggggcttccagcttttctgattccaaaaccagtgctaaggcccaggaaagggtgcctggcagggcccccagcacatcctccacaccagcaggctgggtcagggcagcctaacctaggttctcagctcggctgtccttgccttctgactcctgcctctctgcctgggactgcctgttccccgtgacctctgaattcctttttcttgtggaaactccttcatgccagacacttccctctgagagccctaaaacacctcttttcaaagaagcccatgggttttcctggaaaaaccccgaaatccaagacctggatccccaggctcaccggcagaaaccctggtcatcctggtcaccctgggctgtggccgcctgaagattgagcagcagatcctgcccctcagctgcccactgcagggctgtg

SEQ ID NO: 143961 - DNA, 245 bp, Homo sapiens
ccgagatcatgccactgcactccagcctgggggacagagcgagactccatctcaaaaaaaaaaaaaactctctttaaatcacacattcgagtgtgccctttgtttctcatcaaagccaagactgatttgagatgatttcttaaggtcaggttaatgtcttaatccagttgtgctgctataacaaaataccacagagtgagtaacttataaacaacaaaaatttattgctcacagttatggaggat

SEQ ID NO: 143962 - DNA, 296 bp, Homo sapiens
tttttaatcatagttgctgttacatgaagtctctgaatttctagtgtggagactaaagtaactcaatcttagatgctaatctgctgtattgacttctaaataatcccagttctgggaatgcctctaagatttctacttccctgtacttaccataaatcctgcccttaagtcaaaacaatcttgatattattgtaaacacatacttactataaatcctgcccttaggcaaattccctgtgatctataagccctggggtttggggtggggtaatggcaggtaggcaaattcaccaagt

SEQ ID NO: 143963 - DNA, 364 bp, Homo sapiens
tgggctgactctagagcatcccagtatctcggaccgttccacgaataccttcaaggtcgctcccccctggcccccatttttccatcaggaagcggaggcacagagtgagaaagagctgcccaaggctcccaggcagttcacggagccactgggagttacactcaacccgtccaaccccacgtccctgttctcagccaccacaataaaccaccaaggttccacagccacaggagctcagcccggagtccccaccgggtctcccaaggcagggagatggggctggaggccatgccaggtgcacggtgcccagagctgcttaggaagcctcgcggtgcgggctgggcaccaggcagtgtctgtagga

SEQ ID NO: 143964 - DNA, 113 bp, Homo sapiens
gcttgtcatcactgtctcctcccttcccctcgcagtttatatttagctgggcacacgccgtgtggatgcccgttttcttcctcctaggggagaatcctcagctacagggttgt

SEQ ID NO: 143965 - DNA, 274 bp, Homo sapiens
ctttaggattgagtttttcaggaagggaagaggaagagctaccctctgtttcttgacttgaactgagcttggttgttagaagtaagggaagtgtggaatccagtaactgctgatatgtggaggcctgacctcctaatgtctactctcaagacttcctacgagagaagtttttttgttttgttttgttttgttttgtttttgaattatggtcttgctctgtcacccagactggagtgcagtggctccatcacagctcactgtagcctcaacctcc

SEQ ID NO: 143966 - DNA, 422 bp, Homo sapiens
cagtgaacaggcacatcctgcgtggcacgtgaaagaattcggaacagcgggaaaaattaaaccacggaagcaaatttcaagtcaacagaaacaagaactttctaagaatgagagcagttcaacaatgaaaagggttgctttactgactgctggactgctcatacaagaacattctacagcagggagctgggctgaacttctataaacattcctcactccccaaatcctttccatccctgaatgtggatagtgagagggtagacatcacgagatacggcatcattcgaatctacccagtgccccagtctcaagtagcaagttttatctaaatgtattcagttcctgggtttaattaatcagtttgaacagaatacttgtactgactgagcaaagttcaagaaggcagaataggaacattacat

SEQ ID NO: 143967 - DNA, 783 bp, Homo sapiens
cctataaagcaggaggatcactcaggttggggcctgtagaatcttttatatcttgttcaccaacctgctgccattgtgtgaggagcttctggtggtcaatgcagaatctataagtgtaaacaagcattaacatcaaaactacaacttccagggacaccagaacctgccttgtttagaatgttaaatatatcttttccaaaaaattgataatatttgattatctaatcaaaatattataactatacattaaaccttacatagaaagatgttaaaattctgttaaactttcttgaattttgtttaaatgatcttaaaattctacactttggaatactgacttccattctttaaaatctgtgcttttctaggcagtctatcctaaatgtttgtatttaaataaagtcttttagattctaatctttctgatgactttaggttgacgtaactatagtcacaatcttgtgaaagaaatctcaaaaacatattcctcttttggctttctcataaacggtttggccacagagtcaaggagagaacattggagtgtctgagagcgtgggtcttgactaattttaatcagcgttcctgggcacagaggacataccctccatttcattcctgatgtaatatttgatgtagttcatgttactataatcttgttactgtgatccaccaaaatatgaggttaaaagacctttcaatcttttaggaagaaaaagtgttatattttcctcatctttttgggtttcgtggtcagaaacatgcactggcagacaggatttt

SEQ ID NO: 143968 - DNA, 1020 bp, Homo sapiens
gaaacaacccataaactgatggatagttaaataaagtgtggtatatccatacagtagaatattatttgacaataaaaaggaatgaagtactacatatagaatgatacatgctacaacatggatgaatcttaaaaacatgctaagtaaaagaagccaatgacaaaaggccttatactgtatgattctgtttataaaaaatgtttagaatatgcacctccctggagacagaaagtcaattaatggttgcccagggctgggggaattgtggatatgtgtgggtagttggggaatggggagtgactactaatgtcacagagttcctttttggggcagtggcaatgttctggaattaattctggagttgtgcaactgtgaatatgttaaaagccattgaattctacacttcagatggatgaattgtgtgatatatgaattgtatctcaataaatctgtttaaaaaagtattacatatttcatttggtctcagggcactgaattgtcttttaattcaaaattgtactggctaggagaacccatattttcaataagaataccagcctaataatggtaataacttatttgcatagtgtgccattgtttacccagagttttcacatgctttatgtaatttgatccccactggacctcaccatgcagatgaaattgacacaaagaaaaagtgacttctcttaagcttacacaaccaagaaatggtagagcaagtatttaatctcaggctttctggttgttagtcactgccttcttgtcagaacaatgtcagaacattgcaaagaaaaaataatatctttcagactcttaattatgctttaaccctttcagttcttgaatgtgactagaaaagtcattcaccttctctgtcttgctttccttacctgaaaaatggagataataatgcttcctaactaaaagtcatttacctttttgtctcggtttctttatccagaagaacaagccaggaatatttcctatctcttgggcatataataaggactaactaat

SEQ ID NO: 143969 - DNA, 320 bp, Homo sapiens
ctccccataccaagtccacggtgagagaacggtgcctgggacacacgcacacaacacttacatgccacacgtgcacacgcacctacccacacgtaggctggcacccccatataagcagcccatacacacacacacacacacacacacacacacacacttacatgcctatgcagttagccacacgctatgcacacaaaggcatatacccttatatatgcaacccccacacacctatccatgcacacacatgtgcttacatgctcacccatgcacacacacctgccacatgcacacacacacaggaatgtaccctcatagat

SEQ ID NO: 143970 - DNA, 253 bp, Homo sapiens
gaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttttctcctctgttttttggtagaagtt

SEQ ID NO: 143971 - DNA, 920 bp, Homo sapiens
aatctctctcttgtccctcttccttgcctgggaatctttattgcctccagggtgggaaaagctgactcttgctttgtcatccgttctctcacgtctcctgttttggtataaactttgtacccagactctttaggactctggcttttgaggctggaaggggtaggttcttaccactaactggtatttctttcaaaaccacttctctagtttaagttctgaaagtctatttagaaactcaaaagccaagaattatcttcttttgcctgctctatcaccccttccctgagtaagcctgtgctcggttgctgcctataggttgtaaaatacaggaagtggggtgtggggtttttaattgtaatgaaaatccatatcgctaccagattctgactttaactgctccctaactaccacaaattactaagcatgttctaagtgcaaggtgttttgtgagaagctgtcaggagaatataaagattaaaaatgtggagtacagatcacatttttgtagcaattttgtcccctacatatcccatttgatgttgaccatgtctctgtgggcgagcaggttaggtagaaccctcagtgtgagcctgcgaggtgagttttatgttcttagcactttccagatgagaaaactagctgagagagagagagtgttcagctcatcaagtggtggagctatgggtggaattttcaagtaaacccagaacttccaactccatatatccacttccctccactatccctgaaagattctcaatgagcctccaggccattgggcaaaccaagtagagcccagggcagaaaggaggggacattgaattggacctcataggatggtggcagtaggattgggagaaaagtattccaggcagagagaacctggaagtggacttgtatcagccttctctacccaccac

SEQ ID NO: 143972 - DNA, 169 bp, Homo sapiens
caaagttctaacagcatcatagaactttctcaggtttattctctggatagaagaggacacatagaaaacctgaaatactgcccccttcccacacacaaagttccatctatcagagggtgggtgtggtgaggaaaattctaattttactgtctgtttattagatgagttg

SEQ ID NO: 143973 - DNA, 259 bp, Homo sapiens
agaattaaagaaaaattctgtggggcttccccacatctttaatatgctactgtcactgtgagtcactgtggtagggaaatgatgtgtagggttctccaactcatatgatcagggaatcccatctgcaaggaacctctctctgtgggtttgtttcatggacatagttgaggaatttatgttgttgtagatcaatgaaatttatgctgatttctgtaccccttctgaccccacccgaaacattcctgacctttcgcttttg

SEQ ID NO: 143974 - DNA, 171 bp, Homo sapiens
ttaaagagacccctggcagggatgaaactggactttgaatctaactgctaagcagagcctgctccactgccaccattttgcctccaaatggggatggtctcacagcccatgtgcctcaaatagaagtatcacattactaatgtcttcctcttctcatctcatgtaactctg

SEQ ID NO: 143975 - DNA, 247 bp, Homo sapiens
actaggcaaagttgattttattaaattttacatgctaagatttaagggcttcagtaaatctcagatatctgtgtaaattaattttttaaaaactatgttaagctatttatcttttttagtaatgcaaggaaagaatttttaaatttttttgagaaggagtttcactcttgtcgcccaggctggagtgcaatggtgcgatctcggttcactgcaaactccacctcccaggttcaagcgattctcctgc

SEQ ID NO: 143976 - DNA, 787 bp, Homo sapiens
aattttaaagccatttctagctgttctctatctttaaaaatttattgaataatttaggaagatggagttggttgccaggaaaaataaggacagtagtactctggagacccctgtatgggcattgaggaacatagtcaagaaagttgttaatagtcttgtttataatattaagaagttggaaacaaccaaagtgtccattaacaagggaatggataaataaattgtggtatactcatctagcgggctactgtacagctggtgggaatatattagtattaactgtagccacatgcattaaaatgtttgttaatacagtatatgtagttacacttggcccttgaacaacacaagtttgaactgtgatggttcacttatacacaaatgtgcatttaaaaaatacagtatttgggggatgcaaaacctgagtatatggagggccaacttttggtgtatgtggtcttcacagcgccaactgtgggacttgagtatgcacagattttggtatacatggggatcctggaaccaattatcctcatataccaaggatcagctagctgtatatataatatatacagtcacgcactcaataacagtatttcagttagcagcggaccacatatatggtgatggtctggtaatattataataccctgtttttactatgctttttctatgtttagatacacaaataccgttgttacagttgcctacagtcttcagtatagtgacatactgtacaggtttggagcttaggagcaaaaggctgtaccatatagcctaagtatat

SEQ ID NO: 143977 - DNA, 311 bp, Homo sapiens
cagcggcccccccccaacatgtgacaagccaaataatggcttccaccgatttccaaaatctccatagcagatgtgccgcctccactgagaagcactgcgtttgcatgttccaattctgtgcaatgtttctagcctgtcataaatggaagcacgtgcaagacaaatccctaaaaacatcctccactcactggcgtccctgccatcttgggaaggagagtgaagaaggtgcctgggccttgcctgtgaccagccggctctccctggctccatctgggatatggtcatcccaaatcactctactgcatgtttcc

SEQ ID NO: 143978 - DNA, 666 bp, Homo sapiens
ataaaactgtgtccaagtttcttacttgtattaaacagagtgtttttctagatattgttaaccaagataaggaatccctaaagagaggcaggcttgatttagagctgtctgagggcttccaaaagagctgttcagtgaataagaaggaatccaaccatggagcatcagagtctaagttggatgtataggtttgtgtgtcttcagtattgtcttgtattttaagacagaattagatgtgcccatcagaaatgagtgtatggcatgaaaaagttgcagatggtaggccgcagtgaactccaattgtttggaaggcttaacttgaaccttcctaggctagagaattttaaatgactgagatgtttctaatgtgcctagagcttcttttctaatgagcccagggagggctagaatctctatcagagttagtctgggatgtaaaggggatcaggatgtgccaccccaatatatgccactttagcctatggattattttgagcagttaaaaaattagaaatagcaggcctggtgcagtggctcatgcctgtaatcttagcactttgggagaccgaggcaggtggatcacctgaagtcaagagttcgagaccagcctggccaacatggtgaaaccccatctctactaaaaaaaaaaaaaaaaaaaaaatacaa

SEQ ID NO: 143979 - DNA, 450 bp, Homo sapiens
taacaaatttgttctcaagaagttttttttccctaaataacaaaaaatataagtgtatatgtatatctatataggacctttataataatatcaataataggtccttcacatttccacagtgaaggataaaactgagttgatcaggatttgaaatacccatctttaaggatgaactagaaaagcctccctgaggaaatgaatttgaatgtgtttcaaagggagggcaaggtgacttgacaggtggtgaaaagaaagagaaattgcaagcaaggaaaatgccctgtgcaaaagctgcccctgtggtttctcaagaagcagagtcgcaaagtgatcccacaactgagaaagatattagttaagcacaaacaaaagggagagaagctacacattatgtgacactcagcctcagttttctcatctgttataggagaaggctggattaagtgattt

SEQ ID NO: 143980 - DNA, 984 bp, Homo sapiens
gcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtggggctgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaagcag

SEQ ID NO: 143981 - DNA, 875 bp, Homo sapiens
ggagctcagggcaggtacctgaactctgagagggcttcacagaggagatgaccgaaacgtaagtcctaaatgacaaatatagatgctccagctggaccagagagtggaaggcacgccaggcagaaggcgcagctgagttcaagggcctggagcatcctgtctcagagcgttattttggtctgatgtccacacgaagcctccagtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctgctttcgggcgctggcgcctctacagaggagccctgaggtccctgcctgcactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgtaga

SEQ ID NO: 143982 - DNA, 1880 bp, Homo sapiens
cagtctcaggccaagagctgcaggctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtcttcgttagctgcctgctgctgtctgcacctgtgtttggctacctgggcgaccgacatagccgcaaggctaccatgagcttcggtatcttgctgtggtcaggagctggcctctctagctccttcatctccccccggtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagcttcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctgctttcgggcgctggcgcctctacagaggagccctgaggtccctgcctgcactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgtaga

SEQ ID NO: 143983 - DNA, 1743 bp, Homo sapiens
cagtctcaggccaagagctgcaggctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagcttcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctgctttcgggcgctggcgcctctacagaggagccctgaggtccctgcctgcactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgtaga

SEQ ID NO: 143984 - DNA, 354 bp, Homo sapiens
actgtgtctgcagtcgtggggccctgagcccgaccgcaggggttgctggtatgggggctgctgcagagagggagcggggcccagggctgacaggtgggtgccttggtcgcccctggggtcacctcgttctcccctgtggtcacccctggctgaggggtgttcctgggctgcccaccactggcctctggagtctagaaagaagaagcaaaagacacacagtgcgtccacctggctcctcccctccacccctgtccacgttggacccaccttcctccgtcccctggaccattctcccttccaccatggctgcacccaactgtgacccccacacccccatgtaccatccactcagac

SEQ ID NO: 143985 - DNA, 454 bp, Homo sapiens
ggacgttggattttattctggggaatgaggtgcctctggatgtttttaggtgatggagcaatatgccctcatttcaggggttctgccctggctgctgtgtggagagtgccctggaagaagggtgctgtgcacatggtggggagacctgtgggaagtgcttacggggtctccatgggaaatgataggcagggcagtgttgcccagtcttttaattgccccccccccgccccggccctgaaccattttagacattttcttcctatttactccccctgagatcttttaaaaaaatgaggtcaaattcacataacataaaatttaccattttgaacagatcagtggcatttagtgcattcacagtgctgtgcagccaccacctctgtctagttctaaaacatttccatcgctccaaaataaaaccctgtacccaccaaacagccactccccatccccc

SEQ ID NO: 143986 - DNA, 359 bp, Homo sapiens
gcagagtggttctggggagctgaagcggatgtgggttgtggggttcacaggggcactcctggagagcagagggctgggggaggcctggggtcctgcccaactcagccatggcagggtgtgacctaggggaggggcctcctcacctgcagacttcagtcttcacctgggcagtgaatatgggtgctgagaaaagcccagagtggccaatgcagaggatgtttattgagcacctactgtgtgcctgactatgccggtcccatgactaagtgccagttgtccacaccacggtggccacctccttcctccttctccctcttctgttgctgctttccccccttcaccttttcctccccccacct

SEQ ID NO: 143987 - DNA, 239 bp, Homo sapiens
cttctttcaaagatttccaaccagttacactgttttctgctctccattcattccccttcagaggtacctggtatcacaaggtcccatgtctttccagggttttgcaaagtgaatccactgactccttgttgttcttacccctcccatacctatctttgctctacagatatttagctttcacctatctctgatataagtcagttaccactcatccatctgctttctaacttacaaaactg

SEQ ID NO: 143988 - DNA, 876 bp, Homo sapiens
aagtgtcctggaggggagtgcaggatggccgactagatgcaacaaggtggcacagctcctaccgagggacaagacaactggtataatccaaacagatcttctgagagaaggtaccgagagtgaacagagggaaagacacagaagctaggctggagggacagaaagctgggaaccctacatgaggctgcagcatacccggactcgttcctggcccacaatagccccaggagaatgggtgagttgaactggcaaggagcaacctgttctcatcatgggtctctggaaccccggcaggaggagatgcctcaaccaccacagacactcgagttggcagcgagagctgcttagagaagtggtaggggcagcaagccagctcatgtggagcctagagggtttggtgcaagagtgtctgtagtggagcatggccaagaatagccatccccctaggctcaacgtgcttccataggagactttagccctaggggtcctgaactctgcagggttgtcttgcccatcagacagggccagaccaacatgagcaccccttggtcagctgccctcttccagcctggccacgcctccttgcagggcaacctcaggtgccctgggggcatgtaccatagcttctacactggcagacagtgccttaccagggaagagcttgagtagggcagcccctgtgaccatgcactatctcacagtctccctccccatactgcagcttcctctgggcccacagcagctccccacattgctttgctggtggtgtctgcacaggcgggttttgctttccttgccacaacagcacacctgagtacagtgttccccctgccaaccaggtttcagatggacactttgcatccagagtgagacagc

SEQ ID NO: 143989 - DNA, 742 bp, Homo sapiens
atgctttctccttgaagaaaatttttctatttcattattctattacattaacttatattgagtcctccatcattgaagtcctaccacatttatgtttagtacattataaaagtaactacttgacaaaataactcgagagtcacaaaattaaagcattacgagaatgggtttcgtagttctgcagactttgccataaaaatcagtattgccactttcttgatgtgtgattgcagatgaattgcttaacttctctctgtcccaatttcttcaacagaaaattggggtagtaattgtacatgctttgtggctttttgacaagacctaggcatacttcctgtcacataatgggagcttattaaccattcaccaccagaatattactaagggaccttggacgtcggcatgtctatgttactatcagcatgaccttgaaaaagttacttatttttgagaatcaacatcgttaattctaaattgaagataaaattatatatttttttatttggctcataaaagttttgttagaattagttcattgaaccccaccattattatcattgccctgtatattatttttaattataataatttgttaaatctgttgcgttaaagtagggcacaagatggaaaaagatgaagtctttatatataaattttcacatgccattctctcaaacacaggtttgaaaaataagtaacaggtgcttagtaaagtattagtgatcaggaaataatagaccaa

SEQ ID NO: 143990 - DNA, 277 bp, Homo sapiens
tgagatggagtttcgctcttgttgcccaggctggagcgtagtgatgcaatgtcggctcatcgcaacctccacctccccggatcaagcaattctcctgcctcagcctcctgagtagctgggattacaggcatgcgtcaccatgccctgtaacacagtttttaacaaaattatcttaaatcccttttgtttatgattctgaggttgttaaacttatggaagatttgtagtttgatttaaaaggactatcagctaagagtcagaaattcagctgaatttt

SEQ ID NO: 143991 - DNA, 433 bp, Homo sapiens
cattactaatttttccctctttactagagcatttcctgtgagcatacaaccctgctttagagaattcatcttagaaaatcctccgtccccacatacatgtccccctcttactccatttctgcttcccatcccaacaaaacttcttgaaagtgctgattagcccctcattctctcagccattctgttgggctttcatcctcactggtctacgggaatgactgttaagattacctgaaccagcggggcgtggtggctcatgcctataatcgcagcactttaggaggccgaagtgggcgaatcccctgaggtcaggagtttgagaccagcctggccaacatggcataacctcctctctactaaaaatacaaaaattaactgggtgtagtggtgggcgcctgtaatcccagtaactcaggaggctgaggcaggagaa

SEQ ID NO: 143992 - DNA, 115 bp, Homo sapiens
tgctgggatttcaggcatgagccaccgagcctggctagccttgtagtgttttcctctttcatgtgtacatcttaattaatattcagcagaagcctgaactcagtgttgcctaaag

SEQ ID NO: 143993 - DNA, 270 bp, Homo sapiens
atatgtgttcgatggttgatggaatattattggcttgtgttaggtcttggagggtatgaaaatagagaagatagaatccctgccctgtctgggaaggagacagacagataataatagacaccatacaatttgtcagactttgcaatgcttgtaagtacagcttctctaaaggagaacaaaaggaaggttgaacttctgagcaccttagtgataaaacagacctacattagcttcttctctgattcattaattttactggtaagaaataat

SEQ ID NO: 143994 - DNA, 415 bp, Homo sapiens
ggctgccacctcctcctcctccattaccttttgataggtctgattaccttcattttacagatgactctgggtcactcttcatcttttgtagaaatacctctgtagcaaatgtcatggggacattctcatctttggtagcagggagctcactgcctcctaggtatgttgttccattttggaatagcttcatgtgaatcttagcatgtgccaaggtggatgtggagtctttgcatcagaatcctgaactgctcatcctgaaaaaatgatgcgatcagcctgcttcccacagcgtatgctcagggtgacttcttgtgacatggagatggttggcagtgagctttctcttgtgacttcacacagggacaagtctgtggcattttaaggactagtgagagttcaggatggaggtgaagga

SEQ ID NO: 143995 - DNA, 216 bp, Homo sapiens
cactcctcactacttcctcagttaccatcctggtctagacttaggtcacagaacagctctgattggtgttgaatggcaggaatgccaaggctgccttttcctgggcctaagggatgtctggaggcctcaagcctccccaagtctcacagtcagattccacgacttcagattcatctttatgctgttagaattgccatctctatttaatcctcttca

SEQ ID NO: 143996 - DNA, 192 bp, Homo sapiens
ttctgacctaaggccctcatcaagtcacaaacgcctcccaagttaatttcctgccaccagtttctccttactgcagttcatcctccactctgctgccagaatcatcagaactaaagccgtgcgtggtgtttgcctgcttaaaaacatctcttggctctctgttgtctacaggaagaaatccaaactccttaa

SEQ ID NO: 143997 - DNA, 339 bp, Homo sapiens
tttgaggttaggattttcaggtcatctgggagaacttaaattcttccttctgctattacaattcttctcactcagttgcctgcctcttttttttttttaatttacttgtgactgagttgaagcccagcattttactttccttaatgatctgactttcataagttgataagtcatgaaatcattatcttacattatatgagatatgagataaatcataaatcatatgaaattgataactcatatgaaaaccaaccccaccatatgttcactgtctacttgtgtccatcttcgtcccacgcaccccacaaggaccttccccgccatgtgcctcaaacatca

SEQ ID NO: 143998 - DNA, 549 bp, Homo sapiens
gccattccacaatagcagttaaggttccttagagcaatcttagtgcactaaggaaccttactgcttctttgttatgtaatgcaacagtctaaagacatatttattttttgctaagatttagtgcaacagaaacagttatgcagacggattttgctgttttaaactttagcatctttcctcagcatatagatcaaaagaaatatgtagaacttggatatgtatgtcttgttaatgaaaacaacatgtgcaacagaaaagccttctcaaagtctcaagtgtgggcaaacaacagcaggagagtctagaacactgcaggacaccagaaaaactcatttccaacaaagaatagtaaatagttttcacaaatgagacttgttcatgtggtgatggcttttaaaagtctggttccatcaaagcatagccatggaagaagctgtgtaatttttcattacaggagaattctacttgaagcccaggaggcgggggttgcagtgagccgagattgcgccactgcactccagcctggcgtcagagcgagactccatctca

SEQ ID NO: 143999 - DNA, 387 bp, Homo sapiens
gccattccacaatagcagttaaggttccttagagcaatcttagtgcactaaggaaccttactgcttctttgttatgtaatgcaacagtctaaagacatatttattttttgctaagatttagtgcaacagaaacagttatgcagacggattttgctgttttaaactttagcatctttcctcagcatatagatcaaaagaaatatgtagaacttggatatgtatgtcttgttaatgaaaacaacatgtgcaacagaaaagccttctcaaagtctcaagtgtgggcaaacaacagcaggagaatggtgtgaacccaggaggcgggggttgcagtgagccgagattgcgccactgcactccagcctggcgtcagagcgagactccatctca

SEQ ID NO: 144000 - DNA, 293 bp, Homo sapiens
aatcaataaacaaagtagttataaggaaagcctccaggccacttcattcagatcagagccactttagctgctcagggacaagctgacaactctcccttccatgaagggtaccatgaggacaaccaaaaagcaggctcaggctgtacatggttggccatgccaggctctaccaaatctctgcggagtctagtctacaaagcagctgagcagcaggagaggtccacgcccaactcatgagtaaagagggcacacactccaggcctgggacaaagggccgagtggtctcaggcagc

SEQ ID NO: 144001 - DNA, 645 bp, Homo sapiens
gaaatgatttgatatctgagacttaaagtattccacacttacaaaaaaaaaagtgtgggggacatgaagacagaaaagaaacaatgttgataattgttgaagctagatgatggatacatgagggttcattatgctgttctctacttgcactataaatgtttgaaatttttaataataaaaaagctttttaagtaaaattatacttctatattaaaatatcagaataaaagggttttgtggtgattaaaattgtgtttttcatatttgggaggaaggaaggaatactgagcaacttttgaatttgttagatcaatttgtaggtagtgtataaaagctaaccattaaaagattagaaatataatctgtatcttcaaaattattatggggggaaaattaatatagaaaagtttgtcaaccaacaaaaggctaggaaagaagggtaaaaaagaaataagaaaagataataaatagaaaaccaaaatggtatggtagagtgaaatccaaatttgtcaacattataataaattttactaaattaacattaaaagacattttcacatgacaaggagcacataaaccaactacatgcactttataagaaatacagcataacaaaatcacaaagaaatgatgaaaataaaagaa

SEQ ID NO: 144002 - DNA, 557 bp, Homo sapiens
acaccatggaaagaaaaaaggcacagagtctgactttatcttttggccctgagcctagggccatcctgccctattgtaataggaaaggacagtctcaacagcagagtcaccagcactccctcagcttcacagcaatgcagtaaagcccccggtggcctgttccctggggcgcattgtcacatacactggcagaagctttgaaatgagaagtgctacatttaaaacattaaaaatttaaatatttcagttacgaccatgtaacgagagagacttaaggttccaagaggcagaatcatgatgtttttaactgtgcttactagacttaaatgtgttcctagataaggcggcctcagcacttccatcaggtttccagctatgcctgggaggactcccgctcccatcaccttctggcagagttgaagaatcctttcccaaatatctaaagaaattgggtaaatatcagcaaagcaaggttcttctcgtggggaggtgagtagaccgacggtgcccgtttgcacaatgtgctccgtgctccagctcagtgcccagcgccactc

SEQ ID NO: 144003 - DNA, 443 bp, Homo sapiens
gccttctccctctccctagtggctcacattctccaagcaccaacagctgatgtccccatgagcagatactggtcttatccccaggggctcctcctccaaacactgtttgatgtttactgtcctgacacagttttgtatagattccttatccaaaagaaaataggctggacgcagtggctcatgcctgcaatcccagcactttgggaggctgaggtgggtggatcacaaggtcaggagttcgagaccagcctggccaacatggtgaaaccccgtgtctactaaaaatacaaaacttagctgagggtggtggcaggcacctgtaatcccggctactcaggaggctgaggcaggagaattgcttgaacctgggaggcagaggttgcaatgagccgagattgcgccagtgcactccagcctggcagcaaaactccgtctcaagaaaa

SEQ ID NO: 144004 - DNA, 539 bp, Homo sapiens
tgtctacgtattgtctatgattgcttttgcaatacaacagcagaattgagtagtggtgacacagtgcgaagcctgatatatttactatctggcctttcaaagaaaaagtctgcaaatccctgatctagaggaggaaggacatgtcaattgacaactactggtgtgtggttgaaaaaggcccttttagcaaacagaggagaaaggacttcagtttgtccagggagggcagggaaggctgctaggaggtggtaacttttgagctgagtcttgaagcatgaatttgtcaggtagacagtgaaacagcatgtgcaaaggcacggaggcaggagagagcttgggacgttccaggcttgggataagtgcaggcagggttaaacccaggacaagtgggagctgagccctcagaggtcatcaggggcccaaacttggcaaatcttgaaaaccttggaaaccaggccaagatcataaattctctgctgagggtcacggggagccatggaggagtttaaagcagggaagtggcagtgtctaatttggct

SEQ ID NO: 144005 - DNA, 471 bp, Homo sapiens
aaaaaaaaaaaaaaagaaaggcatgaatcatttgttactgcttcaaagacaagcagtgtttatttctctaagtgatcactatctcttatctcatcacaagatacagaaaaaccatgtgctagaaaaccagagataaaaactgcccttgtgttgcttaagtctaacactgaatgtgactgccctgacttctgggtcctatgactgcaaggcttcaacttagactccatttatcaatttttaaagacctttcagtctcatttgtttccgaaattaaaggaaaaaacaacaacaacaaataacgttttcttctgtcaggatacaccaaccctccatgacccatttgagtgctttcctgaagtttcaggtgagtcaataaacacactaaggacaaaggaacacaccagcaagtgtacgtatttccttgtcatgctcctgtcacaccgcaggccacaggctgcagtctccatgctc

SEQ ID NO: 144006 - DNA, 133 bp, Homo sapiens
gcttaagtggtaaaatattacaaagatagttgaatcctctaccctagcacatttcttacccttgtgtctgcaggaagccattatgaatttgtggtttatcatttcaagctactgcatgtgaacttggcattat

SEQ ID NO: 144007 - DNA, 384 bp, Homo sapiens
agtaacaggaagatcacaggagcttgaggtggagggacaaggaggttgcacctaacctgtttctgaaaggaagaaggtcggggtgtggagagtggttggtctgagctcagcatgggcaccagacccagcatcctgctcttgagaccaagcccccattgactgtcagcaaggagcttgaggctggatggcctctgggtggaaggcagcccaactgcaggccacccctcagatggatcagaagcatcttctgcttcttcaagaatgagaacaaggaaatggtgggctgttgggggtgctcagtggagaagccagcagctgtccattagtggggtggagtcagtgtggagtgtgttaaggacaggggcacccctggtgtggtggtaa

SEQ ID NO: 144008 - DNA, 323 bp, Homo sapiens
cttcctaccccttttgactgggaaggaagagggcaggtgcagaaagggtcagggagtagggagacagggaaagtggatgaccacctcactccctccttgttcttcaaaaccaagttcacacttgagcatggcacaggccttcctgccatgcctggctcaccttcctaaccccatgctttgcacatgctgggtcctctgcctggatgcagaaggctggggaattctccttcaatgttcggctcccactgcgcctgcgcctccggtgaagtcttccccaggacccccacgcagagtccagtgccacctccctctagcccccgtct

SEQ ID NO: 144009 - DNA, 141 bp, Homo sapiens
tgtccctaagctctttgtgttgcatgtaactcaaacagtggctgacttgggacagttcacaggctttctctggtatgctggtattaaggggtttggtacccaattatactcataggagtgagactggtttgtcttacatct

SEQ ID NO: 144010 - DNA, 318 bp, Homo sapiens
ggaagggtgtgagtaagaacatactatagtttattttcaagataaagatgctgtcatcttgccaagactcagatccaagtatctcaacaattcccctagacaaaatcatctcccctcccccaaaccttcagctcatgctgagcccagtactgcggcaagaggcgttttagaactcctttcaggcatcgacacctcctttgaacaagagacttggtagtcatcccgtgtacatttggccaaaacttccttggccacgagactctaggtgatgtgtgaagctgggcagtctgtggtgtggagagcagcagggaaagcaca

SEQ ID NO: 144011 - DNA, 401 bp, Homo sapiens
gtgctcttcatagagaggtagaatctctgaggacaaagactcatgtgggacatgccagctttgagatgtcaagtggactgtggattacacatggctgagcctcagaagaggggttggggctgcaggttcagaggcgaggcggttgctgaaactacaggagtggctgaaattgcccagcagatgtacagagggggagaaccagggctccttcaacagtctcagctgtttccttccacctgcaaagctgggagccttccaactaggaagtgccaaggtcagcgcaagcttgcaggcctggggacttgggaaatgcgtctggctgcacccgggacctggctgaagggctgggccatggagtctccagcggttaggcaaccacagctgactagaccagtgatgcc

SEQ ID NO: 144012 - DNA, 606 bp, Homo sapiens
aggggcttcaagccaggaccccggcctgagggagcctccgggcaggaggaagaggcccaggaagccatcgctccgctccttcccagctgtttatgtggtactcagggtactcggccaagggcacggcgaccccgcaacaccccaggcgtggggcaaagacagcggggttgcggggctcctgtctgcccggggcgtcgagagttcctgccgccccctcccgcctcatgcacggaaagcgccgagccacggcgtgcggcgccggccgagcgtgaaccggagtcggggttcggctaccccgagcggctctgtgggccgcggatcgcttcccctggggcggccacgcagggttgcgggccatggcctggggcgcccgtccggaccccgccgctgcgcgggacgccgctcccagcctcgaccaagggcgcccgggggcggcggcggcggcggcggcggtgactgcccggggcggcggcgcggcgcgggggcggccaggaggcgaggaggccgggccgcggccgagggcccagggcgcgcttccggcgggcgtcgcgcgcgccgcggtaaatgggaggctcggccgacaggggcgggggccgcgcagccggg

SEQ ID NO: 144013 - DNA, 208 bp, Homo sapiens
tctgactacaatccttcctgatacatggaccacatatatttgtgacacctccatggtaagatcagagaggaggctcagtgtatagctagagaatgagcttggaggtagatggagaggggggtatgatgtgggtggaaacaagggccactggaggcattaatccttgaggcaacaagctccacaagggcagcagctgggcccttctcct

SEQ ID NO: 144014 - DNA, 772 bp, Homo sapiens
agcgggtgggctggttatcaggttcgtcaatattttattttactaaatactccctgctcttttgggagttggcaaacaacagcctgcaagccaaatctggcccatcaccctgcttttgtaaataaagttttattggaacaaggccatgttcactcattctcatatccatggctgcttttgcaacaggttgagtagttgcaacagagaccttacggctggcaaagcctgaaattttctaccaaaaaatttacagaaaaagtttgctgacctctactctagaagatcagttgataaaatacaacaacgttttcatgcccatcattatttttcctatttcaatgaatagcatggaaaccaaggtgaagtaattgaactgaagggatttctgaatgaaggattcatgtgttcatatgtttagacaaaattactcattagactagtttttagggagtaatttgctgctgttaaactacctcttcatatgaataattttttaaaagagcagacacatatatacttaaataggaaataattttgaatttaataacttcatgttcatttttaaaattgtggcaaaatatgcacaatataaaatttgccattttagccacttttaagcattaagttcattggcattaagtatatttgcattgttatgcaaacatcaccaccatctgtttctagagctttttcattctgctatattgaaacccattaaacaataactctccatcctcccgttcccccactgtcctacattctgtctttatga

SEQ ID NO: 144015 - DNA, 367 bp, Homo sapiens
tgtaaataaagctttactggaacacagctacatccatttgtttacatgttgtctgtaactgttttcatgctaccacagcataattaagttgttgcaacagagaatatatggccctcaaactttacagtattcaccatctgtccttttacagagaaagctagtcagccctgctctagatcagcagttctcatagttacgttctcagaccagcagctttgcaaccactgcacatttccaggcttcaccgtagacctattcaatgaggaattctgggtgtagggcccagcattctgtgttaataagctcctcgggtgattctgaaaattaaagtttgaaaagcaccatctagatttctggcctggtggct

SEQ ID NO: 144016 - DNA, 316 bp, Homo sapiens
tatccactctcgctactgtatcctagggaagagactgaactttgaagaagacggtgccctgtgaggagccaaggcagctctgggtaagcgtctggtctttgccagcttacctgcgcagggaacctctatcctcatatcttactggtggagtggcaggctggaggctcctctgattggtgagatttggaggtgaggtaagctttcagatgctccctgaacatcacttgtagaatgtgcagagagtcttatgggaatggctgggaaggcaagctcactgggagatgagcagcccagcctgtaggatacagtagggaga

SEQ ID NO: 144017 - DNA, 299 bp, Homo sapiens
aatgataaaaatgaatggctgaggagatatacaatacttgtttgtttttcactaattagagctagattttgattatttatttagagacagcagtctctctctgtcacccaggctggagtgcagtggtgtgatcataactcattgtaacctcgaattcctagggtcaagcaatcctttttcctcatccctctcaagtagctggaactacaggtgtgtgccaccatgcctagctagtttttaaattttttgtagagacagggtctcgctatgttgcccaggctggtgtcaaactctgggtc

SEQ ID NO: 144018 - DNA, 633 bp, Homo sapiens
tcgcgtgtacggcccgacgtctgggatatcagtgaacaaggcgctcgagaaaatcggagtcgctaacaagttcccagctgatgctgatgctactggcctggaacaccacattaagaaccattcataggtagtattttttttaaaacatcgttgtgttgtgcttaacattgattgataaaggaatgtgcttttaacatctccttaaaaggtcccttagatttcctctagataaaagaattagtaatttcatctgcaacacatacaattttttttaattttataaaatttagttaaatgtttgttttacactgactatggaaacagcactattttagatacagaaagaaatcaataaacatagcctgtgttcacaattcactcatccttttgttataaaaagacttgaaattagggttatgttttaacatgaaaacaaaatttagccttagcttttatccatcttaactttagaaattatatttatgcattgtttatagatcattgtcattcgttgttgcttaagtgttcatctgattttatatttatgatgttaaaaatagactgctgaccaataaataataaaatatttacactccattctatttccctgtattcacatcctattaatgaaaa

SEQ ID NO: 144019 - DNA, 368 bp, Homo sapiens
agaaggagggaaaagggcaggagggaggtagggattgataaacccagtgtgatgaaatcaaacattaagggaatccaggtgaaaggaatataggacttctttgtattattctgtagcttttctatatatctaaaattactccaaaatcaaaattacacaaatataaacaagaatttgaagatatctatgtgacatggtttggatttttgtccctgctcaaatctcatgtcaaactataatccccagtgttggaggaggggcctggtgggaggtgactggatcatgggggtgggcttcgcccttgctgttcttatgatagtgagtgagttgtcacgagatctggttgtttaaaagtgtgtaacacctcc

SEQ ID NO: 144020 - DNA, 252 bp, Homo sapiens
cagcagtagattcagggtatgcatttttgcaggagcactaataagtgacgatgggtcattatcagggcatcacagcagggggcacgtgttgtcagtctcttctgttgttggtgatgttaactttcatctcctaagatagtttctatcagatttttccacctgtaaatgtgcctttttcctgtggtggagatagctttgagtctgtatgaatatccagtttcccaacaaactgttatctaatgatagcatcct

SEQ ID NO: 144021 - DNA, 380 bp, Homo sapiens
agcccccattgcgtcccgccagtccacactctaacccccacttagactttaatctttcccagaccaatcacagaattcccaggggccccctcaccttcatgttgggaacccttagtagagtggtacaccccgtcatcaggtccacccctgccttctccccacataggtacattttgcagtgagggcctggctgtgggggtcccctggccttgaatgcagtcactggtgtctgcgccctatccacctccctcaacgcaccgattcccaggcccaaggctcagggcctctaggctctccaaggcattctcagggtgtgggccaccacagtcctggagggtgaccccagaacctaggccaggcgggaggccagggggcttggc

SEQ ID NO: 144022 - DNA, 315 bp, Homo sapiens
agtgactacaccatagtcaacagtggtttgggctccttgcccctgaggtagaacaactctggaccaggtgctatttgagccaatttctcttacggaaatttttgcaggaaaaaatgtaatgcctgtaataacagattagactagttcacgcataggaccctagaatgttacagaggatggagcttagagattattcagtcaaaaaccttcattttgtctttgagtaaattagaatgctctgagggaaagtgagagctaccttagatcagtatcagaatcttctacaaaaaattagctgggcacggtggcacgcac

SEQ ID NO: 144023 - DNA, 112 bp, Homo sapiens
ttctccaggccccacgtttgcactcacgcatccatattttggcaaagtttggaccagagtacaaaggcagtttgtcatattcttctttacactaaactatttatttatttat

SEQ ID NO: 144024 - DNA, 373 bp, Homo sapiens
aaaaattatctcagaattctttatcaaagctaatcagtcatcaagtatttcacagcaattatctatgcccaaccactgttagattcacgagtttaagaggtcatcgttgcttacttcataattgggaaggtaagatcatggagcctcctccctagaaaggaaccaaaagggaaatcatcactgcaaatggtaaaaatcatattgtttttatcagactgtagaaaagtctaattgcagcaattgttaaattactgttcagaaatcattacaaacaagtgtgaggtggtgtggtaggaagagaaagagggacagtgtggaactgtgggaatatccctagtctgggagttgacagacatgcattttaagcacctct

SEQ ID NO: 144025 - DNA, 453 bp, Homo sapiens
agtaccagccttacccttactgtatgttcaatgttctgggtttgactctagcacccttttggctttctgtttcttgttgtttgctttcttttcctgtaggaagaagaagacagagctcttaccagggggaggcagagatggcacagcaagagacatgcccccagaatgccaccaatgccccaggacaggcccacccatgggaccaggttatcaggggccctgtggggatggggtggaatctgaagggtgagccttcatccccaggctgggagtgggtgagacgagactggggcctgtatgtctgagtgccccccaaacccagcagtcatgttgcgaggaaacgaaatcacgttacttcttccagctgatgttccacttgtttcttctgttgtttctgtggggagagtcaaataaggtgatggagggtggccccctcaactctattccccagac

SEQ ID NO: 144026 - DNA, 593 bp, Homo sapiens
gcttgtgactagctcttgatggaaggaggtggcttctagctgggctgtgccaccccaggctgtggagttccaggtgaacctggtcctgacaggagtcagggccttgggtctcaggtaaggttgtggcgtggacttgctgaatcctatcactgtccctgttgagcagccatactgggccgtgtggcccacggtggtctatggttcagatgggtggtcctgagagcagggtctacacagcatctgactcactatgtggcctgggcaagtccctgggcatctctgtgcctcagcttcccagctgtacaatgaggtggggtaagattagatcagtattttttctttcttcttcttttttatttcttaggagacggggtctcggccaggcacagtagctcacgcctgtaatcccagcactttgggatgctggggtgggaagatcacttgaggtcaggtgtccgagaccagcccggccaacatggtgaaacctcacttctactaaaaatacaaaaaattagctgggtgtggtggtgcatgcctgaagtcccagctactcgggaggctaaggcatgagaattgcttgaactcaggaggcg

SEQ ID NO: 144027 - DNA, 423 bp, Homo sapiens
tgacaacgtgtgtaactgctgctccacaggacagacatttgtcttctgacaataaagaaagaaacatatacctagagagccaggtattccttgagaaaggtgttcatactcatcaccttttagaaatccccctccaagtttctgacaatccatctatctctaaactagaaacatttgtgggtttggagcctgcagcctgcctggccttacctctgactactcagctcccttgaagaggatcagccagcctactcctgagagtactgccaaataccacaccctgggtctgtgtatccaaaggtacaggaagtggtctgtccaatgcctgggtgattgcatcattccaacaagcttcaatgtacaaagtttgagtcactctccactctccacatagctcttcaacccaaatctccttccagccta

SEQ ID NO: 144028 - DNA, 331 bp, Homo sapiens
ggggcttccggcaagctgctccccagtcagtcccatgaggctgctggcctggttcccatggccccacttgctttctggggctccaggtctcctagacaggctccaggaaaagcatttccctcttcgttgcttcttgggattccccgtgggtgcttgttggttctcgagagagatggcgatcagtcaggagttgtgggtgagaagcagtcatggcatctccaggacagggttgagttggggtcagggggtgagggcctaaggatgtgactccctgtctcagtttcttgaggcccaggactcaaagtccccacctcaggggactcttagacca

SEQ ID NO: 144029 - DNA, 603 bp, Homo sapiens
ggtcacgaatggaataatatattacctgttcttatgttgaaaagttatcaaaaataaactttcagcagcaaccacaatttacataaattcgaatacaaattaagacaaaaaattggggtaggctcatcctccattctcactttgtttatagtgagacctgtgatagtcacatttgaaattaatcttaaagtctttagttagagatagtttcctacctttaatcattgttactaaactgtttaaaaactgggagggaaaattgaaaagtctgccacactggacatttctttgtttcaaaaattgagtgttttataggcgtctgggtactctgggaggattccaagctgcttgtcatgttgatactctcaaacctgtacttgagtcagggagacagccataactacatacaataaaagcataaagggggaattagaactaggggagagtattgacaggtgggactcacctaattcaaggctaccagtaggtatttgtatgctgtgtacctttctagtctttttagtaacagggttaagaggtagaaaacaacctctaagtaaagagattgagattaatttgaaatgtaaagagagcagcagtttt

SEQ ID NO: 144030 - DNA, 510 bp, Homo sapiens
ccactcctcttcagaaagctatccttatgaaatgggagtgcacttacagaatggtgaacaccttgcttttgggtgaaatacatgctatttcttgacatcacctaggtaccttctgcaccagcctgggtagatcaatatttctttttgcgtgacacgctgatattgctgctagatagctttcctttggaagcaaaattcccaggcagtgccctagagctggagcaacattagcaacgtaaactttctctgcgatgacaagcagagaggcctgcctccatcaaccgacatgcactgtgacagctcccagcggcaggtagattaatctgaataatgtcagaatgacttttctcctcccttgtaaagaggttcagtgttgcgggctgccaaggagcagacacattttattttaaatttaaggatttttaaaaatggaggacactttacctctgaattaaatgctcagttcctgagttattgctggacatgaagaggaggcagcagccatcccat

SEQ ID NO: 144031 - DNA, 498 bp, Homo sapiens
ggcattgatatggtttgtctgcgtctcatctaaatctcatcttgaattgtaattcccacatgtctagggagagactggtgggaggagactggatcatgggggtgaatgctccgtgatagtgagttctcatgagatctgatggttttataagggactcttccctcttcgctcctaacacttctctagcctgccgccatataagacatgtctcttctcgttctgccatgattgtaagtttcctgaggcctccccagccatgcggaactgtaagtcaattaaacctctttcctttataaagcacccagtctcaggtatttctttatagcagtgacaaaatgcaccaacacagatatgttgctgataaatggaactacagaaagggacaagatcaactggagttaagaagagaatttaaggtggcttatgcctggcaaagcactgtgtttatacatcttttgtgagattatactgccacgcagaacgcgcctaatggggatc

SEQ ID NO: 144032 - DNA, 3543 bp, Homo sapiens
  misc_feature (10)..(10): n is a, c, g, or t
  misc_feature (26)..(26): n is a, c, g, or t
  misc_feature (88)..(88): n is a, c, g, or t
  misc_feature (92)..(92): n is a, c, g, or t
  misc_feature (111)..(111): n is a, c, g, or t
  misc_feature (132)..(133): n is a, c, g, or t
  misc_feature (178)..(178): n is a, c, g, or t
  misc_feature (197)..(197): n is a, c, g, or t
  misc_feature (255)..(255): n is a, c, g, or t
  misc_feature (343)..(343): n is a, c, g, or t
  misc_feature (382)..(382): n is a, c, g, or t
  misc_feature (541)..(541): n is a, c, g, or t
  misc_feature (579)..(579): n is a, c, g, or t
  misc_feature (883)..(883): n is a, c, g, or t
  misc_feature (1149)..(1149): n is a, c, g, or t
  misc_feature (1220)..(1220): n is a, c, g, or t
  misc_feature (1274)..(1274): n is a, c, g, or t
  misc_feature (1451)..(1451): n is a, c, g, or t
  misc_feature (1462)..(1462): n is a, c, g, or t
  misc_feature (2206)..(2206): n is a, c, g, or t
  misc_feature (2294)..(2294): n is a, c, g, or t
  misc_feature (2307)..(2307): n is a, c, g, or t
  misc_feature (2425)..(2425): n is a, c, g, or t
  misc_feature (2817)..(2817): n is a, c, g, or t
  misc_feature (2819)..(2820): n is a, c, g, or t
  misc_feature (2907)..(2907): n is a, c, g, or t
  misc_feature (2927)..(2927): n is a, c, g, or t
  misc_feature (2934)..(2934): n is a, c, g, or t
  misc_feature (2938)..(2938): n is a, c, g, or t
  misc_feature (2990)..(2990): n is a, c, g, or t
  misc_feature (2992)..(2994): n is a, c, g, or t
  misc_feature (3005)..(3005): n is a, c, g, or t
  misc_feature (3145)..(3145): n is a, c, g, or t
  misc_feature (3184)..(3184): n is a, c, g, or t
  misc_feature (3190)..(3190): n is a, c, g, or t
  misc_feature (3229)..(3229): n is a, c, g, or t
  misc_feature (3270)..(3270): n is a, c, g, or t
  misc_feature (3273)..(3273): n is a, c, g, or t
  misc_feature (3286)..(3286): n is a, c, g, or t
  misc_feature (3298)..(3298): n is a, c, g, or t
gggccgcacnggaccagggatgagantgggtgcccgggactcgcctatactgcctgggggtgcagcccgcactcctcactatagtcanatcnactatgcgtgctttccagnggcctgggagaggactccatnnggagggatgcttaccttgtgggctttggaatataagccctttcancttctccgctggtcctcancacgttggcaaggcaggtattgtgaccctgttttctcaggtgaggacatggaggctgngaggggtctagagactggcctggctagtaggaggctgagtcaggatttgaaccagcagatcatctgaccccggagccagtcgtgggcngcacagcgggagctgcaaccgaggctcttgactcctgcntcgtcattccctgaggtccacaggacaaccagttggggacctggggccccatcctgatgccctggggagaggtgctaggccccttttgggtctatgggctacttttgggccagtggagctgggtaaagaccatctcaaaccctgtgccaggggaggtcngactccaagagcgccacctttgggcttccagctgtgtnggctggaccaagaaggctcagagaattagggggttcgtatttgatccttttccttccaagactgggattaccagataaaacacagggcatccagttacatttgaatttcaggtaacaatttttttaagtgtaagtatgtagccaatattgcatgagaaatactcatgctaaaaagttattcgtcgtttatctgaaatgcaagttcaaatttaaccgagtaccctgtatttttatttgctaaatctagaaaccctctccaagaggctccttggcccactcacagggagagcccgatctccctctngacaggggaggccccctttctcaggccagaaaagatcttgtagtaaactactcaagaggctgaggcaggaggatcgcttgagcccaggaattcaagacctgcctgggcaacagagcaagaccctgtctctagggaagatatcctaccgtagcctccctcggggactcccattcctcccacctcagggccagtcaagggaacaggcctctgctctgggcagaagtgccggcagccgctctctgaaaagctaggtgttgcctcagggnctcccggtgtcctgtggaaaatgcctggccacggtttccatggttcccaggctccaaccctgcagttctcngccctcattcaggaggggcctcggcagggtggggggtgccgtctttcccttgcnggagccccaaggactctgccggctccctcgctttggcagcagcactgcccaccctgtctctggaggttcccccgcctcaatccacccagctaccccgaaaggcacaatcataggcctttctcgtcttttaagggtttttacttccatggggaactatgtgttggatgagaaaagtanccggggaaggngacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacaccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaacgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacanctctgaagaggcaaagacactcacaatggacatattgacattggctcacacctccacagaagctaagggcctgtcctcagagagcagngcctcttccgacngcccccatccagtcatcaccccgtcacgggcctcagagagcagcgcctcttccgacggcccccatccagtcatcaccccgtcacgggcctcagagagcagcgcctcttccgacggccnccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactnanncaaaaccacacatcactgaggtcacagcctctgccgagaccctgtccacagccggcaccacagagtcagctgcacctgatgccacgnttgggaccccactccccacnaacagcnccanagaaagagaagtgacagcacccggggccacgaccctcagtggagctctggcnannnggaatcccctngaagaaacctcagccctctctgttgagacaccaagttacgtcaaagtctcaggagcagctccggtctccatagaggctgggtcagcagtgggcaaaacaacttcctttgctgggagctctgcttcctcctacagcccctnggaagccgccctcaagaacttcaccccttcagagacacngaccanggacatcgcaaccaaggggcccttccccaccagcagggnccctcttccttctgtccctccgactacaaccaacagcagcnganggacgaacagcancttagccaagancacaacctcagcgaagaccacgatgaagccccttctctattaagaatacaaaaattagctgggtgtggtggcacacacctgtagtcccagctacttgggaggctgaggcaggagaattacttgagcctgggaggcggaggttgcagtgagccaagatcacaccactgcactccagcctgggcaacagagcaagtgtctaaataaaaagaaagaaagaaagaaaggaaggaaggaaggaaggaagg

SEQ ID NO: 144033 - DNA, 487 bp, Homo sapiens
caaactaagaattggactagaatttagaatgtatgctcattggccttttagctatttatagctggagtcccacagataccaaatgtcatgaatggaaatccacatgcccatcattgacaatctaaacagaacttgtttgattaagaataaaggaggaggaaaacaacaaaggaaactatatttcagaatatgggaacgtgattactatcccaagaatataaaaaagtatttttatactatctgacataatcaaaagaatatgaattacatgaaacaagagccagaaggtacaaggatgaattaagaagcttgttaggcgagttaaagacatttcaagaaattgaaaatataggagtattagagtctttattgaaatcagtgaaggaattgacaatgtctgtcatcgaattagagtttaaatatcagatgctgtctcagaactcataagaaaaatcaatgataaagagatgatagctctaaaatggta

SEQ ID NO: 144034 - DNA, 692 bp, Homo sapiens
attgagctgttctgtaaggcaagtgtcaagaatttaggaagttccatttaatttagcctttgtgaaaaaattctactttttgtatgaattgtgtgccccacccccactcccaaatattagctccacaaaggcagaatttttatctcttctatttgttggtgtgttctgagtgtcctccacagtgtctggctcaaagctgcttaaagatgcttcctttatggaaagaatgaactgtaataatttatatcacccccccatatagaagacataaccttctcttatacccccaaattcacaaaaatagatatgaaaggattttctttaaaagtactaagaacttgaataatttatgtagtcttctgtgttatattggaatagcctccttgttgttaatacagacactttttttaaaaaaaagataaataacttttcagtttgtacctgttacgtttaaactttatttttaaactgcttttataacctgagcaattgtttttattttgggagagaccttttccaagtagaaaaccattttaagatttaccagcgcagcactaattacttcaatttctgtagtatatttctgcaaattacaaagttcaaattatggctcttgtaaacagggtttcctggtgaccatggaacctgtactttcatttctcccgcctggaaagctttcttaaagtgctagt

SEQ ID NO: 144035 - DNA, 483 bp, Homo sapiens
aatggcaaaaaactttccaaatccattaatggcttattcaaaacagcacataattcagaacctttgccatttcccagctgacaaaaatgccctattaataaaaatatcagaaaccacacatgtatagtttcactttgacttttgaattaatgtctgatctcctgagttttaaattaacaagatttccctgcataacctatacaacttcgtcattcacaactaaatcaagcagctgggttggcttaatcagtttggtttggcagggacgcgtttgtgtagagttttcaccaaatggcatggattttcttccctacagaacagggttgtgcgtgtgacaggcttgtgcttggtgtttctgaagcctcctcattgaagccacctgtgcattatggtgccaactggtgggtgatcctgtgggtctgctgggtgaggtggaggtgtgtagcagcttctgaatgaggtacagagttacttttagggagg

SEQ ID NO: 144036 - DNA, 287 bp, Homo sapiens
atgatttgcccgagcagacattattcacgtggcaatggttatcacactagcaatgacattctacctaagtttctgaccaagttacagtttcataactttatacatcacctcttgcattattgtccggtgtccccagctccccacagtttccttctgctttctcctaaaatcacagtgaactctacttccttttctcattcaccatattcttgtaagtcccttgttagtaatttcccttttcaagtagttgattcatttattttacgcgatgccagctgtgtagttgt

SEQ ID NO: 144037 - DNA, 715 bp, Homo sapiens
ggggcccagtggggacaggcagtgaggggcactagggagaggggggcccagctgtgcgggaccgggggatgccctgggtgtcacgtgtcaagatggcctggcctggtgtcccccaggagccctcccctcccagctcagcagagcgggggccacgcctcactgcagtgggagggggtggaagtcacaggacccagcaggttcagcctcctggtgggggccggcaagttggggcctctctctctgtgaccctgggtgccttctctcctgcccacgggctgagcctcgggtggtggctggaggagggaccagcaagtcccacctccccacacagaaggcactccgccagtcccctcatccacggtcagaaatgtggaagattttgttctgggcagaaattgcccaaaatactcatctgtggtataggggtcggggtgggggccagggctacaccagacagcacccccaaggcagcttggataggtgtcacccaggtcaagaggggcttggcctcatttggacacagtctttggagaaagaaaagagcagccagggtggggggcgtgggtcgcagtgagctgggccagggaccttgaggacaataggaacagagtaggcatgcagtgtccccagactccgatggccaccggggccgggggagagactggagcccaaagtccccccctaggcagccaaagggaagtgaaaggggagcccc

SEQ ID NO: 144038 - DNA, 367 bp, Homo sapiens
taaaagggaaaaaagtactgttacaatggagaaatattgtgaacagcatcttaactgagtgatcaaacctaatattaccttttgtctgtgatgtagtacgtaaagaacacatcactcattagaatccctgccaaaaatatttaacctgaagctaatcaagaggaaatcaccacagaagtcctaattgagatacattctgcaaaactacaggcctatactgggggaaaaatgtcacagaaggtagggagaaaggctagggggactattccaaattgaaggagactgaagaactatgacatctagctatggaatcggggtggggacaggacaaattataaaggacattattgaggtcaactgaggagat

SEQ ID NO: 144039 - DNA, 221 bp, Homo sapiens
ggggttttgccatgttggccaggctgctctcgaactcctgacctcaggtgatccaccagccttggcctcccaaagtgctgggattacaggtgtgagccaccgcacctgaccgggtctcttactttttacttaattcccctttcgcttcagcatgctgttctacccaccccacatatgggtaaattataacagggctaagagcttcagtagcatttctgaga

SEQ ID NO: 144040 - DNA, 693 bp, Homo sapiens
agggctcctgggtaacccacattggttcttggcaaatagtgagaaattcttctcactttggaaaactgggagcacccaaccaagctccaggtgtcctgtccatttccaccacttcccttccaggagtttccttgcattcccacttgtggggtgtaatcctgcccatggtggaaacgtcacacctcctttcccctcctcagcctggcccttccccagcagccaggactctactctcactatggagacgtcctcctttcctgagctctctgcttctgtgcccacatccccggcgccatggctttttcaccttctgaagccatgattgcccttaactctttttcttttctttctttctttttttttttttttttgagacggaatcttgctctgtctcccaggctggagtgcagtggcgtgatctcggctcactgcaacctctacctcctggtttcaagcgatcctcttgcctcagcctcccaaggaactggaattacaggtgcccgccaccatgcccggctaatttttgcatttttagtagaaacggggttttgccatgttggacaggctggtctcaaagtcctgacctcaagtgatctgcctgccttggcctcccaaagtgctgggatgacaggcatgagcccccgcgcccggctacctgaacctcttttgacaagtgctgatatgaaggcccca

SEQ ID NO: 144041 - DNA, 415 bp, Homo sapiens
acagttaaccacagtgtctcacagggtcctggagagatagctcttggcaccctctgccactgttcaaataccagtgtatgtcattgagagaccatggctttgaccagcaaaagttcaacttttctctgtggtatacctcagtttttcttctttaaccacaaatgtacttgtgcttttaggtaggtcctttggaagtagcacttacggtttgcagagtagcatttttggtttaccagccgttatcttccatattcttatggagagttttagttgctgttgtgctcacatttgctcatggccttggaaggatgtcgcatggaagtctcccagatggatctctgaccacttgtcaaatgcagagaaggtttgccgcaggatctcttccacatgttcgttattctgtagggtttgttat

SEQ ID NO: 144042 - DNA, 364 bp, Homo sapiens
ccacaagtccaaaaacagccagttgtctgctgccagccagaactttggggagaaacacagcttaatctctctccaatccaaagaatatggagctagtaaattcaactatcagttgaatttgcttgcacctcagagccccagtaacaccaggaacacagtgggtggctttcaggaacctgaaaaactggaccctgttgagccacatcagcaggacacagtggtgctcaaggtggcagcagagaagccaggcagagctttatcagaccccagggaaaaaaaggctgggatggagaacagaccccagatctacccactaatgcctcagatgtctggcccagtgactgctgccagggccacaggctca

SEQ ID NO: 144043 - DNA, 365 bp, Homo sapiens
ctgtggtgtgtggaatagattggaagaggagcaagactgaaggcagggagaccgggtgctacaatgatccacgtaaggaagagatcatggtggggcacggtgactcatgcctgtaatctcagcactttgggaggctgaggtggttggatcactctaagtcaggagtttgagaccagcttggccaacatggtgaaactccatctccactaaaaatataaaaatgaatcggagtggtggcgcacaccagtaatccagctactcgggtggctgaggcacaagaatcggttgaaactgggagatggaggttgcggagaggcgagatcgtgccactgcactccagcctgggtgacagagtgagactgtct

SEQ ID NO: 144044 - DNA, 854 bp, Homo sapiens
gataaatcaaaagataattgttcttgaattgggaagctttttaaaaaatcacattcaatctaagaaaaatgattataaatgtgctagttaaaaaaatgtttagcgtgcttctcagggcttttcatctagatcaggaaaattaggattatccgtgtcacttgggcattagagtgaagtttccctgcttttcatctagatcaggaaaattaggattatccgtgtcacttgggcattagaatgaagttttcctgagaactgcagtcaggtttttggcatggctggccttctgttggtcatatgttaggcatggaatggaagatggctcgatgtttgctgcggctgtccatgcccctctacgccatccacaagcctctgaccgagttatccgtgcatgcatttgagcgtttcttgcaggagaggccggggccaaaggaacgcttcagttgcgctgggctgtgccaaggggcctcagcaggagcaacccttgggggccagagcccaggctcttccagcaacaggaaggacctttcttccctctgcagcacctgtcgaacaaaacatgctggactccctcattcattcccggcagagaagcactcccctcaccccccacagagccctgctatgccgggcactcagaccagccagaggtgggggagcctgtgagtaaagtggagaattggaggtgtggtgccaccctgaccacagcacctttcttctccctgaggccacctcctcaaatactcttcttggccacagatgagggcccagctgtggttggcagatcttttgggagataactggatgtgtgggggtgggagagttgccatgggtcccagtctcagggcggccgc

SEQ ID NO: 144045 - DNA, 721 bp, Homo sapiens
catagttctttatagcagtgtttgaacagactaatacaatttctcaaccttttctctggaagttctctgtcgggcacaacgtcatcaacattttttgcccaagctatttgtctagcactaggaatggactcagagaaatcctctcatcagtaagttttcatcttagtagtaacattctgccagcaaagtgtagaagatggattcaaacctgagtcatgctttctttagctgcagagtgataaaagcagaaaatccttaaagaggcatgttcactgccattgacagcaactttttttcaagctgtgttattagagtaaggcctgtgtgaattagtgaagaattatgggactttgaaataaatttcatagtttatatactttccaggatatagttataacaggatatcagattgagactctttttgcctcaatttccactgatttctaaatgatggtgattgggataccaagggagtatcagacaggtggccctgcatatgtcagatgcatactttacaagggagaggaaggaaacctgctcctatctcttgggcctttcagcaggattaaaggtacaaaaagtagtcagagagaggactgggaaaaattgatgaaaatatttatttggtcaactgtaagttccatcctgccctttcaggaggggtttggagagtgcatttgctcttagtgctgagcctaatgagggtgctcccccaaagccc

SEQ ID NO: 144046 - DNA, 361 bp, Homo sapiens
taaggacaggaaccatttctgttactctgtctttgacctgaagcttatctaggacaggagatgtaagtagaagctactaaatgctcctgctgctgaaaccagcagagcctgcctggccctggacaaagcctccaggagctgtcagtaactgatatcctacagggtatgggcttagcaagtcagcaccaccgtcggctccccaaactcttcccacttttccatggctgcaccccagaactccaagtatcctctttccttattaacaacttttatggtattattcttattattaaagtaatacattcttattgtagaaaacttggaaaatataaaccaagaagaaatcatcggtaactgccaa

SEQ ID NO: 144047 - DNA, 324 bp, Homo sapiens
ctcacagttctagaggtcattaagtctaaaacaggtcttacaggcctgtttggcatttgcagcagcctggatggagtagattacaaagctacaatcaaagcctgcattccttcagaaggctctagagaagaatctgttctttgtctattccagctcctagaagctgcttatattcctttgcacttggccacatcatcaagatttctgctttcagcatcacatccctttcctggactaattgattccctctgataaggactcttgtgattaccagagcccactcagataatccaggacatcagtagcacaggcaaccgaaaagag

SEQ ID NO: 144048 - DNA, 335 bp, Homo sapiens
attcccttcacctgaaagtacacatgccatgcaagtcttaaacatcaattaaaaacaaagcaccgagttttgtgcagtggcggtatcacagccaatgaggtttacgtgaggtacaattattgttattcgtaagataaaacaaaacaaagtacctatgagctttggcatcttgcaactccttcaaatgtgtcaccatacaaacataaaaatagtggaggctgggcgcagtggctcatgcctgaaatccctgccaggacactggagtgcagtggtgcaatcttggctcactgcaacctccgcctcccaggttcaagcgctcctgcctcggcctccca

SEQ ID NO: 144049 - DNA, 309 bp, Homo sapiens
ataaactttgtgttcattgaaccactattctctgccaattcctgccaaacagaatagtacctttcccaggcttatttgtgtatacatgtgtatgcatgcttgcacgtagcacttattgcacttggtggtcagttcaccccgtggcaaaatgccacactctgaaatcctcattactggataactttgaaatttggactcacatatgggacgaatttccagtccctaatacatgtcctaggagccaaacttcatatgattctcctctgggggagagtcagagagaggatagatagttctgcctataaatag

SEQ ID NO: 144050 - DNA, 322 bp, Homo sapiens
tgtccattgtttttcgagttcttttgttggcctcttacagttttctaatcttcctcgtcatttgactaatatttctccattcctgatgttgttaaatgaccttacctactcctctccttttgggatgcctctaatctgctgaggacttcaaaaccagaaattttaatatcacaagaatgcacctgattggtatatgcccacaatcaaaacccaggcatatgaacaatgccctttacaaaggcttattgatgtaacataattttaatctctgctatttttgtgtcatatataatgtcaaaaattgggcaagtagagggtctgc

SEQ ID NO: 144051 - DNA, 227 bp, Homo sapiens
aatagggatttagggttaaatggatacagagtttcaattctgcaagatgaaaactgttctgaagatgggcggtggtgatggctggacaacaatgtaagtgtacccaattctactgaaactgtacactcgaaaagtttgaagatggcaaatgttatgtgtatatttttaacacatttttctgctttttttttttttttgagggtggagtcttgctctgtagcccaagg

SEQ ID NO: 144052 - DNA, 353 bp, Homo sapiens
tggtgggtgaaccctggcggactgttccacgtccaacctgctctagcttctaatgggcgagtgagcccatctgctgcagcacactgcccattctctgggccctgtccactgaggcggacgagaggtggctgccctacccctcctggctatgtgagctgtccagtgtggaaacgatcactccccacctgcagacaccatcccttggaagggccatctttccactcctcagggacaagaaagccaaagagatagaaagcagcccccagggaacttcgctatagccatcgcaacctggtatgaagaaattaccccgcttgagggcttataatttacaatgcacactacatgtgaag

SEQ ID NO: 144053 - DNA, 432 bp, Homo sapiens
ctacaggcacacaccaccatgcctggctaattttttagttttttgtaaagttggggtcttgctgtgttgcccaggctggtctcaaactcctggcctcaagcaatcctcctgcctcagcttcccaaagtgctgggattacaggcatgagccaccacacctggctcatgtataatattctaaatgtagaagcaaagacctctcttttgagctttctcgttcagaatctagaaaacaaggatttacatgacactttcctgggacttaagcatgtttccaggtgtgggcatagggaggattatccttcccttcccagatggtacctgagatggagggcctgaaggccatcccttccttcaggattcttgtgtggtctcagcctactagtggactgtgaaatcagtaagtgtgtcatatttttctttaatggaacag

SEQ ID NO: 144054 - DNA, 390 bp, Homo sapiens
tgagacagggtcttactctgtcacccgggctggagtgcagtcgtagaatcagatcactacagcctttaactgctgggctcaagcaatcctcctgcctcaccctcctgagtagctagaactacaggtgtgaaccaccttgccctgctgttatatgccagtttcttataaaatactataaatatcagcaaatgtgcaacaaatgtttaatagggaggccaccttagttttcctttctgttgtatgtagtaggagcaaactgcctttctgttgtatgtagtatcagagcaggtctcttctaatattaacctgaacaaaatccatcctatttcaggatgcagttgtctatctaaacataagtagagataaatgaaggatttttttaaattttat

SEQ ID NO: 144055 - DNA, 400 bp, Homo sapiens
taaaaaatgcatcactgatggactatataacatcatggcattaaaatggtaactctcttatttccaacttcaaggtcatgtgaagtatttatgctaaacaaggaggaccatcaaaatctgatggatgacataaatgggaaaaagaaagaacaaggagcaactgatggcatattacttcactaatgccacacatcataaaaactagttctgacacttgtatatggactctgctataaatttacaaatattacaaatgtctaagtctaaatgtgctgatattaaatccaagtctaatggatatcaattataaactcaaaaccatggtttgtcaaaattagggtaatgacttatcacgcaccaaaaacaaaaatgtaacatttcaactacctccacaagactt

SEQ ID NO: 144056 - DNA, 350 bp, Homo sapiens
gacatgttcatgtttatagcagcattatttctaatagcaaaagctggggacaaaaaaataaatttgttttagtatattagtactaaataatactaacagcactaaaataagcgaagtctacaaatatcaacatggatcaacaactaaacaaaatatatgattgaggaaaataatcataaaggagcactatatagaaatgtcaaaatgaggcaaaaataaactacgcattactaaagagcaaatgatcaaaatacataggttttgtttataaatacaaagatattatattaaaagtataaaaagtcaaagaaatattaatgttagatttaaaatagcatgtatttcttagg

SEQ ID NO: 144057 - DNA, 938 bp, Homo sapiens
tgagcagagccctattgggtggtctggcggtgggagccccttagagcatggccaagaagggctcagacacagctgcagcgaggagcagacataggtgcagaggtttcttttacaggacagtcagaggcaggaaggtgaggagaaggggagagctcggaaactcggcactaacccctgcagagcccttgtgattggccttagtttccctaggtgtaaattggggtgacggccagacaagatgtgactgtcccctctggtgccagccccttggagctgtgtgaaaagtccagctcagagaagcatgtcctttccgtctgccttgtgatttccaaagaagggggcaagacagaggcctggcagcggccagcataagagaaaaagtcctgccctgcaaaatatgctttctccgggttcttttggagtcctgctatttctccacttcgtgggtaccgtcctcctaccaggacagctcctggtgcttcctccgcctgggtgtgttttcattgtctgctcaccagcctgactcccacatgagactataaggcccttgagggcaggggctgtatcttgtctgccactgggttcccagggtgctgcacagcactggtcctgagaaggcactcaatacatactcagtggatgaatgaatgaatgaatgaatgaatgaataagtgagcgagagtgagtgaattaatgagtggcatgagctggatcctgcccttaacttgctccgcatccttaggcatcctccccgactctggacttctggttccttagctgtcagctgagggtgctgggccccatgccccaagagagcaggcctgcatctcatcccagctctctcggttattgggtggcctggaccaagtccctgccctgacgctgtaaactgggcggcccccctgacgctgtaaactgaccctgacgctgtaaactga

SEQ ID NO: 144058 - DNA, 829 bp, Homo sapiens
tattttccaaattgcacacttccataaaaattttcctaggaagcaccaaagctttcaactgcccagaaacaccccgatctgggagaaaaggtggcttgagctgcacctcaaagatgggctctatctcagccgggttgcaagtgcacagggctccccgcgggacggagacagggagttgggaggaaacgcaacgcgcctcccaggcaacagactccgagctccggttcggaaacgctccgaggcagaagcaagggcttctaagggctccgcttcccagccttgggtccctactactaccttccccctagactcggtgagcccaggctgatggaccgtgcagtccagtttgagccagcccagcagccctcaatcgggcgggcagggaagaaggcctcctactgccgggaagaggccagcgcgctccaagttccccgcaaattccgcccttcccgcctggcacggttcccttgcaccgctgtgctccgctcccaggcttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggccgcgcgccgccgcagtcctgtcgcagcgcgtgccctggtccctccggaccgaaaaggccgaagccgtcccccgcgaccgaccccgcgcaactggctcgggtctgcacctagatggctgtgggccccacagggatggccgggcgggcccgttcggccgctacctcagggtcgccagtccccgcgcgcggccgcaagctt

SEQ ID NO: 144059 - DNA, 897 bp, Homo sapiens
aaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagtcatgcctgacgggactcctgacctggtggcaccagatccagtctgaagggacgaggatggaggacggaggttcatatccacagggagagaggggccctgggaggagggggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattggctgtccagtccttgtg

SEQ ID NO: 144060 - DNA, 521 bp, Homo sapiens
aaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagtcatgcctgacgggactcctgacctggtggcaccagatccagtctgaagggacgaggatggaggacggaggttcatatccacagggagagaggggccctgggaggagggggccgcgtggggaggggagcgccacgttgggaggaggcggccgct

SEQ ID NO: 144061 - DNA, 379 bp, Homo sapiens
tgtcacccagctgagaaggcattgttattaagcaggtagttttacacctgggaagcaagtgtaccaagctattcagtctgtgtgctgggtgagaaaatgttgttgaatgaatcaggtcagtctgtgtgcttattgacaacttttcaaacatttcacacccttagaagagtctgtatcacttacctcccctgatacctatgcttgcaaatgtgtgtgcagtttcagagggttccaatgtgatggcccattggtcccctcctgggattctcatggacaagtaagattcggttccccgttcgggtgggtctgtgcgtctgttcctgggcgcatgctcacagaagcagcacgtgtcccagccgtgggctggcatcccagcgct

SEQ ID NO: 144062 - DNA, 249 bp, Homo sapiens
aaccagcaagggaatcaatatgctaaaaaacgttggtgatagaacagaacattaactttgagattttaggaaagaacattcccaagaggtgacaagattccagtttgctacgtgtatggtggctgaagtaaaagaagaaagctaagggacctgtgatgcttacctgcaggacagatccccaccacaccaccatccctcacagtcactggtatcttaaaaagagttcaaatcaatttccttttttttttt

SEQ ID NO: 144063 - DNA, 371 bp, Homo sapiens
cgtagcgcggtgactctaaggatcccgggttatcgctgccacatagagagtacagttttatatacctaataattcccttaaatattgtatttagcttggaactcaagcactccgctttctccttaattgtatttctcaagaaggaaatgttataattaccaaagcagagttactatgaacatctagacaaactaaaggaagcattttgaattgtaagtacccaagatatttctattactagaaattattgaaaacgatgacaataaccatttctattgttcatatacttttctttaatcctgtcgatcacatcctattataaaaaccacccccctctatagatgggagccactccaggaagacaagaagtc

SEQ ID NO: 144064 - DNA, 443 bp, Homo sapiens
ggcatgtgctaccactcttcagctaattttgtatttttagtagagacggggtttctccgtgttggtcaggctggtctcagactcccaacctcaggtgatctgcctgcttggcctcccaaagtgctgggattacaggcatgaaccaccacgcccagcctgacaactgcctcttatagaaggtggaggaagcatatgggctatatgggcctaattctaaacaacaaagaatgaggggaaaacccaggtcaacagtgagagtattatgtaacagttttctttacaaataataaaacagaaaccaaaagcaatctaggtagatctaggtagaacattttctaggtagatcattctagaacaataaacaatatcccacacttttggcccaaactcttaaatctcctgtatgtacctcaacagcatttgcctatcaataagaatgaaat

SEQ ID NO: 144065 - DNA, 352 bp, Homo sapiens
agcactttgggaggctgaggcgggcagatcacctgaggtcaggagatggagaccagcctggccaacatggtgaaacgccatctctactaaaaaatcaaaaaaattagccgagtgtggtggcacatgcctgtaatcccagctactcaggaggctgaggcaggagaatcgcttaaacctgtgaggcggaggctgcagtgagctgagatggtgcccttgcactccagcctgggcaacaagagcaaaaccccacctcaaaaacaaaaagtgatgctgcacctgctccacactgagcccaagggtgcaaagtgcccccctctgatgacccctaaccatgatccgcctcacccccagc

SEQ ID NO: 144066 - DNA, 620 bp, Homo sapiens
agagggtcagccctgcgaggggtgagccctgacagagaaagggaggggtgcctgtgagtgcccttggagtggctgagatcagggagaagcgcctggagcaagcagctgggagctatggtgggctgcagccaggtggcacagtcagatggcttctgcctgcatcggatgggctgatggacgcccaacagaggcatgagttcaaagcccccagagggctgcaatgagcaaagttgacattgtagagacccgtgggactcacaacctgccctcttcagcagataaaccacaaggaaacgagaggcctggcatgcaggggactcggcacagttccaaagcagcgtcccggggcatgtgggagaaacgcctagctccaggcccaccccgcctgcttgcgggcccagcatcgctttcacagggcttccaggggatccccaaccgctcagcattgagaaccggtcgctgctctagattaagaggctcaaaggacatatcggatagtatggactttggatccgaattaccaaatcggaacaaaacacacaactttaaatcagacaagcagaaatctcaacactggatattccttgatacttagtaaatttggtttgtgtattattgca

SEQ ID NO: 144067 - DNA, 329 bp, Homo sapiens
ctgcactcaagcaggcaatagagcaaaacattgtctccaataataataataataataagattagccaagcgaaaaaaatttttaaaaaggccagacatggtggcttatgcctgtaattccaacactttgggaggccgaggcaggtggatcacttgaggtcaggagtttgagaccagcctggcccaacgtggtgaaaccccatctctactaaaaatacaaaaattagccaggtgtggtggcgggtgcctgtaatcccagttactcaggaggctgaggcaggagaatcgcttgaacctgggaggtggaaggttgcagtgagctgagatcgt

SEQ ID NO: 144068 - DNA, 422 bp, Homo sapiens
tttccccaccaacgtcaaaggttgagggacagaggacatatccctgtgggcaacgaactgggccccacactcctgatcagctcagccattgccaggttcttgggcctaaggttgatccaaatcggggcaaagaattaggtcctctcaaagcggagtaggaaagaacaagacgttcatggggccttcctgtaattcggcttccatgttgaagtccaaagtcccaaggccagcatgcaggcagctcactgcgtccgccctccacaattccaccagcccccagcccactcaatacacctgaggcctatggagcgtgtgccaggcctcaccaggcccctcggactttcccaatgctgtgttctgcccagaaagctcctccctgctttctcctcctggcctgagcggacccattcttggatcagcag

SEQ ID NO: 144069 - DNA, 695 bp, Homo sapiens
gaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaag

SEQ ID NO: 144070 - DNA, 701 bp, Homo sapiens
gaatatttgttgaatgaatgaataaaatgtttagtgaactatacgtgtctttcagtggttgaagcatttacaatttttatacttcattatttttatttagtagagttagcaaaaagagtggctagaagtcagaggacttgttcacatattaccaaagaatgtctatgttacatgaccaatttatgcatctagactacatgtgaatgtgtgttgactgatttgctacttttgcattttttcatattcagggttttcataattcacggacatagtgagtgaagctatgctgcttttactaggaactatttcctttgggattttgctggtgtattcaactagagggaacttcaagtggaatctaggacacctgattgccttgaacaattaaggcaattgaaggtgctggagagtaaggttaatcaatgcatgctttagaagtctgtattcacaaagggaagtcaagtgttccattcaacaaatactgagtttctgttacatgtcaggcatgtattatgcatggcagtactaagataaacaatatcttatggtctataagatttttttagctaactggagagataacacattgaaaatctcttaccttaccttcttctttgagaaattatgctttagcttttatggttccccatgccctgtgtgataggcagaattgtaaaatgaccacctgtgacctatgccat

SEQ ID NO: 144071 - DNA, 370 bp, Homo sapiens
ttccctagttgctcaaccatcagtgctgggatgagttctcaaagttgggggcacatctcctttagcaagataccctgatatctgccgtttgtcctgcatcactgtgacaatgtcacttctctcactgtgcacaactcaagagacccctggtgtagcccaggccccccagctgctgtgctttccctggggtggggactgacacgccttcctctgttcttctgcatctgggatcttagtgcttacagagtcagggatcaggggattgcccaagatttctttaccatctgcttcagcaaatggctctcctggaaaggtcggcaggtgagcctgatttctgaattttcactcagattcaccagtttcattgttt

SEQ ID NO: 144072 - DNA, 433 bp, Homo sapiens
agggagaaaaggggctgttacttccaaagaaagataatttggcaactaaatccatcatgtaagtacccagtttcccacagagtagagcaggtagagaaggaatctggaatgctgaactttgttgatgtccgagctcccaggaaggcataaaaggagaataataatagaagaggacgagtcagggatagcattctcagcagggtgggaaacatgctaatgagaggaagactgtaaagaaaaagcaaagcgccagcgggggcgcagtggctcacacctgtaatcctagcactttaggaggtggaggtggacagatcacttgaggtcaggagttcaagaccagcttgaccaacatggcgaaaccccatctctactaaaaattcaaaaattagccgggcatagtagtgcatgcccgtagtcccagctacctgggagg

SEQ ID NO: 144073 - DNA, 572 bp, Homo sapiens
ctaagggtattgtggagccgaggaaaaggtttcactcatccgccaccatttactgaacacctcgtatgtgccagcgttgcatcagtactgggaatacagcagtgtacttgccaaagtccctatccttgtggggctaagcaagaccaacccgaaacaggttaataagcaaggagccggttagagggggaggagctaggcagcgaattcaaatcaggtgacagactgggcacttctttagatgcatgcggctgtggggagggcctctgagctgatcccagtttggcaaggtgaggcagtcatgtgggatgggaggagaaggaacagccctccaggtggagggaaccacagtgcaaaggtctgaagggaggacagagcttggtgaggtgcagggacaagcctcacggaggcctgtgtggcttggcagagcgagggagcagggaggagatgagtccgggggctgcggggcaggcagggccctttcactgggagccttgtggactgtctgtgaaggagtttggaatttcagcaggaacagcctggtcagattcagggtgttagcaggtgacccagga

SEQ ID NO: 144074 - DNA, 386 bp, Homo sapiens
tttaattggagaattctacataagcctgtattttttaactttttttgttctcattataattgacataaatatatttattgaggcaatttgttcagataagaactcgggatgcttcataagtcatgatgttttttaatatataaatgtggcgaacaaacatgacagtgcttgctgtgtagcagatgctccatgataagccataaatattcctgctagagttagtttgtaagttcaagtcggagagggaaaatatcaatagtgaagaaataagattgattcttcccgtggagataacaattgttttcatgctgcgaagctaaatattgctgaacctaaagagaaactctgtttcttttatttcctaattatctttagttttgtttgtc

SEQ ID NO: 144075 - DNA, 369 bp, Homo sapiens
catttcccatttggacattataatatctagtaattgtatcacaactgaagcttggagtacagtcaatgtctgaagtgacttaaacacgcaaaaattgtagctttatattccattacgtatgccttattttttagatattttgtttcacacctaaaataaatgattttccttacttaagacgtaagtagttgaaaaatatatttattcagtacatcttccaaagcagtgtcattaccatgtattgaacaccgtgataccaagtgagatcagagcatgtatcctgcgtgcccatctacccaccagaaagcataaacagcaatgcatgatcagcacacttccttagcatattagtccatgagatatacagat

SEQ ID NO: 144076 - DNA, 283 bp, Homo sapiens
cccagagcccacctgtgataaggccacagcccatgccatgtgtgtgtcctgaggcatgagcgtggacacatgagaatctcaatcccacatgcttgggggagcaggcacagtccttattcattctgcaaatagtcactaagcagcctctgtgtgccaggcactggcgacacagcccctgccccctgaagctcacagtctaatagtggagacatgcctgccatcagatcattgcagcctcagctcacagctgccagacacctatgtgtggagggcagcagggaca

SEQ ID NO: 144077 - DNA, 300 bp, Homo sapiens
gtctcactctgtcgcctagcctggagtgcagtagcattgttatagcttacttccatcacaccatccagctaaatcttctgctttaatggtgtttattctaatagaattttacttgttcttctgaatttgacttacataccctaatttccacttatgcttctcctttctttgcctcctaaaagtgagtagcatgattttagcttataattagttgatttgtactgttctcagctaattttgatgttatgatcagccaggcatggtggttcacacctgtagtcctagcactttgggaggcca

SEQ ID NO: 144078 - DNA, 372 bp, Homo sapiens
gtggctggcatgcagatgacatcacacctgtaatttcaactgctttgggcggccctggctgtgtgatgtgatcaccctgctgccaggatgttcaaaaacagcatggacaagagagcaaaattccatctctacacacaagtaaacattagctgtgcgtagtggcaacaagcctgctgtcctagctacttgggagactgcagtgagctatgatcctactactgccctccagcctgtgcaacagagctatgaccccatgttaatctgttgtgtggtctttctacctaggcatatgtacatgtcttcatgcatatgtatatgtattttttgttgttttcacaaaatcgtagcatattatacacactgttcctctgt

SEQ ID NO: 144079 - DNA, 167 bp, Homo sapiens
ctcactccccatgtcacactgttgtcatcatgcctcctctctgtaatgcccttgctgatcacaatcctgtctctcaacaccctgatcagcatcatctccatgaaatgtgaattgaaaagttccaacaatctcactccttctccacaggttcatggcacctgtctaca

SEQ ID NO: 144080 - DNA, 557 bp, Homo sapiens
ggctcaagtgattccacccacctctgcctcccacagtgctgggattacgggcatgagccagcgcatctggccaccttattttcaattactggctcaatgtaatggctccatctcaggaacagccaatgaaagagatgcacaggacaagaaacaggaccttgccctgtcactcaggatggagttcagtggtcctatcatggctcattatagcctcaaactcccaggctcaagcaatcctaccatgtcagccttcccagtagctgggactacaggctggagtacagtggcacaacctctgctcactgcagcctccacctgccaggctcaagcaatgctcctgcctcagcctcccgagtagctgggattacaggaagtgagctcacaatgactcaagctgccacatagtgttgattgtgaaatgccagttgaagcatatgtcctgcgagcttgggggtgctacaagttgaccactgcagcagtaaagatgactctgaagaatggcgtgggatggatcctttcaaatgcacttgagcagcagtctccaaccacagggccac

SEQ ID NO: 144081 - DNA, 400 bp, Homo sapiens
ttgttcctcctctgtggctgctctcacatcctctagtgctcttttgtggatgcttcaggacctctggttctccctcatgggtgttcccacatcctcgggtgctcccacatcttctaatgctcctttgtgggtgctctcagtagctattctccatcagcccctgtgtctttcgtggggcagatgttgttcgtgaactttcaggagctcctctgtgctcaattctgagatcatgagagccaggatggggggtgcggggaatgctgtcccccgctctgctgaaaccaccttgtccaatgggggttgccccatatcgatgtgggaactgggcagtcatttccccctgctttccccctgagctctctcaggggtccccttcagggagagatgaagctacaagctg

SEQ ID NO: 144082 - DNA, 332 bp, Homo sapiens
gccaggaatactgccccaggctcccaggcctgtccttccagctgtccttccaggcatgaaatctctttaaagccacagggctctcaagagaccccaggttccggtccaacccacccgttgtcagatgccactaaatggagagaggctaagggactcctaaggcgatgtaagctgtctgcatggccagtcctttctttactaaggaaggtactgaggcaccaggcaccagttgcttggggttacagctgcacacgcacagactctcccctggagagctgccctatcacagggaggacggtgggcagtgggaatatgaagtgatttcgtgcagc

SEQ ID NO: 144083 - DNA, 784 bp, Homo sapiens
gagcccctggggccagcccatgggaccaagaggaggaaagaccccaggatttggggatctgaagtcagaatgtggctccaggggcatgatttgccccagggccatcccagatggggaaggaagcagcaggttgccgggaggcaggccagggggctcctctcgcaggccaggctgggcactggagggtatttttagctccagtttctgcaggagtcatgcggttcttttgtgcctcagtgtcccgggtcagctgggtcaccagctgggtgtgggaaaacccaggcggggttcacatcctctcccctgcttcctgggagaaggatattggtagatagaagggacttgggttgctgctggacccctagccaggcccccctctctatgtcctggcctcctggaacccagcccaggcaggctttgggatgacgcaggctcccctgtaacctcgggggtggggtggggggatgcggtctcctcattagggagttctctctctctctttttctctccggatgtgcttcctgttgaaagtatgagtatgctgtgatgttgcattttaaacaaatcactgacctctcagtcctccccttggcctgggagaaatgaggcttgcgcctttcagtgccacttctgaggggcacggtcatgagtcttggcccttcctttgtgcttattggtccaaagggaaggtatttagtgttggtgcttgtggattagcgggtggaggcttgaagttgctggagtgaggtggccagcccttctacgagttatcctcattcctgtc

SEQ ID NO: 144084 - DNA, 189 bp, Homo sapiens
aagcaatatgtcacaatccctactgtggacaggtcccagggagaagagagtcacacaacctcagcaatgggcccacatatatgttacagtgacttctgcgagtcagcagaagaatcatatcacctgtatgctaaattcagcagtaagtcactctctcttctaagggcaaggcccaggcaggagaggaga

SEQ ID NO: 144085 - DNA, 190 bp, Homo sapiens
cccaagactcgacatccaccacgtcgaggctgggtactcttaagtctccgagcaccaagccgcgccgcctaaggctttcctgttgtggggcgcgcgcggcgtcgccatggagatctccgaggggccagggaggtcgcgcagcagaaggggaagcgaagggtccccggacgcgcaggcccttcctatcggg

SEQ ID NO: 144086 - DNA, 370 bp, Homo sapiens
tcaggttcccttacagccactgtgttttgacgattgcccattagaaaaaaagactatgctttctgtaggttttaaaggaatggtggtgaaataaggagcattccctgagcagatcttgcctgcgggcacacctctgagcattggaccaggcgagaagagcccatgtgttggctgctttgggatcccagcactgccaatggcaggtgggctgtggcccagggagagaacctagccttttgcattctcttgccccatttgaaaatggagacgatagtggcgccccgctcagtgttattttgaggatttgaatgtatctcagatgtagtacctggaaaaatataagtgctcagtaaatacggttgccagataa

SEQ ID NO: 144087 - DNA, 352 bp, Homo sapiens
aggcacccagactgtaaccccacggcattggtaatgcactggccttgaggcccagggaatcacaggaaagccagccggtcacttgtggttgggctgggtccttcctgtgctttacacacaaaagattcctgatgcccagctcaggaggtgggagctgggagcagcagtgaaagaagaaaggcatggaaatgggaaccctccacgttgagtcatgggaacactggaatcctccctctttctcagagctacaatgctgcagagcattcttcctcaaaaataaaaaggccagaagagaatggggtggattttctgttttcatagcattggggtggaaaatccacccaactgtatg

SEQ ID NO: 144088 - DNA, 407 bp, Homo sapiens
aaacattcttcatgttcctggccacttttatttcagccacttcagtttggggttcattgggaatatggaaacagttttccattcacttgctctttaaggggagaaatggcagcttatttgggggaaaaaaagtgtggaggtagagcagcctgcactggtgtggcattttatgagcaagatgggatccgaaagcaggggtgatgcataggaatggcgcatacttcgtgtgtgtaagggaggtcagaagaggggaccaagtgctttccacttctcagagtaacataatcctccacagtgctccagttaggtataatgcttttgtttggaggcaataaacattagaaaggaaatttatgccaacatttcaatctccactattagtatggcatcatttggagcacttcact

SEQ ID NO: 144089 - DNA, 427 bp, Homo sapiens
tgcctttgaagtattcccccatactgtgacaaatgattaaatagttattcataatgcagcatgacacggatataaggggggaagaagagagaggtctctagggcaggttgggaggatgaagaaaagctttctggaggtcacaatgctattgctgcatcttgagaatatcttgggatgggcccgtgagggagggtaaagagagagattgggggcacatggtttctcagatggtacatgatacagagggtagccatgcttgggacactcagtgagccccgagtcaccgagtgtgggtgggcagagtgtgaggggctgggtgacatagatggctctggatctgtcagcagtttggttggggcttgttggtcttcgaggagatgggctgtgaaactgtggggcagtgagatctgtgtggtggacagactca

SEQ ID NO: 144090 - DNA, 252 bp, Homo sapiens
ttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctg

SEQ ID NO: 144091 - DNA, 438 bp, Homo sapiens
gctgtggagggtgggtaggggagtgggccgggccagcacactgagactggcagctgctccaaccccatccctccttagagatgccacctcccccaccacccacccctaatttgtgccttgcctccccaccctggagtagtccctccgggtaccaacactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaaga

SEQ ID NO: 144092 - DNA, 485 bp, Homo sapiens
ggcctcccaaagtgctgggattacaggcgtgagccaccactcccggccaacaatacattctttaataataagtaataaacatttttaaatacatttaatactcttaataatactaaaattaatttaaataataattttactattttaataatatctcaaatattttcaacatgtcgtcaatatgtatatagcctagcatttggtgggagaaggtgtattttgtgtacgtgttagagttgggaaaatagagaacaatgtatggttgtactatattgtaaatatggttgtaatcatcaattgactatcacaattctttcaattacagaatagtttgtgaacatggcatacaaataaaaagtagtactactaagtataaaattccaaacatcttggggctacctgttaaaattcaccctgtactcttgaaagcaaacgtgcatctaaataaactaaaataaagattttactacactggacttggatcg

SEQ ID NO: 144093 - DNA, 395 bp, Homo sapiens
tatgacgagaggatccggcatgaggttgttcctagaaatctgtaagcctgcacagtccagtaaaactttctgtgatgacagaaaagtcatgtgctgaccagtatagcaaccactagccacaagtggctattgagtacttgaaatgtggctaatgtgactaaggaaatcaattttatttttttcttgagagacagagtcttgccctgttacccaagctggagtgatcatggctcactgcagcctcaaccccctgggcccaagcgatcttcctgcttcagcctcccaagtagttgggaccacaagcatgtgctaccatgcctggctaattttttattcttcttcttctttttttttgagacggagtctcactctgttgcccaggctggactgctgtg

SEQ ID NO: 144094 - DNA, 706 bp, Homo sapiens
gtcatgggccacatcgtatgtaattttgaaaacattacaacatgcaaagacttcgaatgccgtatgtggttctggttgcagcatctaagaaagatatatatattttttaaatctgagaaaattttggagtggtaaaataaaatactttccagtcttagaatattaggatttaggaacataatcttcaaggtgaaattaggtaaaaggggccgggcatggtggctcatgcctgtaattctagcactttgggaagccagggtaggtggatcactgagatcaggagttaaagaccagcctggccaacacagtgaaaccccatctctactaaaaatacaaaaaaattagccaggtgcggtggcacacgccagtaatcttgctactagggaggctgaggcaggagaattgcttgaacctgggaggtggaggttgcagtgagctgagattgtgctactccactccagcctgggcaacagagtgagacttcatctcaaaaaaaaaagaaagaaagaaagaaagaaattaggtaaaaggaaaagttcttccttatgtagtagtaagtaaatttttaaaattttatacaagccgggtgtggtggtgcaagcctgtagtcccagctactcagaagcctgagacaggaggatcgtttgagctcaggagttcaagaccagcctgggcaacatagcaagacgcacatctcttaaaaaaa

SEQ ID NO: 144095 - DNA, 364 bp, Homo sapiens
cctctgtgggcagaaggaatgaaaggaacatttactgatgcttctccacgagtaaaatgtcatcagaaggtggaggtgaggccgggcgtggtggctcatgcttgtaatcccagcactttgggaagccaaggtgggtggatcacttgaggtcaggagttcgagaccagcctggttaacgtagcaaaaccccatctctactaaaaatacaaaaattagctgagcacggtggcgctagcctgtagtcccagctactcaggaggctgaggcaggagaattgcttgaacccaggaggcagaggttgtagtgagccgctgtcacaccactggactccggcctgggcaacagagtgagatgctatcttaaa

SEQ ID NO: 144096 - DNA, 404 bp, Homo sapiens
ccatagatcttggaccgtgctgtcctctgagagaaagggcagctgagtccgccttactgcgtgtctaagggccagggcccctcaccgcccagcaaaacctgctcctcacgaccaggaagatggtgttcctggtctcactttgaagtctttttgtgagacatcatcctgatgataattctgggggtgggctcgggcaagttccccgtggatggagaccgcttggctctttctttcccccttacaagaacctggaatgctttttattgccaaggctgggccaggtccgcttttctcgtctgcaatggcctctgagctgaagcctggcccggattcgcccctcctcttgcatctctggcctgtgagtcctctcctccctctagccctgcagctcagcctgccctgcc

SEQ ID NO: 144097 - DNA, 377 bp, Homo sapiens
actatttctgatcctacttactcttaaatacatttacaaatttaaattttttgctcagaaagcactcctaagatccacagatcctggagtccatgcttggctatctgctaacagcattctgacattcattcattcttttattcactcatccagcagatatttattgaccaccactggtccacagctgagcctcacaactgaaactgtatttttcttcttctccctctatatgactgtatctcccaaaccaactctatttaccaattattcatctacttttcccatgagatagctgctgtatcaccacccaggatctatacaaatccaattaaaagcaaacaaacattaggttttagtaatctgtgctgcctcatcat

SEQ ID NO: 144098 - DNA, 275 bp, Homo sapiens
aggcctcctttgtttgtttgctttttgcctttgttcataatcaaagatgagctctgctgccataacaacttcgttatttctgggtcagaacatctggcttctatgacttattcaaccagtgtctgttgaatttctcagctaaatgtggaagaatctatttccagatgtggaagataaaagtgcaaagggggcttggggcccctgagaaataggggtcacccaactggggcttaggggttagggtggttttttttttttttttttttgagatgggg

SEQ ID NO: 144099 - DNA, 260 bp, Homo sapiens
tagaagtctggagctacagtggaactcaggtttcgtgcatctttggcctgcttatcctctctatccaagaagaggggtgtggatggagaacgcctgcccaggagggacaaagcttcagcccctccagtcagtgcctcttctcctttctcccctctcccctctcccatctcccctctcaccttggccagattttaactgtgcaagggagggtggagtcacttgttcttccgtgtgccaccctcctgtgtctttgctctgtc

SEQ ID NO: 144100 - DNA, 791 bp, Homo sapiens
aaaggctgtagaggtgaatccagctgtggtgagaaatggatgaggtggaggtaggcaggtgattccctgcaagggagaaagaatggggctcagatgttggatttaacagagaatgggagatttgaggcagtgtggcccagtggtcagagtgcaagctttggagtcaggacggcaatcaaatcccagattcactgcatcctaactgtgtaaccttgaattctcctctgggaaacagaaatgatcttgataatagctatgcagtagggttgctgggaagatttgataagatgatggaggtaaagcattgcatccagtggctggcacagacccccaaatcttccccttttctctttaattgattttgtggtttgaggctcttaaatggcaagaaatcatttgcatgaataaagagccattcttccaagcacttccctcctagttttctgggagagccactggaagccaggattcagagttccatcctgcaaaagctgagctgagctagccaggaaggaggaggagctgactgtggcccaagggctgggaagcaaggcagaaggggagaatccagccctaattcccacgctgctggtgccagtgaggctgactgtgggaaaaccttgtcaggggtcacactttgggatctctaggagcaaggtgctctgtgaatgcttatctcagattctctccacccctggccctttcagtgcccccagcccaactccggggagagtatgagtgactgacaggccctgctgcagctgcagcctcctcactgtgggtacagatgt

SEQ ID NO: 144101 - DNA, 185 bp, Homo sapiens
ccgggcgcggaaaatcgagttcggtttcgcgcggtcatccctggcagcctggtgctctgtgaatgcttatctcagattctctccacccctggccctttcagtgcccccagcccaactccggggagagtatgagtgactgacaggccctgctgcagctgcagcctcctcactgtgggtacagatgt

SEQ ID NO: 144102 - DNA, 484 bp, Homo sapiens
attcccctttccctgagtcattcatttcttctttcctaaaccactcccattattatactaataggttgaaatattattctttttataaaatgaaacaaaattctcctgagattttacattctcctccagctacttcccatttttctgttcctctgctcttctttctatcaaaactcctgaaagagttctctatactgtattcactgtcttcactttctcactcctcattcttccctcaactcacagtcattcatctttgagtctccattacaaaggcaatgctttgctcatgttaagttttagttgccaagtgtgcatccaagcacagtaagtggtcttgaggcttggagaagagtgcagggctggaaatatgaatatgggactctttgatatattgatgttatggcagaaactactaggtacttaccaaatattctttttcctcttcccccttagaacttcacatttaggcagggagcagtgg

SEQ ID NO: 144103 - DNA, 718 bp, Homo sapiens
gatgtcctataagttttaatatgtgatattttcattatcatttaagttttagttcttgaaaagtttccattaaagatttgtttcatggccaggcgtggtggcatgcctgtaatcccagcactttgggaggccgaggcaggcggatcacctgaggtcgggagttcgagaccagcctgaccaacatggagaaaccccgtctctactaaaaatacaaaattagctgggcatggtggcacatgcctgtaatcccagctactagggaggctgaggcaggggaatcgcttgaacctgggaggcagaggttgtggtgagccgagattgcgccattgcgctccagcctgggcaacaagagtgaaactccgtctcagaaaaaaaaaaaaaaaaaagattcgtttcacccagttattagaaagtatgttttcaggccgggcgcggtggctcacgcttataatcccagcactttgggaggccgaggcaggcggatcacgaggtcaggagatcgagaccacgatgaaaccctgtctctactaaaaatacaaaaaattagccgggtgtggtgtcgggcgcctgtagtcccagctactcggagaggctgaggcaggagaatggcgtgaacccgagaggcggagcttgcagtgagccgagatcgcgccactgaactccaacctgggcgacagagactctgtcccaaaaaaaaaaaaaaaaaaaaaaaaaaagt

SEQ ID NO: 144104 - DNA, 393 bp, Homo sapiens
gtttcaggatttgacttgcaaacttgtgctttttccctgataccgcccaccatctgaaatgctcttcttcctaccctccctcacctccagtataacttctgtccaggctgagaaaattcaagttcagatgtcagttcttccaggatgttttccttgatttacatcccatcaaatatgtcatgttttgtgattaacttccatcatagtactgatcataattactctgtaatataataacttaattagctttttataggttgtttgctacaggaaggcagaggctgtttcataatatccttagcacctaacagggatcatacctcagaggctcttaaatgtgtgttaaatgaacgagttccttccaaatactaaactgagttatcaaaaaaaaaa

SEQ ID NO: 144105 - DNA, 693 bp, Homo sapiens
cctagagaaaccctgggcctccaccctgttgcagactgaggcactgccttggggctcggatgcagagccagtaagacttaatgaaaagcaggctggatctggtctctaaaaaatggccgtggatttttggaaaatgtatgaaaggaaggaagtgaagactgtagaggaagtgtttcctgttaatgatgtggagaacaaagtgcttggtgaatccctggtgtgcagctcacactgagcagttctggtctgtgaaatgccacactcgtggcaaacctagagcaagaatctgagaaagcagttaagtggcaagtgagctttgttttgggtaagtataatagttcatttggggaaaataaattctgtgctatgacagggatggtgaattctgggtgcttgttcatgaaacagaaaaaggatgggctcgtggatggattaaacctgagaacctgcaacgccaccctgatttatccaaaagggctgtagagaactgcttgtttctttgaagattcagtcgatgatacaaaattatacaatattctggagttgtggttgcagctaaagatacatacagtatagcctgaaaaggtccaaagaaaaggaggtaaaacactctatctttgagcagcctctcagcttcagcactgctgacatttggaaccagatatttttggttgtgtagggctgtcctgtgcg

SEQ ID NO: 144106 - DNA, 525 bp, Homo sapiens
atggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttccctg

SEQ ID NO: 144107 - DNA, 779 bp, Homo sapiens
tctttctcccttcatttctatccatgtaatttggggctctaatttgatacatgtatgtttataattgctacttcatgatgaattgactatttatcaatatataatgtccctctttgtttttggatgaaagtctattttgtctgatattaatatagctacccttactttcttttggttactatttgcatagagtagcttttccatcttttcactttcaattcattgtgtttttggatctttggatctgaattgtctcatagacagcaaatttttttaatccattttgtcaatacctgccttttgaaatggaaagtttaatccatctaccttttatgtaattgaatgtagggaaggaaggacttactaataaggaaatacttacttctgacattttgctattgttttctttatgccttttttgtctctcatttcccccattattatcttcttttatttgtaattttgtgtagtaaaccattttgatacccttctcattttcttttatgtatattctttagatttttttgttaccatagaaaatataattaacatctaagtgatatataatttagttttaatttaatttatagcaacttaacttcaatagcatgtaaaaattctgctcctgtacagctcaactgctgcccatttatgttgttgttgtcatcacaaattagatttgtatacattgtatgcccactaatacatatttataattattctatgcacttgtctgttaaatcatgtaagaaattaaaagtggaattgaaaacctaaaa

SEQ ID NO: 144108 - DNA, 472 bp, Homo sapiens
tccgctgagttctgtccgcagaaaccgttctctggaacagtgcagattgcagattacgtttactacctccgccatgtcccgcccttcagatgtttgaagatgactcttagattccagtcccccaccagttcaaattagtcattggtgattagtcacattactttaatgactcattgagctaaaactatgaggtaaaaccattagctaaagcttttcagagaggtaaaaggcagacatcttaccgatttaatgagactcccagcattctgggctcgacacatggagcttagatgctagcggtgggagtagaaaggaagggaccattataagccatgtcaggatgcaaatgtttttaaaaacaccttggtgtcatactggatgtgctgctgtaggagttagggaacagtgaaaacacagctgagggtgagtgtaagttttgagatgaggagagtaattgataaaagtaggggag

SEQ ID NO: 144109 - DNA, 359 bp, Homo sapiens
ccagtgtgctaagcttccagtcttttacttgatcctttataacacagtgatgtttgagctgtagtcagattccaaatcaagtatcaagaattacagaatgtactcttctgttttttaatactcttagttatttcttgaacttaaaagcaaatatatacatagatatgtgattaaacaagtatagtaaaaagttaattgtaaggtttgggtagtagacatctaagtgctcactctaggccaggcatggtggctcacacctgtaatcccagcactttgagggtccaaggcgggtgggttacttgaggccagaagttcgagatcagcctggccagcatgctgaaaccctgtctctactaaaa

SEQ ID NO: 144110 - DNA, 528 bp, Homo sapiens
actgtcgcgcgttttagatcagcaaacggctgttacgcccatttaaagttgcccaactggtggcctacggcaatcgatgttgagggacctgaggcactgtcacatccggaaaggacttctggatcatcagaggaggattagattaggtagaattcagtctgtacatctgtccttaaattactgaagggtgattgtcgctaagagcattggctccgagatcagacccctggatctgtagctgagcccttcctcttactagttgtgtgaccttgagcaagttacttttcttttctatgcctcactttcctcatttgtacaacgagtacctaactcatagggttgtggcgacacctaaatgcatattacaagtaacatgcttggaactttgctagacacataataagtgctcaagaaatgttaaccattgtgaggccggccacgatggctcaagtctctaatcccagcactttgagaggctgagccgggcggatcacctgaggtcaggagttccagaccagcctgaccaac

SEQ ID NO: 144111 - DNA, 404 bp, Homo sapiens
gaaaacgatctgctccccatgaggttacagcaagggttagagaagaccttcacataaaacaccaggtgggcgcagcaggggtttggtaaatattagctactttcactacttagtgtcttctttgacagctactgacctaagagtataaatccggttcagagaagtttagaagcacgatgagaagacaagcatgctaaggcacccacctagcagagaagcaggaaaaactggggaaacttcagaggagggggacagaggttctcaacccacagggaaagcccactcctttccctaggaaaatcacacagccacgtgccacatacagtaaaaaagacagaaggatcacaggtggcgttgctttgatcatcttcattacacaaataaatgaaacattttggttaaaa

SEQ ID NO: 144112 - DNA, 273 bp, Homo sapiens
caataagcagaagtcttttgggatgtatttttaaacaggaggttttgaaaactccaaatttagattcataaaaagaggtagtgcaagtgtgaagcatgtggtcattttggcatactcagtgtataacttctctctttacctatataaggataaaataaagcttcagaaatgtgcaaagcagaaatcttccagttctgtttatccactttcagtcaggtagtaaaatatcctaatgttctatgaagaaatcttcaaaatgtactactgaaagag

SEQ ID NO: 144113 - DNA, 414 bp, Homo sapiens
agtgcaagccacaaggcaaattggtagatcggattacaccaaaattaaggatttctgtgaacaagtgacatcgcagttgaactgaagagatgatgacagtttgggaagagattatgaggtctaaaagtgacaaaggggatgaatatctagaatatacaaagaactctggatagtaccccaaaagaaaaatgggtgtcatattcagacaatttacaataactcaaggctgtataaggctgtaaggctattacacagctattagcctagagaatttagagagcttgagaatgccaatgctggcagaggtgtgggaataagattttcctgctgctcgtggaagcacaggttggagaatgatctggcattagctaatcaaattaagtgtctattcggggcataggtctcttagaaatt

SEQ ID NO: 144114 - DNA, 291 bp, Homo sapiens
cagccattgggcaataggcagttccaggtacaatctgagagaagggaatcacatgaagttactgctacatttttctggtggggaaagtttcaaaaccctcaatgacagcacgaggaagcagagtccaggcaaaggatcagtcttgtttggtggaggaaacggagactgctgctcagggctgctaaaatgtgtgtggcagggtatcagaaaggatggagttgcagagaaggagccccagaaatcttatagaggttgctgcaggtccttggccaaatcccaaactatgaatgt

SEQ ID NO: 144115 - DNA, 406 bp, Homo sapiens
ctctactcccatttcgcaccccagcctgtatgggtgtcaccttccctgtgccccatggcacctgggcatccctctaccaaaacactcatcacctttggtttgtattctttttgctcatattcatctcccattcaactgtgagctccttacttaagggtatgggctgtgtctcttatctctaaattcttatacagtggattacgaatgctcaaaatatttttgcagaatgaaggtaagaatatgacatggaacctaagcccagtccccaagtcactgcatactccaggctctcacagcatctgtgctttagtacttatagtgctcatgctactgtcagctactcacaatagactgtgagggcctcgtggacctacatggcctagtgcaaagtaattgcgtaatctgt

SEQ ID NO: 144116 - DNA, 183 bp, Homo sapiens
gggcagggcagggaggggaaggaagaaaagtagaatacagaaatagagggaaggagaggtgaaaaataaagacagggcaaactttttagtttttaaaatcttatacacctaaatcatgtgctgtaattctaaggagaacaaaaggtatagcacaaatcattgctctaaagcttgactcagtag

SEQ ID NO: 144117 - DNA, 172 bp, Homo sapiens
ggaggcggaggttgcagtgagccaacatcgcgtcactgcactctagcctgggtgacaagagcaaaattccgtcttgaaaaaataaaagcatattttaaaaagaatctaagcttttatatagctacaatccctatgcttccctctagccagtatttttgatctgtctgaggtg

SEQ ID NO: 144118 - DNA, 305 bp, Homo sapiens
tcattctttctgaatgcaaagggcagcaatttcacactgtcagggcaaaatgcacatgcatacagctcagctcccagcgggatacctttgcttctcagaaatggcgaagaaagccagcaaaatggcctttttctccttttgttttaatttaactatttagagtgaggtccttaatgtaacacccatcaatgattatggagccactgttctgaaagaactcgcagggccggcagatctgtgtgagttgtggtgtgtgctttgcttaaagcaactttaaaattatatgaaacaatgcattcttgttg

SEQ ID NO: 144119 - DNA, 494 bp, Homo sapiens
cagcgtaaatgtagtgagtcaaggtacgtggcatgaagggtgtgcaggcctgggtttgaatcttgcctctggcagtagctggtgtgtccgtgagacaaatctgttaacttctctgagccttgagtgccttgtctacaaaatggggatgatactaggggacttgtggagttgctgagaagatgaatgatttgtaaatatgtacaaaatgctgagcaaaaggccagaggggagaacacacacatctctatgttcccttaagatacaaagcagggtacacttgttcaccaaaccccaggctcaataaacagttatgtcaggacaaggaggaagaggccaggatgctatgggtgagcagagaggggttggaggcattcagttacctgagtctggggagatggcagagggtggcgggagcacactccatcaccactggggagaactggagagacaacaccagataaccccaaagcccagaggctgcagaacaaacatca

SEQ ID NO: 144120 - DNA, 296 bp, Homo sapiens
ctgctgtcaaaggctttggaacagcagctacaattgtacaccagaggtggaacctctgcggctggcggcccgggaacatcagaagattgattttcatcttccctggaaaaatggacatctccttcattgtttggagattttgaacgagtgagaacagcagctggttgtggacttctttcttgattaacctctaagttggatactggagggggtggtatattttctgtggctgaatccgaatcctgtggtatggagaatgtctttggcttccggcatgttttcggtttcgctgcaag

SEQ ID NO: 144121 - DNA, 305 bp, Homo sapiens
tataattttgtgtgtgtgcatgaaaagtaaaggggaacaggatgttggtgaacagtgataatgttcccacgttgaaacaggataatgtcccgcactgaaagaatgagatatttatattgatgacttcacagatggagcacttgtgagagatgaagcagaggccaaaatcttcaatgcataagggtactccaaggaggtcacaaaaatcaaggactgagaagaagaagactccaggattgctaacaacgttgacatccatcttttccttggttggctctagctaagggaatgacctcagcctaata

SEQ ID NO: 144122 - DNA, 465 bp, Homo sapiens
tccaagtttacattttccttgaacttcaataaattactgaatttattgaattcagctaagtgcccactaccagtgtttgggttggatgggaagaagatactaggagaaaaaagaaacctccttgttgtgggaaagcttggtatcattctcaaagatgctaggatggaaagacttcttgccttattctacatggacaagcttaatcttctaatttcttgtgtggctaagcaataaggtcttagtctctgatggcaaggaagccttgatccaacattagatctatgtatttatcatttctggtctatatatggcttgttgtgcagcagtttctcaatcaggtgaatttttaaaaacctgctccaatttcttgaataaggatatgagaggagacacagtaagtgaaagcacttgaaaacttcatcttgttattatagttaacaacaccattaccacagggtatcctta

SEQ ID NO: 144123 - DNA, 348 bp, Homo sapiens
ctttaaacatacacctcaggaccagaacacaggaaagttccattgacttggtcacacagagcttccctgtgcttcgaatattgacctaggaccagttcctataacatcttgccagacgtctgaggtgcaaggcagcaactgttggaaaattaattattgcattgccaggctttatactaaaatttttactaaaatttgaaaggcctaatacacaaatacatggagagaatggataaacgatacatctacatacaccttcaaacactttgaggtaaagtcgttaggaaataccaaatattcaacatggtggaggggggtgtctaagtatatgcaaagatttctccctag

SEQ ID NO: 144124 - DNA, 481 bp, Homo sapiens
atcagacggataatatctagaacaaaagaactcagttgaaaaaacaagaacaaagaatgaattccctgtagactaagctctcttcctgcacaggtaaggatctctctacctcctctctgatcctcaccaacaatggggaaccaacctgtattcaacagagggaaattgctgaataattcataagacaggagggttcccagctcaactcaaccttggatgaattgtctctatggccctactaagatgaagaaaaatatttccttgtgcagtaaatgtggttcatgaaaaggattcattaagtaagatgctatttaaacatatacatttttctgactagcactgcactttttagggaaggtgatgcttaatagaggagagatgctttaatctctccttatactaactttctaaattaaaaaaacacacagtgctgccactagcatcttaaggaagataggtggatgcatcgatacacacttct

SEQ ID NO: 144125 - DNA, 369 bp, Homo sapiens
gtgcagtatagcgtgatgtgataaaagcctcagtcttgctgctgcttatcaattaaagcattcggctcaggggaatatggtggactatgtctgcctgtccctaaaacaaaagtgtatgaagtctgttgatttaaatttttaaccttaaacaataaaccttgaaccagtaagtgtttaacccaggcccaaaccccaaatctcctaagctaagaggacaggggcattcccgaactattactcatatttcaaaggtgaatcagaaaggttacatgtgtctaacctaggaaaatagaggttaagggaaacaaagctcttatgttcacagctaaaattataccaccttgaagcagaacactggttatctcacgt

SEQ ID NO: 144126 - DNA, 501 bp, Homo sapiens
ctttaaggcgttgtttgtggtactggctgggaatttgggactactaaagtgtctcttaattgctcttaagcatcagtttaaaaataacttttttcttagatatgaacataaataggccttttcctttttactggaaccatatgggacaacctttggttgtattagtcgctggtttaatgatctgatgctgaaaaggttgacttattttttctttcaattgatgacctgcacaactgtaggtaggccagtttatttcttgttctttgtaaaactaaaggctttgctctctgacttcttgctgaagtagcacatacccccttcagttaaatcaggggtactcaaaacaccatctggggaaaagccttggcatgcctgttaaaaaccttgctggtggcctctttaagaggaatacaaagcctgatggcctgccattgctgatcatttagggtaattattaagatgcctttaacaaaattcatcgaaaaattaactgacttgaac

SEQ ID NO: 144127 - DNA, 306 bp, Homo sapiens
cagggctgctcgataggcagtgtgcctggagtagccagaagaaattagaaattaaatttcttcttggtgttacctctgaatgtattctgaatatgccatatctcatctggatccaagaggtagctgatgggatttagccttggttttggaacatagtttttgtgaaaatgaagctaattggcctatggagagagtaaatctgtagtcgtcaaaaccatgttgagtttttttgagatagggtcttgctctgtctcccaggctggagtgcagtggctctgtcatggctcactgcagccttgaccttct

SEQ ID NO: 144128 - DNA, 322 bp, Homo sapiens
atgagaggaggatgattctggagggatggacggctgagttagaattaataaggtaaagcttcccgagggcaactgcaaggtatgctgcttaagtgaaatgcagctgcagcctgtgctcagcggcttggttcagatgaagacaaactgtggcttttagcaaagggtacacagagggaggtggaggcaggttttgtctttttagagcagcggtccttaaccaaaggtgagactcaaatgtgggagggtacttttattgtgataatgcttaggggaagagggcagtcatcagaagaatggggtgggattaaccaagcgtgggcat

SEQ ID NO: 144129 - DNA, 952 bp, Homo sapiens
tgagacggagcctcgctctgtcacctaggctggagtgcagtggcgcaatcttgactcactgcaatctccgcctcctgggttcaagcgattctcctgcctcagcctcctgagtagctgggattacaggctcgcaccaccatgcctggctaatttttgtattttggttgagaccgggtctctcactatgttgcccaagctggtcttcaatgcctgacctcgtgatccaccttccttggcttcccaaagtgctgggatcacaggcgtgagccaccgtgcccggccgtgtaagtgcttttcaaatgccagtttttgcagatggtagtagtggatacagtttttatttatggaaccttctgtggagtgtcaggactgcactggaggattacatggagtggatgtgtttctctttggttttttggagacaggttctcaccctgttgtccaggctggagcatggtagcatgatcatagttcactgtaattaactttgaactcctgggctcaagcaatcttcctgcctcagcctcccaagtagctgggactacaggtgcatgtcgtcatgcccggctaattttgttttgtttcattttctgtagtgacaggatctcactatgttgcccaggctggtctagaactcctggcctcagatgatcctcctgccttagcctttcaaggttttgagattacaggcacgagccatgccacctggctaacatgtttcttatattagatcaatcatttattttggctactaaagctaatgtgaattttcaatttattctttatatctgatatgaattgcattagctaatgttgaaaatcagtcatttgcactgaagaacctattgtatgcagggtatgagggggtggtagcggttgtacctactctcaagaaatggaatgaaatataataaaatgaacttactagacaacaatatcaattagtccactt

SEQ ID NO: 144130 - DNA, 416 bp, Homo sapiens
tgtacatgtagtgactccctgaaacctcatggcaaccaaactaggtaggcattattattgtccccttttacagaagaggtaactgaggcacaaaatgattaagtcacttgtccatgggatttagcttttgagtgatagagtcaaggtgtgaacttaagcagtctggctcaaattctgcaaagccaaatagtggaaagaaagagaataaagcaaatacactaggaacagatgacaccttccttcaaaaggagagaaggaagataggagactctccaggcaggaaagactgacagctgctgtgcaggcagaattaggaatttggtacctagtgccctctgggtagcagccgaccaatgtcaggcaacaccagtaaatgacatcctggtgttggtgtttatacagcatggctgggccag

SEQ ID NO: 144131 - DNA, 729 bp, Homo sapiens
atggaacattgcaggctgcagattgtagactgatttgttgttggtcatatagaactgggtcctgtctcagactatactaagctcagctagaactaaacaaaagttattttgattgcttttttacagtataacccagataagtatcacttgtaatcattggcagaaggaaataacattactaagaagcaaaaattaaatgatttcccacctgtctgaagaaggggagaaaggtagtcaataacaaaaatcaattatctgctttacagcagaattaaaaccttattttgaatttttggaggtatttatttacacttgttctaaaagtttgtgacttgacctcttctggaattcttagcaactaggcatagagctattccaggatcagtgctcttgggaccagatagaaagaagcatttggaagggtgctatggctgggctcagtagctcatgcctgtaatcccagcactttgggaggctgaggtgggcagatcacttgaggtcaggagtttgagaccagcctggccaacgtggtgaaacttcatttctactaaaaatacaaaaaaattagccaggcctggtagcaggcgcctgtaatcccagctactcggcaggctgaggcaggagaatcacttgaacccaggaggcagaggctgcagtgggctgagatcacaccactgcactccagcctgggcaacagagcaaaactccgtctcaaaaaaaaaaaaagaa

SEQ ID NO: 144132 - DNA, 249 bp, Homo sapiens
tgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcaga

SEQ ID NO: 144133 - DNA, 636 bp, Homo sapiens
cccaacaacagtctgtttaacctcttcccctaatgctgaactattgttgctttaagcatacattttctgtgtgtgtttcagatgtagtttccttaggaaagattctctatgctgtgcaacaattccccatgtgtctcttacatttctgcacatcttgtgtcagcgtttgttctagaccgtcttcataaggatgtttgtatagctaatagcattggaagatagggctaatatagtagaagacagatttatttgctgattaggattataacgataatatctccagaccaggcacagtggctcatgcctgtaatcccaccaatttgtgaggctgaggcaggcagatgacctgaggttgggagtttgagaccagcctggccaatatggtgaaaccgccgtctctactacaaacacttaaaaaattagctgggtgtggtggtgggtgcctgtaatcccagctacttgggagacaggtgggagaattgcttgaacccaagaggcaggggttgcaatgagctaagatcattccactgcactccaacattggtgtgacagagcaagactctacctcaaaaaaacaaaaaacaaaaaaagaagaagaaaaagaaaaagaaaaagaaaggattataatgacaatgt

SEQ ID NO: 144134 - DNA, 327 bp, Homo sapiens
tgctctagccaaaccccactgaccaaaccccggtgagttaccagctagcagtttcctcccctgggaccgaaaagcccaaggacctgcccagatcaacacagcaggagctgagatccatgcaggcctgttggcgctgtcctaatgctgctcctgacatgactccaggacctccattctgcccccacttgcagcctcatagcctggcatcaaaagctgcttaagaggccgggcgcggtggctcacgcctacaatcccggcactttgggaggccgaggcaggcagatcgcttgaggtcaggagtttgagaccagcctggccaacatggta

SEQ ID NO: 144135 - DNA, 154 bp, Homo sapiens
tctcattcctctcttactatgtcccaaatcccttcacaggctaaaagaaactcttcagaattaatcctattcataaagaacaccacttactgagtattgcattttcttcttcaaattcttcagcatacattgggaatacaccctatggaccatt

SEQ ID NO: 144136 - DNA, 857 bp, Homo sapiens
atgtgattgacgtcatccaggggctcaaagcaattgctttgtaggaaaggaagagattagctctggatccgccgacctctcttggcaggcctatcctttgagctcctttgcattggcagaacatgtatgtgtgctttctctgatcctgggaaaactaggactagacacaaaatacacagggaacttgctaatacctgttagagaggtggatttattcctttgaggtgggcgggaaaagggaaggtgatctcataccattctagtgtttcttagtcattggcaacctcctggtgagggctcacctcccatacccaacccctgtggcaaatgaaagagtctcccagacaagccgccaaaggaattcactgcttcacacagcacccacgctggctgtccacttccttggacattcttcccagggacttacctaaatcttttcagggacaatttcagtctaacaaactgacgtatgttaaatacttaaaatgtgcatggcattgtgctgagcaccattaggggaacacagcggtaaacttgggaaaccagtgccctgcttctgggttgcacttacaaggcatgagcaactgtaaactcctgcatgtgatgagcattcggtgaaatcattccactttttttctgtctccattattaccaatgtggtccaggctgccatcatctcttcttgcctagactactgcttcctctggtcttcccactttctctcttgcacctttacaattcattctctacccagcagcaagttatcttttcaaaatacactacaagcaagtcagatcatatcactcccctgcttgcaaccctccaattgattcatatactatatagcaattagtatg

SEQ ID NO: 144137 - DNA, 444 bp, Homo sapiens
atcaaatactgacatgccaggcacagtggctcacgcctgttattccagcactttgggaggccgatgcaggctgatcacctgaagtcaagagtttgagaccagcgggaacacagcggtaaacttgggaaaccagtgccctgcttctgggttgcacttacaaggcatgagcaactgtaaactcctgcatgtgatgagcattcggtgaaatcattccactttttttctgtctccattattaccaatgtggtccaggctgccatcatctcttcttgcctagactactgcttcctctggtcttcccactttctctcttgcacctttacaattcattctctacccagcagcaagttatcttttcaaaatacactacaagcaagtcagatcatatcactcccctgcttgcaaccctccaattgattcatatactatatagcaattagtatg

SEQ ID NO: 144138 - DNA, 922 bp, Homo sapiens
ttttgagacagggtctcacttgtacccaggctggagcgcagtggcatgcacgatcttgactcactgcagccttgacctcctgggctcaatccatcctcccaccttagtcccccaagtaagagggactacaggtgcttaccaccatgcccggctaattttttgtagagatagggtttcatcatgctccccaggctgggctcaaactcttgagctcaggcaatccgcccgcctcaagcctcccaaagtgctaggattataggcgtgagccactgtgcccagccagtaatatccttagtttgatgtatttggcttataagttcggtactgaatggggctttgaaggatggcctgtttctcactaagcatgtaaaatgtttagccctgtcatctgctgtccactcagcagcgagagggattctttaaaaatactaagtcaaatgggttcagaattctccagtggcttctcatctcattgcttaattgcctgtacagatctggctctttgttgccccgcctgtgatctcttctcccaccactgtccctcactttctctgttctgttcagtggacctcctgtattacatagtatgcactcacactcgtcactatttttttctgtgcttgccttcctctgttacatgtattcatctcctgcctctgatatgcaagttccttgagggcaggaactttgttttgtttactgctgtattactaactcttagaacaattatgacacatagtaggcgctcaaatatttttgaatgaatacattaaatttggtaagttgatatttattacagaggatatcctttaaatccagatatttctaataataaaagctaatagttattgagcatttgccatgtgccaagaacaaaggtgacaacattgttatgttcaattttcttatgaggaaattgggc

SEQ ID NO: 144139 - DNA, 217 bp, Homo sapiens
cagcgctgtacccgaggcagtggtggggtgacttgagtgttggcagagggcgaggtgaccaggggtgagtgcacctggctaagggtgggcgacttcaagtgccccatgcccggtgaccccacccgcttccgccggctctgtcacctgctatctcaggccctgcctcgactgaactaactgctttctgccgcccgccgtgccccgccccgccaagctg

SEQ ID NO: 144140 - DNA, 351 bp, Homo sapiens
aaaaataaggattcattgttgctgttgccattatccacattttatagataaggtgggaaacacctggagagattaagtgaccacccaagattgcccaagaagttaaatgcagaggcctgctacatgatgctgtcaggacttgactgaaaggcgcaagttcagtgtctcaggtcaagttgccaggaaacagaccctgagactctgagatttccatacaggaggtttttattgggaagtgctctgggcacaatacacagtaggagagagggaaacgggattgcacagggggagagactgaactgtggggcatgcacaacagcggcctcaacagggaggagcttggaagctggg

SEQ ID NO: 144141 - DNA, 610 bp, Homo sapiens
ccgtctttttccatgtgccttcacatggtctctactctgtgcctgtttgtgtcctcatctcttataaggatgccagtcacattggattagggcctacccataagacctcattttacttttaatatacaggacctgtctcgaaatacagtcatattttaaggcacatgggttaagacttcagcataacttcaatctatgaattttgtgagagacataattagcccgtaacaccttcttaatgtggacagttattggaagccagatgaaatttatgaaaaatttgtactgaaaatatttcaaaagtaacattttaataattttcaggtctatatagttaaccttgagctacctactttaagatgttgctaaatagggcatgctttattaaatagatattttatttgtgattactgcattgtttactttttacacacttaacagattttaaatcaaatcgataagcatattgcatctcctttatgggtaaatcatgtgccccagagaccccaaaatcttgatgacattctgtgaagttatacaaatatatctaaagaaacatatctgttcttgttctgatttcaattctaaataaaaatccaatttcaaaatc

SEQ ID NO: 144142 - DNA, 318 bp, Homo sapiens
agttaaatgggtgcactggatgctataatctctaggtttcactctgacactaagaatttgtgattttttcttctgattcctggtccaagggttccttctctcctggagatggagacaccatgaccactctcatggatcttttcttcttggaagaaggggtgaatatagagaatgacaaagaaaaagtgagatgacagtgatcagtgttatgaagaacatggcttgggtagggctggttccttgtattgagtggtcaagaatcaagaaggtgaatctgcagtcccatctgttcaaggtgcagcagaaagaagtgaagcc

SEQ ID NO: 144143 - DNA, 316 bp, Homo sapiens
tgaagacgagatcagaagactgtgtatgcagttcagcatttagaagttggggtgatgagcaaaagacacttgagaaggcatatccagacatataggcaacctaattaatggtggctgtgtgtgtggtttaactttccttttaagagttagatggaaggaatcttaagctacatttagtctgtctcattttgtgaattagatttttaaaaaaggtcatgtggacagactagtggaatagaactaaggtatagacctaagagcatattgaaacagtgtatggtaaacttggcatctcagagcactggggtaaaggtgg

SEQ ID NO: 144144 - DNA, 332 bp, Homo sapiens
tgccttcccaacaagttataagcccttgagggcacacagctcgtacttgcctaaatgaagtgcttgcacataatatatgttcaataagtgagccttgaatggaagaacagagaggggaagggccagtccgggcaagattttaaaggaagagtagaaatctatctcagagatggcttatagacttttctatctcctagcagaaacaaagtccagttacaaaaaagtatacatttttcaattaaggctaaaattcctaaactggctacacattagggagcaaatttcttctctttatcagggatgggcaaaatgtgtcatctatggtcataata

SEQ ID NO: 144145 - DNA, 617 bp, Homo sapiens
tgctcactccttgcacaaaatatccactggattcctggtaactactgaaaaaaatctaaactccctattggaaaccaagatccttcacaagctgatcttaacctacctcttgcttcaccaatcactcgtgcactaaatgctcaggcaggttgattatcccactctccctaagtatgctaaagcttctcaaagctctgtattcctgtactgaatcccgaaattaccttctccttttgagctcagcaaattccttttgatgctatatgacccagctcacatatttactcctttataaagcctttttgttgccctaggcaaagttagttattttgttataaaggaggcacataaagtatttgttgaatggatgttcaatgtatagaggagtaaaagtgatcatctttgtatatccaataccaacttcagtggtcaaggcagcataaatgggtactgcaagaaggaatgaagcctcatcatatcataaattccttcagagcactggttttgacagatactacttcatcgcaaatatctcacagttacttgccctcttaataataatcgtgcatgttgccgggcgcagtggcttgcgcctttaatctcaacactttgggagg

SEQ ID NO: 144146 - DNA, 114 bp, Homo sapiens
cgatagctcaacctctttgatgtccagaccaaatgtggcccactttcctttgggcatcggtgcctttcagcctgtttacctggaggcggtggttctctgcaacatctgcctatc

SEQ ID NO: 144147 - DNA, 293 bp, Homo sapiens
caaaatgctgagattacaggcatgagccaccgtgcctgacctctaacttttcattatggaaattttccatatgcacaaaaatcagggagagaattacaccatgaacccccatgcacccatcatcccactgcaagaacttgtcaacatttcgccaatctcattccagttcccacttttcttttccttcttgctattttaggatattttaaagcaaattccagacatttcatttcacccacatccataacacaccagggtgcattcttgatgtaaggattttgttttgttttata

SEQ ID NO: 144148 - DNA, 181 bp, Homo sapiens
cacgctccaaaaattttgatgccatcctcacaagattatactcataaagaaaagagctgagaaagaacattcccaaaactatacccacctgggaatctgcctctcgtcttttgtatgggtttgtactgttactttggtagcatgatgtggtgggtatagttttgggaatgttctttctcag

SEQ ID NO: 144149 - DNA, 202 bp, Homo sapiens
tttacattgatttgagatgcagtatgctatagtgaaatgaacaccagactgggagttaaggatcccgggttccagttgttgtaaccataactatttgtctaactttaagaatatcactgggactctgttccaagatggccgaataggaacagctccattctgcagctcccagcatgaccgacgcagaagacaggtgatttct

SEQ ID NO: 144150 - DNA, 254 bp, Homo sapiens
ccacattattcataccacagttttgccatattttcttttcagtttttagggtatcacgttcctttttttaagtcagaggtatcaatatatatatcctgttgtaatcttttttaagtcctataaatagattgctcttgtgttactggatatatgtaaacaattacagactaaactgatcgtgtgcatatataatgcaaaaaagtacacgtgaagatattcttatacaaggtagctcctgaattcaagtcaaccac

SEQ ID NO: 144151 - DNA, 203 bp, Homo sapiens
ccctgcccgctggccatgtatacagcaccctgacctctgtgggcagcttctgtcacaacagtgttgggcttttgtgagagaagtaagggataatagcaaaaagcgttaagaacccaaggaagatgtcattcaaaagagggggttcctataacagtcaaactcatggaaacagaaagtagagtgccaggtgccagggtctgggg

SEQ ID NO: 144152 - DNA, 469 bp, Homo sapiens
gatgcggattcttataaaagtttggggaggtattctctataaaggcaggggttgcagaatgagagactccctgaatcactcatgcccttgaggccagctttgaccaagacacttgaagatactcttagtccctgggttccttcatgtcagaactagcaaatccccaaatcccaggatggagctgggggagctggggcaggagggctttgccgacagaaccatatctccagcatgccctagcaacaagcatccattccaatctctcagatatccagaactcgagactgcagccccacttagtacccactgatgagaccagcgagacccttagtagtcaataggcttagtgtttcctcgagatttggggcaactggaaggaacctcagattatcagtccaatttcattttacagaggagatggcagatggcggatcatgaagtcaagagatcgagaccatcctggccaaca

SEQ ID NO: 144153 - DNA, 1157 bp, Homo sapiens
actccagcctgggtgacagagggagacttcgtctcaaaagaagaagaagaagaaggcaatctcaaaagccagtgtacatgttaggcagcagctctcatgttggtgaatttcagttttgtgccctaagtctgtaagaaaggtctatgtgtaccttttggtcttggaacttggtagttttgtcatggaaaaaacactttatctgctgctgtcctctgtcagagtacccaggcactccttctagattctctctagactgagatcctgagttattttcctgaagccctttgttcctcaacttctgtagtcatctattcttgagccttgaccttggttatttgttctggtgttctgtgattctgttaattttttctgtcatctcttttgttagggccctcctcctttctagggtcccgatgacaccttcgtgattctcagtgctaccctagtcacagcctatcaaaggtagaaaaactatagtttttcttcagtgtttattcaattctttctactctcactccccttttgtattttccttctgactcatgcctgccaagctgttttggcctctgacaacagttgttctctcatcaattatggtgctccaagtattcatcacttcatgcctgctgatgtctgttcacaaatattcagattttttttacgtgtccagcctgcttcctcttgttttaagtgtcagtgtctttctgtcattccttttttctctgtcttacatccctgtgtatcacatccattcagatcttttacttccctcatctctgcaccccagtaattctttgtcataatttcttagaagtatagtcaagaggagactttcagagagctgttaattttatccctttatttaacagataaggacattgtaatccagggggagaaagtgacttacccaatgttgtaaaattcatttaggtgtaggtcttgagtcccagaatatagtctctccatttccttaaacctttcctgtcattcctgtcttcaaggacccgttggtaaacacctccatgagcttcctgtagactccagaaattagtggtggtagtgtgctagtgtggaagggggaaggggagaaggtgttatacaacccagtctatgacatcttttcctaaatctttttacctgtggttataatttgttta

SEQ ID NO: 144154 - DNA, 436 bp, Homo sapiens
agggcgagaccctcaaataataaataaataaataaatagttaaaccaactttgcactcctgggataaattccacttggttgtggtgtataacactttttatatgttgcaaattttgatttgctaatgttttgttgaggatttttttgtgctggtactcataaatggtatttgtctgtagttttcttgtgatatctttggttttcgtataaataatactggcctcccagaataaggacgtcttctctcttctcctatactttgaaaaagtttgtgaagaaatggtattaatttgtctttaaatgtctgacagaatatgccagtgaaggcagagtgtggtggctcacacctctaatcccagcactttgggaggccgaggcgggcagattgcttgagcccaggagttcaagaccagcctgggcaatatcatgagacccc

SEQ ID NO: 144155 - DNA, 821 bp, Homo sapiens
agcgggagtgaggtcagagatcccactttcactcagttttcttgttttttgtaactaggagtcaaattattcacattactttcatgcagttttgtttagcttaattgtatactgaaagcctggcacacataattaatcaatgtattgctagtgactgttgaacaacccgtatctgttggaaatgttattgtaaaatgccagatgcaaagggaaggaggacagaagcagctgagaaagaaaaccatgccatttttcctcagatgagcgttatcaaagtggtcatgtgtattgagagaaatcaatttggctttacagatttgtcctcacttctggaaaatccaaaatatatctcctattgttcttttgcctgccaggctgacacaccaacaagagctacctcctatatttttgactgcaccttatacacatttaaaaagtgcattgttttgcaggccacacaggagtactgggcacaactggtatgattatataatccaatgcttcaatttcaccccagcactcagtccttattcttataccctctccctaatttgtatgagaaatatgtgaagggaaaatggcagtccaattttttttttccaataatggcctttcattttcagtttccttagacttcatggacttttcagtaactttgtttcaggaatgcgtgaaaattgatttaagatttttaaaatttatttcagtatactttgccatgaggaattgatattcagacattagcaatctagtatctttttgagcacccctgtcaatgacagagttacattgtctgtcatttgactgcctttactgagtgc

SEQ ID NO: 144156 - DNA, 746 bp, Homo sapiens
cacccaggccggactgcagcggcgctatctcggctcactgcaaactctgcctcccaggttcacgccatcctcctgcctcagctactcaggagcctgaggcaggaaaattgcttgaaactgggaggcagaggttgcagtgagccaagatcacgccactgtactccagcctgggcgacagagcaagactccatctcaaaaaaaagaaagtaacatttttgtttcttagaaaaggagcataacaatttagcctttgaaaccgagtagcttagtcaatcttaggctaaaatatccaggcacagacagaggtgagaggtggcaaatgaactatttgagatcttaattggaccagaaatagaaggcagattacagttttacctctcatttactaaaaacaaaaataacagaatggaattagatagcatttttttcaggttgaaacaaggccactaaaacattagtaggcaaatagaaatttggaaaactctgggaagagtatccttgaagatttcactgcatatacttgaaagcaaagtaggagagtgggagattgcaagcttttcaggtggtctttagaaattctagtcatcctttttttaaatataaataaatctccattttaatacattaatgtctaaagtataccgaaaaaaaagtttttttttgttttattcctttattctttgtaaagaatttccaccatcaataggtatagtgaaattttatctcttagaaaaggagcataaaaa

SEQ ID NO: 144157 - DNA, 277 bp, Homo sapiens
gggacttcagcccatgtgtcatctccttagaggcctatagtgaccatctaaggcaatcctgtctatctcatgctcttttttcctttttcacaataccttcttcatttgctgcatagcatttgtattaacatttatttatttattcctcggtctgtctccctacactgtaaatccccttactagaccataagctccaagtgggtataatatagcatctagtaaagtgctaaacacagtaaatgctcaataaataattttcaaaaaaataattcattcc

SEQ ID NO: 144158 - DNA, 1105 bp, Homo sapiens
ggtacaggttctgtaagttacctatttttttggactttataagttatcagcaagcttcttgttagtaaaggcatgataatgaaacttgaattcatctacaaaattggatgtgcccatcaaggggcctctaaaccaatttaagcccaaagttaactaattacaatttctactggttttagtaaaactagcatagtcaaccaagtaaacaaagtccattgttaatcttatttgagttagctaacattacattctagtaatgggtacacctaaatatatcatgacttgagtttcattacattcagacataaactacaaattcctaatgtgcaaactattgttgacatttttcttaatcactgatgtaccataccagaatttccatgttttgtttgtacattaatcagaattgagttgtaatactgtatgtgccttcatccaagaaaaattttacataagcatttctagtgcaaaaaattctgttatcctggattattgtacgtttgctatatcaaacagtattgtggatgtagacttgaataaaggggtggggactgggattaaatatattcaagtaaatctttaaaacaaaagctatctgcaaatttgatcaccatcataataaggtctgttgacctttttagaagttttaaaatatgagtccttttgagctttcatgtaaatcttaaatggaccaaatggactgagtgatttgaaagctaaagtgaatgtcactagtaaggctgtatacaaataaaatactaatgtaatctattaaagtgatgatgaatggctaaaagggcaagttcttaactttttaactggaaacgtaatgatcttggcaagctgttaatgtctgtcccatcttaatttttttttgtgtttgaactgttggtaatgttaattgcattctctcattttaaaatgtattggtttttctaaaagtattcaatatctaagttcaaatagataatattttaatgagaaaataccaatattgtaaatttcagtatgtaaatacgttgtgcttcatattctgtaatttctacctctattctcagaccactctgagcaaaataaaagtagttcagtgctttacgattgtaca

SEQ ID NO: 144159 - DNA, 201 bp, Homo sapiens
ctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctact

SEQ ID NO: 144160 - DNA, 312 bp, Homo sapiens
gtaactagtgctgccatgaatataagagtgcagatacgtcttcaacatggtgatttcacttccttttggtatatacccagtagtgggaatgctagctcatatgtttcatttttaatgtcttgagaaacatccagattgggttttttaagttctgggataagcgtgcagaacgtgcaggtttgttacataggtatacatgtgccatggtggtttgctgcacctattaaccctgtcatctaggttttaagccctgcatgcactaggtatttgtcctaatactctcccttcccttgccccccaaatccccaagag

SEQ ID NO: 144161 - DNA, 270 bp, Homo sapiens
tatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcc

SEQ ID NO: 144162 - DNA, 756 bp, Homo sapiens
aacgtattttaatactttaacttttagaaatatagttttagaaagtatatttagaaatatagtctcaaaaggttataaggattacattatataattatatttttattaactgtataaaacattttttcagccaactgacttactaattaatggtttaagtcttttcagctaccgtatgaggtggttctggccttgtactgcaaagaaagaagtattgctctttcagtaatcagattgccatacatgtagagtagatttggatacttgcattaatactatgttcttaggaattcagaagctaagaaaacgttgcattcctatgtgaatgttttctgccacccctttgagttggaacacacgtagaagtgcgtttctaattctttagctgatggtcttttagcttgcttatagaattctttaagtgacatgaataatgaggtcttacagcaggtgatgacagtaaatataactataaagttttatgccaaaggggatcattgagatgcaacatcatctagtcttctagttttgtagatgagaaaatagttcagttgagtgaggtaaatgatgtacttaataccacaattacgtagaaggagggagggagaaaatgtcatacaagcgtttttcacaaaatcatgaaaagattcaggttatcaagtttcttgttaaactagacttctctcctctactcctttttagatacactatcagtcaatagccagtcaccagtattcctgctagtctcttcctact

SEQ ID NO: 144163 - DNA, 204 bp, Homo sapiens
catctaaaatctaagaggacctacacacaatgctgatgtgactaaaaaataaaataaaacctaagaggatcactaacacacacagctctaccttttgagaaaaatctatgaagttatatcatgtgcattttttccaagacagtatacattgctctaagttaaaaataagcatttgcctgagatttagaaaataaaacggaaatg

SEQ ID NO: 144164 - DNA, 382 bp, Homo sapiens
cctgtggcctggtgtcggggcagggcggggctgcgtcccagcatcagaagggtgggcagggctggtggctgtgctgttggctggcgggcaaactggagggaagaacttcccttgtcctagggtctggctgtcactcagctttctctcctctagtctcactatgggcttttgccaaacgtcatgtcgatatagtcccttcaacaatctgttgaaaaagcccccccttgagagaactgctcaagcttctcactggtttcctcacaagggtcattccagtttccggagcagtggactggggaggggacagggctgctcaggcgatgatgtaggtgacggagccagttttggtgttcaacagttgtcatgttcttggtccgtattg

SEQ ID NO: 144165 - DNA, 229 bp, Homo sapiens
ggtctcaaacttgtaaataggcaaaacaggccaggaggagactgtgcagaaccagccggggcctgccgtgtctaaagctggcagccactcttcagtgtagcccatcatggcccattatgttagaagacgaacgcatctaacagcttctcgggagagtgaggaaatccagcatttcctgtgaaatctccccatcattaaatgttcatatcgagtccaacattttctgaaa

SEQ ID NO: 144166 - DNA, 108 bp, Homo sapiens
aatgaatgtctcaggagcaagatcttttacaatctcagtacaagagccaaactgctcctgtttcagggacagaagtcattgaaggctctattgacctaaatagaaaag

SEQ ID NO: 144167 - DNA, 825 bp, Homo sapiens
agcgggacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactgtcctgctaggacctgcttccagaagagttgatcccagccgtgaaagtgcatgatgccttcagcgaagcaggcaggaaaggctcaagtgatcctcctgtatcaccctgggtatcaaggccattcagtggaaaagaacagtctcttcagcaagtggatgaagttagatctcttcctcacatcatacagaaaaatcaacctcaaatggaagaaatatctaaatgaagccgaacacttgataaaaagttcatcagcgtaaataagaagaatcccctccattacatacaaaagaaaaaataactggagagatcatctctgctctaagcgtgtttttaaagtctctgcagtcttggaccaagctcgttttattccctactctacgagaatctcaagagcaccaggattctgtttggagttgccatggacacagagttcttaatccagtactggcttattctcaatacgaggtaaa

SEQ ID NO: 144168 - DNA, 808 bp, Homo sapiens
agcgggacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactgtcctgctaggacctgcttccagaagagttgatcccagccgtgaaagtgcatgatgccttcagcgaagcaggcaggaaaggctcaagtgatcctcctgtatcaccctggaagccgaacacttgataaaaagttcatcagcgtaaataagaagaatcccctccattacatacaaaagaaaaaataactggagagatcatctctgctctaaggtgattatcctgtggtctttggttttggtacgttctccccgaccccatgcccttttccctcatctttaatgagtatctgtatgtgtggcagaacagcgtgtttttaaagtctctgcagtcttggaccaagctcgttttattccctactctacgagaatctcaagagcaccaggattctgtttggagttgccatggacacagagttcttaatccagtactggcttattctcaatacgaggtaaa

SEQ ID NO: 144169 - DNA, 404 bp, Homo sapiens
tgaaaagagctgagaccaagggaaaccataatggggccagagcatgcaagaccattgcaagaagcatcaagggcttggagctttatccagaagacaggagcagccattgagagggcatgctccagcttttgttttagcagaatctctttgcatgtgatgtggaaaatgaattggagaggggaaccaggaaacctgttaggaggctacttctgtaatccatgaaatggcaatattctgcttttatgtccctgagaagaaagcataggtaaggaccactgaatacacatttggtagaaaaagaatattccccggctaaggattgggaagataaaacaatcaggaccacccacccattacttcattttcctttatgtatccgatcaagtaccctttctaaaagaagg

SEQ ID NO: 144170 - DNA, 886 bp, Homo sapiens
gttccttctacatctttaattcgagtgatcacacactcctccttcgcacagtgctgtgatgggccaaggccaagaccatggcaaagccatgatcttcatctggccagaaaatagaaccaaaggagttcttagcatgtcttgtcatcatcagacacagctgtagagtagattcactgtaacaaactttcattatgactttgccccactaggggacaaattcttgcagattttgctttcccgttagccacatgacctcatccattcccatgatagtgtttatcacttatataaccccttctatattagccaaggatatcctaccatgaatcctcactgaagcaaataccttccacagtgaccttgaagcagctttccccctgcagcaatggttaggaaagtatcgtttctgtcttgcccacacttgcagaccaccttctgggagatatgcaagaggtctgcctccaactttcccacttcttctccattccattgctcaccctcctcagataacatttctagtgtccttgtcatttcaagcccagatcttaattttaatctgatgtcactggggggaaaacatgcttaggagctagaaaaaagaagatcaagcaagtcctgagaataaagcctttagaaatggccctgggcgtgacctggcccaggttatgtcctattcctcccagaagagaaaggccacccctggtgaagtggcagggaaagcagtgtgactcggggtagctttgaaggccaaggaatgaatgtctggctctctcttgatctttcaagcttacagtctgtcccctaatacacaagccaaccagggactgtgctgccattgcatgaagtcctcggtgtgtgcacctgagtagactgcatttcactgaaa

SEQ ID NO: 144171 - DNA, 726 bp, Homo sapiens
tagctgatgagcacatttcttattccttactgtagctcttctattcagaggtgtttggtcctgaagtgatcattttctttctacagtcagtgacttttcctatttctcccttaagagtcctcattgctttatccttgattttaggtctgtataaacttagctggacaataaatttatcaggtgtacagctcatttagtgattctgttctgaactacagcaatactttcatattcttcctacttatttgtgaatatttatcctttattatgtcatttattaacctattttctttctctgcagtcaacttagaaatcttttataaaatatttgaaatattttacagaaagaagcaggatagaatcactaaatcttttggagattctggtatttcttttctcctacttttataatcaagtggttgttgacgttttatgaatttgcgtaggttactataacagacatctctggatcatgcacattatgatcagcctttcttctttatctgcataaataattaacttagttgagagaaatatctcctcgaaatatagaggccaccagcttaacatatctcaacctatttctattttaaaaaatatttgtgtgcatatagatgtaaaaaaaccctgaagaaatatagtctgtgttgctgtcagtacatgcaatgtagagttcatatagaattctcttagcccctgagagtattgaaagtgttaatgttgggg

SEQ ID NO: 144172 - DNA, 682 bp, Homo sapiens
ttgaaatgaaaggtataaactctcggccaaaaatagagcatataaagagaataaaatagagatttcagagctaagaaacacagtaacagagataaaacctcattggatgggttcaatagtagaatggaaatgagagaaaaaacgatcaactttgaagattattcaatggatattatccaatctgaacatagaaaagagattggaaaattatctaattctcagcgacctgtgcgacaataattaaagatctaagatttatgtcattagagtctcagaaagagaggaaaaaagtatagcgcagaaaaaatacttgaaaaaataatggctgaaaaattaccaaatttggtgaaagacgtaaacctacaggttcaaaaacctcagcaaactctaaacaggataaacacaaataaatcattgcccagacttaccataatcaaactgctgaaagctaaagttaaagaaatcttgtgagtagccagagaataatggcacattacttacaagagaacattgtgaatgactacagagtgctcatcagaaactatggaggtgagaagataatggaatagcatttttaaagtgctaaaagaaaaaagaattatctcctgggtcttggcacccaaaattctatgtctactgaaaacatccttcagacttggaggtcaaataaatattctcatca

SEQ ID NO: 144173 - DNA, 510 bp, Homo sapiens
ctacacccttaacctgctttctaaaatcactgagaactgtccctttctctcagtaagtcttttcttattccaattccactttaatttccaccagcttcatcttccagcatgcaatgggtctggggctttgatccataagtcaatcatcggagaagtttagcctagaagaacgaagagcagtaggctctgcagtgtgcaaaattgttggcttgcaaaatacttatgttttcacatcattacagaatcaattcccgccctcataaaaagacctgaacaagagaccaaaaaatccctgcacgggacaacagatccacagccaaaaaggccaagataaaacacagttgggtccagactgtgcacaacactctgccctctactttaaaaggccaaagggggattgtcaaaccttcaaggtcgcccaaaatacagacactgagaataaggataaatatggcctaaaataggaatgaacagattccactgaagtaagactaaataaggaagaaaaaa

SEQ ID NO: 144174 - DNA, 322 bp, Homo sapiens
tatattagtgaacttgtccctgcagatttcaacatgcatcaaggctgaggggagagaataaatataatttttcttctgaattagtatttgagtcccgaggtatctcacagatgaaccattacctttatttgagctcgggaaagaaaactctccatttatgggcacatatcccagtgagctaactaataaagtgatcatctttagactgccacaagcacttttggcaaagcagccaaaataattctttaccacagagggggtgaaagaggagtatttcaaagaatctatgcacttaggacataatatttacaaaaagtgctat

SEQ ID NO: 144175 - DNA, 146 bp, Homo sapiens
ggaggccccaggcccggtcacaggagtcactgtccctcctgcaggggctgggctccccagtggccagaccaggccagagccttggggttgtgcttttggctgggacctagagcccccagcatcctagacctgttcctcctggaagc

SEQ ID NO: 144176 - DNA, 257 bp, Homo sapiens
gctcctttcttcctctatcctaaccccaatctccaggttgccttcaggaggtcttcgccggctttaggtactccttactcgcactcaggagtcccagcctgagtcctctgctgcctctgtttccctgttgactctgggtggagagagagagagcaggaagcttgcactaaatacatgagcacctggtagtgcatcccttctggatccaaccagaggagacaagctcccgcctaccctctctatatcacatttgccca

SEQ ID NO: 144177 - DNA, 276 bp, Homo sapiens
atcctaaaggtagtgatgcttagctcctggtgtacagcttctaaagatgaaaaccaatagctagtgtgtagcatacttcctgacagtcatggaattcttctcttctgggctcccaaggcctggacaagaagttgaaccatgccacagactgactcaaataatgcttttagaattctgatatattcttccaaagcaagttgtaatcacacaagtattactattcttgtatccaacatcccccaaagatgttaatcactcaaactactgggtagggca

SEQ ID NO: 144178 - DNA, 185 bp, Homo sapiens
ttgatgcgtgtttcacgaccacgtagaacactgcagcccccggaatccctcctgtgtgcccctcctgtcaaagcagctgctaggagaagctagcatctaataccatagattagttatgtctgtttttttaactttatgtaatgcataaggaaattacacagagtatatgtcgtcttcagtcaggc

SEQ ID NO: 144179 - DNA, 435 bp, Homo sapiens
ctcccactgagggacgttaggttatcattcgtacttttataaatctaaaaattgccttgtatacatttttgtacacttacactttagaatctttaaaaaaaattgggtacctttctgttgtgaagttttgcttttagtggctttgttagagtgctgtgaaaaactagatggagaatagggaacatgtctctgaaagtctgtgccatatagggctggaacttgagcagtatgagataaatactggcttattttcagatttttctctgctcaagggttggcctactaaagttgtttttatgtggtgtttggtgcattttctttttctttttcttttttgttttttttttgagacagggtctcactctgtcacccaggctgtagtgcagtggcatgatcatggctcactgcagcctcgacctcctggactcaagtgat

SEQ ID NO: 144180 - DNA, 664 bp, Homo sapiens
ctactaatgtccgttaccctaagttttggtgaagattagttttttctatcatttacatctgccttagatactttatatttttaggaagtcgagtaatacagctaaattacgaccatcaaaatccttatcctgtgatgttagagtcaaggataagatgtcatcagaaatgctgagggaagtgattgtcctcctaagtcattaaaaagcctagtgctctagagcctcagaagctgatgttgatatagaattaggtacttccatgctttccaggtaagttgtaaacctcttatctgtgtttgcttcctttaatcaggccagtaatatcttccctttgttctagttttttattccccactgtggtttccaggtgagagagtgactgtattcatcataactggacttaaactgattccatatataactagattaaagaaaagcattttataacaggattttggtatgccatatttcagcattatattgtttcttattgtaaatagccaaatttgaaatgtggcttatgtttcaatcacaagagaaataaacaaaactattaaatagcagtgaaactgaatgctctgggaaataacttttggggaagtaagagatatggcttactatttacaaaatccctgcccccatatacatgtcacttgttagggta

SEQ ID NO: 144181 - DNA, 267 bp, Homo sapiens
ggactcaatgacataatcggctttgcttttcactcagttgcttagggcttataaaaataaaacacaaatacccacagctgttctaggcaatcactcagctctttggaaagaaaatacagatacagagacaggtggttctgctctaagcacaacattcaaaattaagagtggagagactgcagctgtgtttccaggagaaaactagcaaactccaagactttctatgctaaatacagttgcatatggacacccaggatcaagggagtg

SEQ ID NO: 144182 - DNA, 535 bp, Homo sapiens
gcccattcacacctgtttccctctgcccagaacagacctaaataccaaaaggaaaggtggtattcctacagacagtgctagcatcttggcggacaaatgcttagtgtcattttggccccatgaggttgtggccacccaccactgcttggcccgtcccttaccatcctcaaattgtgcttgagtagactgtagccccttttgggaccttgactccaagaaagcagatagacagatagagaatggagcaaactggaagataggggataatgggacagcctcaggcaaagaccagggactgctgaatctcctggcagggtggggattctagcaaaggaggaggaagcagaggatggaggtaggctgcagtagtaatatcaggccaggaggtgttagaagtgcaaattcttgctttcagccttctcagttaaatatcatctctatttaattcactacatgaaagcaagtcacaggcattaatagcagtgatattaacaataaatccaggatcagacacaattctaagacatttgagtct

SEQ ID NO: 144183 - DNA, 714 bp, Homo sapiens
tgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcaggggtggattgcaagtgtct

SEQ ID NO: 144184 - DNA, 250 bp, Homo sapiens
tgaaactctcttaactgcttctaaaaaatatgctggtgtcgccacttgaggagttttcagtctagggcattttctatggacttcccagtgtgaagatgaggacagtgttctcttccaaacacccgccccacgctcccgcgaggctcatcttcccgccccagtgtttgatgacttggccatccgcgcttacgttattttgaccatgtatatgttattgagagttgtacaatatagtgtactggggctactt

SEQ ID NO: 144185 - DNA, 340 bp, Homo sapiens
ctcatcacttccgaggcctcttctgaccatcttacctggctgtgaccctccactgctcaaattcccccaacggggctccatcttccaaaaataagatgcacgttcctgtacttcatgttcaagcctgttgatgaccaaacctgatacactttccagcttcacaggctatggctccccctctgccacaccaaactcatcacagttacccaccccctgccacacacacacaacctcagttattaaacacgtgtaagtcttctgacggccgctccctgagccaatccggatgtagctgacacctctgcagagctggtagactatgacaaagagaagccctcct

SEQ ID NO: 144186 - DNA, 786 bp, Homo sapiens
tagagtggttttcattgtttcttctgcttggagtcattgagattcttggatatatctgaaaacttgatttacgtattttttttctggtttactagctgtttacagtgaaagtgcaatgcccatggcagatgtcttagtctgtttgggctgctataacaaaatgccatgaactgattggtttataaacaacacaaatgtatttctacagttctgaaggctgggaagttcacaatcaaagtgctagcagatttggtgtctggtgaggtctgctttctaattcatagatggtgccttctcactgtgtccttacatagtggaaggcatgaggcaactctccgggacttcttttataaggacactagttccattcatgagggcagagccttcatgatttaatctacctaccaaagacccactttctaataccataacatggatgatgaggtttcaacatattaatttgggggaaacatgaacattcagatgataacagcaggtaatatttcatgtgtggaatcagaagtcttattttgttattattggtagaagatggctttttcacttataagtcataaacatgttattaattatgtcttccaaaattttcagattttgttgtcaaatttgagaaaacttctctcattttttcttgacttaaccacatactttcagtgcccgacaccaaaggacctgttcatataccatgaccacctctggccctgcatctttgtgtcatgattctagatgagtcagtactcagggtgatagaagtattgctagaagcca

SEQ ID NO: 144187 - DNA, 220 bp, Homo sapiens
tttataaatagaatgcacatgatgtgacaccccatttttcaattaactaatctcattttaaaaattttcctgtttcctcacctccttattttttctctattttcttccacagaaaaagatttagaagctaccacaaagtctcaaacatggtaaatgatctggttagtttaaatatatcatgactggccaggcgcggtggctcacgcctgtaatcccagca

SEQ ID NO: 144188 - DNA, 533 bp, Homo sapiens
cggtcatctcggcctttctgcctctttggcacccaaccctcaggcacctcagttgttgggaaaacccactgtgtgctttgaccgaggcgggagaaaaattctgtcaatgaatgggaaattctctcaaatgttttgagatattgcttacacgcaccgacgtgcacaaatattaagcatatagcttgaacttttacacgtgcacacggccaagtgatcacatcaccagatgaatggaaaatttccagcataccacaaggctccttcctgcccctttaagatcaccaccccctggtaagctaactgctattctgacttctctcacatggaaaattcctgcctgcttttcacgtttacacaagtggtatcatagaacagaatatgtcctctggtaacagtctgtcttctttcactcaacagcatgcctaacactcaaactttaaaaggtatatattaaaataacacctcagttcacttataatgggctcccgttatatgccgggcttagaacagtccttgtctttaatcctcacagc

SEQ ID NO: 144189 - DNA, 364 bp, Homo sapiens
aagtttaaaagtagaaggtaacgaattgaacgtactggcatgttgattctttgaaaagaaatttagaattcgtatctaacaacccctcctcttgcatttccttacagctctttcttttcaaactttttaacatgtctttgcttagctgttctgcttgattttccaaaagaagaagcttctcaggataaggtggaagatagttaagggaggttttagtaagtgccatttttataagcctctgcaccaacccacagatgcatggtgtgacacagcacctgacaagaaaaagtacacccattacagctgtgagggaagtaagaattgaggctaatattctttccatttacccaaccacttttctagc

SEQ ID NO: 144190 - DNA, 391 bp, Homo sapiens
taagccttccctggatacagtggtattgaccgcgtatgcatcatgctctttgtacctgactactgtgttgcaagacgtagtttctataattatttcctttttgtttttccccaaattctttttgaaatggtcagcctaactcagctggaccttaaggacaaggaaaggaactggttcattcttaggcgaaaatgaaatagggactttgggggcagggtttggtgttggccccaggaatctcagtgggaaaactccaaggaggaagaacagctcatgctaaaggcgtcctcgtgcctcttcaccggggagtctccttcctgagctcttgcctgctcaatggtggattctgggtttggaaaaattaaagggaatggttcctcctcttagcagg

SEQ ID NO: 144191 - DNA, 407 bp, Homo sapiens
tttcttctagctttggggtttgtttgttcttgtttctttcactcctctaggtgtgatgacagattcttaatttgagatctttctaactttttgatgtaggcatttagcaatataaactttcctcttaacactatttttgctgcatcccatagactttggtatgctgtgtctctgttttcatttacttcaaaatttttttaaatttctgccttaatttcattgtttatccaaaagtcatttaggagcaagttgtttaatttccatataatcaagtggttttgagagatctgcttgaaattagtttctatttttattccactgtggtctaggaatatggttggtatgattttgattgttttaaatttattgagactcactttatggccaagcatgtggtcaatcctaga

SEQ ID NO: 144192 - DNA, 249 bp, Homo sapiens
ctagatgttcttcacccatctctgaaatttgtagagtctaaactattgtatactggaagtcttatggaatagtctttttaaaataacatttgctttgtggacaaagagtaaataatgattaaataagcaggagggagtagggtagagagagaaggcatggcacatgactggcaacccaaaggcttcatgttggtggtttcattctccaggcttgccaacttctactccttcaatgcagacctcaacttc

SEQ ID NO: 144193 - DNA, 275 bp, Homo sapiens
taaaggaaatataggagaatattttcatgaccttggatagaaatcatgttcttaaagggggtgaggggggaagagacacaaattataaaggaaaagattcataaattcatctatactgaaatgaagaatttccacatcgaaagaaaccatagagaaaatgaaaaagtaagccagagtggaggtggaagaagatatttgtaacacacataaccaacaaaagttgagattcctgggtaaacaaagaactccaataaatcaataaaaaataataggca

SEQ ID NO: 144194 - DNA, 221 bp, Homo sapiens
tatccctacattctcacaacagccttcttacctcgggtgagagtcatgagcaccttaccaggcagggagcttccccaggatagtgtggtggagtcaggactcactccatcctgcactttacccacaggacacctggagggtcccccagccctgcttgcttttgtgaacgtcgtgtgagtacaccgaggtgttgcagctttccttccctctagctcaggagg

SEQ ID NO: 144195 - DNA, 123 bp, Homo sapiens
ctacaggaatggtcagggctatagaaatatttcaggagttatcaagaggtagattgtagtttaatgagaaaacaattaacatttactgagcatctgttaaatggcagacactctggtgtttgt

SEQ ID NO: 144196 - DNA, 641 bp, Homo sapiens
gattaacccaagaaaatgtaaaccttgtctaccccaaaaagcttttcacaagcccaaagaccatttagctatgaattcatatttaaggttttatcgttgtaacctccaacctttacccaaagtatccattaagtaaaacttcggagggaggatggctcattcagcaacctccttttacagatgaagggactggggaacaatagcagagagacttttccagccacagaataaatcagtagagagctaggtttaaacacatttagctctgtaatgcccaattatctctggagtcaggaagcgatttaggtttgaaaacgctacaggcagatgtttctgtgggttgagtgcattaaccaatataacacatgagctaccaacacaaatatatttgttctgtgccaggaggtggccaggcactttatgagcgctataattttaccaccccggccccaattcaacaagctaaggattagcccagtgtttcagatgaggaagaggttaacttgttcagggccacagaattagacgtgacatagctgggattcaaactggggactatcgattctaaagggggaaacaggatagagaacgggctagaagatagaggacgggctacaatggactgggcagtcatgaaccta

SEQ ID NO: 144197 - DNA, 230 bp, Homo sapiens
gggaagtaccagaagaaatgtaatcttcctctgaacttcagctgccatgtgggaagctgacctggacattgtccctgttcatagggtcgggcatagctgaagcacggcagataagcaaagccaaacttcaaagatgacatcaggaacctttagatcaagatgtacatcaagttagaaaaatcttattttgcagatacgcaggcagaattatgatcttttaatttttaaag

SEQ ID NO: 144198 - DNA, 736 bp, Homo sapiens
taactgatcttcaataaactagttaaattaacagactctccatctccttagtaaagtgtgctaatcatggccatcacatgcatactcccagctattaaactgttctctaggacagtggatctcgatttacatgtgcatcagaattacctcgagattttctgattctgtgagtctggagtggggcctgagaacttgacatttctgataagttctcaggactttgatgctgctggtctggggacatacttggggaactactgatctaggacaccatagcctttggtttttatcagcagagctgaatgttaataggaagcaattgtatttgttcttacactgattatgtgtattgtatttctgattgtcattgtgtaatttaactaaatactacattcatctatgagaatttagttgaaaaaatatttgtttctatgaaaactaaatcaaatactttgtaacaacttaatgtaggtattcattaaaataaagctaccaagtgagattggtagggccactgttaaatatcagaataaatatctatctatctatctagatatatctatatatctatatctaaagcaattatacactcaagttgctttaaaaagagactttaatttattgttttactttaaataaattaagtctataaattgtaaatgatgtgttaatgctggaatgagttaaaactttggtggactgttgagaaggcatgattgatttttgaaatgtgaaa

SEQ ID NO: 144199 - DNA, 301 bp, Homo sapiens
tgctgggattacaggtgttagccactgcacccagctgaaatgttttaattttaactcattttatacacatgcatacaaacacacatctatgtgtgcgtgtgtgtgtgtgtgtatgtgtgcatatatatacacatatatatatattttttttttagatggagtctcgctttgtcacacaggctggagtgcaatggtgtgatctcagctcaatgcaacctctgcctcccgggttcaagtgattctcccgccttagccttccgagtagctgggattacaggtgtgcgccatcacactcggctaa

SEQ ID NO: 144200 - DNA, 1419 bp, Homo sapiens
gtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctggccacagagaaggtatttgtaattggattctcctggaccagcccagcctctgaagttctagaattaggtgcctcctttgcccaaaggctatcagctattggaggggagggtggcagtatgtccctcactgggtagctgtgaacactaactgacttcaccagtgtaaagtgcctggcacagggcctggcacagaggaagccagagtcaatgt

SEQ ID NO: 144201 - DNA, 426 bp, Homo sapiens
gcttgaacctgggaggtggaggttgcagtgagccaagatcacgccagtgcactccagcctgggcgacagagtgaaactccatctcaaaaaaataataataataaataatgcttgagaagaactacaatttaagtgttgtaactcaatgtaagaataaaaataaaagttgtcataaaaaaaatttctgaggccaggcgtgagaggatctcttgaccccaggggtttgaggccagcctgggaaacacagatattacatattacaagtaataaaaaaaaaattaggcatagtggcgcatacctgtggtcccacatacttgggagactgaggcagaaggatcacctgagcccaggaggttaagactgcagtgagctgtgatggagccaccgtactccagcctgggtgacagagtgagactctgtctgggg

SEQ ID NO: 144202 - DNA, 469 bp, Homo sapiens
cctgcctcagcctcccgagtagctgggactacaggtgcgcgccaccacacctggctactttttgtactttttttaaaaatagaaatggggtttcaccatgttggccaggctggtctcgaaatcctaacctcaggtgatccacctgcccgccttggcctcccaaagtgctgggattacaggcatgagccaccacacctggccattttagagtattaaatctttctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaa

SEQ ID NO: 144203 - DNA, 403 bp, Homo sapiens
tcaaaggctctctgcttttgcacctcctaacagtaacgccatccttctctgtggactatggtttccccagttctctttctggcaaacatctattcgcacatgaagatctagatcaagtgtgacttcctctgtgaaagcctccctcagatccttctctctgtccttcccattctagtcactgacctgatactacgtcaaattgtatgcaattacttgttggaagacagctaccctgatgaaactgggcactctcccagggcggggactagggcttattagtcaccttttagatacagtacctaccttagttcctggaacagggtaatttattgaatatgtatttcagagatggatggagaaatcgtttgtttatttattcatgcatgcattcattcagttagtt

SEQ ID NO: 144204 - DNA, 489 bp, Homo sapiens
atgattccgagtttggagcctgcatgctcagtggatggtcctatcctttactgagtttggggaaactggaaagggagcatgtttggaagacagtggggaatcaagagttctgtcttagctgggatttaggaaaggggatggatataaatttttgtcaatcgacagtgggtggagtttagggtccattgggaagacaggctttgggctggagaaatgagggtttggattcaagatgggggaggtgaaggaagaaggatctggcttaggattatgagcactacgtttaaggacaagccctgacttacccgtgaggtactcagttgtgtcctcatccttctgtggaaaattgggaaaagagcaatgtctgaaggtgatggttgatttcagtacagggatcatcagagtgtccttatggagccaagcagggccaagaaggtgtcaggtggggaaagaccttccatgcaagatgaacagggtggcaactcaact

SEQ ID NO: 144205 - DNA, 184 bp, Homo sapiens
aagcactacaggtgactcgaacctacacccaggattgagaacaactgcatttaatttatgttgactaaatgagtgactgaatgagcaatgaggcatattttgttatcagaacacaataaaaattaaaaacaaaaagcactcatctgaacaatttcctttttttttttttttttttttttttttt

SEQ ID NO: 144206 - DNA, 303 bp, Homo sapiens
gttgtgatggactcctgtgatggtcattctaaagaagcagctgtcaattatcttcagccaaatttactatgtaataatgtgagatttcaagaggagaaaaatctggataaacaacaacaacaataaaaacaactgtacaagcccacactgtggaggatactcagaacctatctgtgggctgaatgaagcgcatggctgccagtttatgatctttgccatatcgccaacaaaacaaaacaaaaacgcaccaaattcctactgcttgtttgctgtgagctatgaaaccatctaaccacatttgtt

SEQ ID NO: 144207 - DNA, 208 bp, Homo sapiens
tataggtagattgctgtagtaagtctttccgtgtataaatagcagagggaggaaatgttcctgccaccatccattcttatgtccaaagggccatctttccgaagggaagaacctctttcaggagtatcaagttgcatggaggaacacccaagatccataagaactccatcaaaagttcctggctgcactccagctttcattaataagg

SEQ ID NO: 144208 - DNA, 262 bp, Homo sapiens
ccgtgatagaggatcccatcgcgtgctgagcatgtttgggattcgcgtgagcatgagcctggctccctcatgtgattcttatgatggccttagattggcagggcaaggactattatgctcattttatatactcaaagaaattaattaggctcagagaagttaaatgacataccccaagtgactcagctgatacatgatggaaatgtattttaagttgggcctttaactcctttgctgcctataaccgaagcacaatcttcca

SEQ ID NO: 144209 - DNA, 199 bp, Homo sapiens
gtggaatgaacccctgcgttagagcacctgcactgaatccctgggtatacttctcttaaaactgcaggtttttggttatataatgttataccaagggaattttttaaaagagaatgttttaaaaaggtatttcaagacaataaggagctacttgtttgtaagagttctacagaaaccaaaaattatgcgaattcatact

SEQ ID NO: 144210 - DNA, 324 bp, Homo sapiens
ctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatga

SEQ ID NO: 144211 - DNA, 685 bp, Homo sapiens
tgctctcctgggatcacatggtctgtcggttgagtgtttcacatgtacgggcaccccaagtgctggagaggaagaagcccagtctctgccctctagtacttgggatgataactgctgccagggagtatgatcaccacctggtgtcagagctggttgcaagaggcttgaaggctctcaaacttccaagggcttactttctaacagaaagagtggattgtgaacactaacacttattctactatgcagaatgcaataagtggcttaagagagttgaacctgcttctcagaatgttcataggggggtcatttgctggaaggatcaggctggtcttcatacaggaggcaagtctggagctctgaaaaatagcctagggagtggggaggatggtaccctcagaggaaaacctggggagatcaaaggaagtgacccaagggacatgtccccgacaagaataggacctttcttgcagcggagaatagacaataacaacttgtaaaattgctgtttctgtctaagagcctgctaatatcctagagaggattttgcatatgttatctctaatccttaaaaccactcttcaaggtaggcacaacccccactttacagatgaagaaatgaggttaggacaggatttgcccaaagacacaaagccagttgatgggggaatcagaagtcagacccaca

SEQ ID NO: 144212 - DNA, 284 bp, Homo sapiens
tagtgcacacctgtaatcccaggaccaagcagaggggtggaatggggaccattataacaccactgttcagcaacgaagctgctgccttgtaaaacaggctgaatgaatgcaggggctgcagtagaggggagtcctgtgttgaggaagtaggaggagattagatggcaccagagatcccttccaaattgcagcatgtatagttctaaaaataaagtgctgctggtatgatctcccttctttatcagtgggttgatacacttcaactcccaaccccaccccaacct

SEQ ID NO: 144213 - DNA, 403 bp, Homo sapiens
gctgttctttgagaaccacctattacccacagcaccttctcagagcatctgttcccattactacagctggctgtgggacaagacaaagaggcatccatcgctctggccacatgctgcctcacactgagtccaccagattctctttcttaggaagctggaattgggatccgctcagtgaatgctagcactgaaattgtggggatttgtcgagtaggagttgaggcaaccaaactcaagtttgagccacgtgagtggatgaatgagccaattctgctggtccacgaagaggaagaaggatggataacaagctgagagagaggcagagaagggagatgaagtggccacagagacagatagtgaaagtccctgctttctttctagtttcttgggatacagggtttgg

SEQ ID NO: 144214 - DNA, 436 bp, Homo sapiens
acacaaattaagctcttgcatctgatctttctggtaatcttgaagttcagagttagttttagatgtccaattactcaaaaactctgccccaaagcaacagggagggtgtagactgtgttttaaagcacgaatcttgtataattcactgagccagtttgtcagacttgaattgtattatttttacttgaaaacacatagtaccatgccaagaggaaaatgtacccaatcctagaagtacaagctagtgaaatttatctatctatttaagtcatgaaagttccacttactcgtctactatgaagtttaaaaaaaagttctactaccaagcagaactgagaagagtcaattgacgatgccctaatatccatttcaggtggagctaatttatcagttatttcctgtggcttctctggagctcttataaaagttctccatt

SEQ ID NO: 144215 - DNA, 733 bp, Homo sapiens
gaaagaaaacaaggtcctctccttgatcctctcatgacggtgacatggacacttgggaaacacaggatttcacattcagtgatggaggttaagatctgagggggagacctggacattttttttgcactgactctggcggttgaagccagtgatttagttctggagtacagactaatcagctgaccatttgctctcactcctctgaggtttggatgcctaagaagagaggatttgagtcaataaatgactatggggtccttggaacccagtaagccctcacttctggtagaggagaggatgggcctgtggctgcagacagacctcatgtgaccccgatctcccctttgtgtttgtgtgactgtggctcagtgactgtgccttcctgtgcctcagttttctctcaatcaaatgagctaaatggcaaatggactgtggcttttcatgctatctgtgaataaatgttaaagtattcacagtcaactgacttaatgcttggcacagtggaggtgttcacacaaacagcatttattattaatttgcttccatgagaaagcacctttgcgtcagatccctgtggacaaacggctacctggtgcatcttctctcttctgtttctgcttctggggatattagactttctatggagtgtcctaggcctcctaaggcagttggctgatggcctacaaagcttgtctttctgtcctctccactctgagtgtcaggtgaagaaagc

SEQ ID NO: 144216 - DNA, 503 bp, Homo sapiens
cctcgttatgaaagtgtcaaccttttgagagatcagattaatggttgtctgcatggtatggtacgagtagtgcagtgcttgactgcgcccttaacacacacacacacacacacacacacacacacaggctcacacacgtgctcacacatacatgctcacacacaatatcacacatcctttcagcactgagaatggttaatagtaggtgtgaagactcacccacagaaaactgagaaatagtgtgtgactatttctgtgactaacacactttttatatcatcttcctcttcaataccatccttaccccagatgtccaggatcttcaagttacttaggacccagcatacatgttgctaaacttctaccacttctgtaagtcatttaattcaagcccattcactcaatgcccagaactggagtgacaacgggtgggatgagaagtcatcaccttcttcatcaccatctttgtgatcttcatcatttcatgaacacttactctgtag

SEQ ID NO: 144217 - DNA, 507 bp, Homo sapiens
ccacttccatttaaaaactggctcttcaagttctcaaaacctcttatcagactgaaactcagccaaggttaaaactgccaagtatctctctactttcctgaccccactgctcaaggactcctatttagcacactgtattatcgaacagcttttgcagagtctttgtgtggaagctgtgtgtgtgtgagataatcttttttttagcatcttttttttttctcctcaccgtaagtatgaccacagtcttcaaaaaacaaacaaacaaaaaagaagcgctgtcttcagacatgttaagaaacatgtgcttttaaaaaatgtgtacgctttatattaacttttacatacaatatgagtagaatatcacaaaggtctactgaattaaaatcaagatattaatatataccttaagtcacaattattggataggtgacatacttcataaggacaactgtttggttcacgttgcttatgtttgtgttttaaaatcataacaataaacttttgttt

SEQ ID NO: 144218 - DNA, 352 bp, Homo sapiens
tagtgacgggaggatttatcttcttggatcatcacaaatctgtaaaaaggagactgagccatattccttgcaattccaggtccagctcagaaagatgtctcagtgagaggattggagggtgtttgatttctggctcagttctcacctaaatccagccagttttatatagcaaatgctgtgtcctgtgtgtcaaagtgataccaggcattcaaagcacagattaaaaaaaaaatcctcctaattattaatagtgtcattaatacttactgagtgctaccatgcccaggtgctgagctaagtgctcttctctgggccaggccctgggctgggcatcccagagagatcatctcaa

SEQ ID NO: 144219 - DNA, 515 bp, Homo sapiens
tgcagatgccaaaatcttgagcttcatgttcagacataaaagcaccatgttccaaaggcttaatggctccatttctccctatggaaactgaaattggcaacattctccatcagccttgtcttgagcatgttgctggaaactgaaactggcaacattttccatcagccttgtcttgagcatgttgttggggtgggtacaaatgaatccgtgtgtgtgcacctggactccattgatggaaacatgcgtgagtatgaaagagccatccttgtgatgaattctctctggcccaacttccatttgataaaagcactctagtgtatcaaatcctgacagtggaatagatagagcagcaaattgaaaatacaattatgattttatcctaacaaaccgagtggtccccaaatagcagcaagaaatagaatgtggcaaagcaattacaagggctgcctgtggtatcatcgtaagtataattactttcagaaatccatcatttattttttcattgtcattttatc

SEQ ID NO: 144220 - DNA, 133 bp, Homo sapiens
tgctagcagatgtgtcttctaggaaacaagtgggggaccagctggacccttgtgcacaagcaaacctacaaaaattggtcccaaaaagtccatgagatcatgctgaaggaagaactactcttggaggcactct

SEQ ID NO: 144221 - DNA, 200 bp, Homo sapiens
gctcgaaccagaagtttctaaaagcattcttttgttaactgttctcaaattaataaagccaggagttaacacatcacttttgattttataagatgaatagttctgaaaaccttatttttccccatccctcctattttctacctcttgtggtttatatttagctttattaaatagtgctgttcagttcctgaatgactcgg

SEQ ID NO: 144222 - DNA, 435 bp, Homo sapiens
cacacacagatcaatccccatggcccaacactcctccagggagaaagaaaatgggagaagggtcaggaattggcagctgggagccgcatcagggttcctctccccagggcaccagcagggaagggtcccccttgaccacagctccagccaggtttctaaatcttgcttgtttgccgaagcagccaggcacctcccttccagcccagagtgaagggctatacaaactctggcctttctctgccatctcctccctggaggtgagcactgagccctccaaagacacacaaccagaagggacacaggccagcgggagcacacaccatccctcaccggagcctgagtgccagagccccagcagcgcccgggggaaaggcaggggtatgaggacaaaaccctaaccagctgctggaaggcaagggcctggcaatgcccttc

SEQ ID NO: 144223 - DNA, 410 bp, Homo sapiens
tggttctctctgcaaagtggtctggctgaatataatcaatgttattcctctgctttgttgaatgagcttcgagtaatgatgtgcagatgccaaatgtgacatgtctggggacaaggtagtttaattctagtctcatttgcagagatgacttgctatcattaggggctttgtctccaagaagccagctgacagaaagagaaagccagccactgctcggcaatgaggcaaatgcatgctataaaaatgctggagcattcacttagctatagactccaagtaggagcatttgagaactgagttaaatcattgtggtctttctttagttttttcttaaatgacagttatgagtctgtctctcagtttgtaccatttgatgtagggggtttggaaggttgtatcagtaaagcaga

SEQ ID NO: 144224 - DNA, 932 bp, Homo sapiens
ctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccttatttcgctggttcttcttgtctctcctggcattttttcttgtttatcggtattgaagcttgacatctggattgagggaataattaggagggtcagttgcaattttgggtgagttccattatataaggaagaattatacgtgtgaatggtatacagttaaaaggattgcgcaagatatatgtgggtgaatagtagttaagatgga

SEQ ID NO: 144225 - DNA, 363 bp, Homo sapiens
cttttcaaaaaccaacaaaatcactgccaatgagctgcagtgacaatttcacagactaaccttcagaatagtacataaactgtctctaaacgacttgcagccaggctcatctcttcactgtctcctaaaggaagcatgcggtcttaccactgaacctccgctcagatcactctcctgacttctcccttttcccagccacccctctgggtcttactcattgttgtttcacatccacaccaagtctcgtgaatcactccctaggttctgctgtttactctcacctctacatttccgtattgttagagtttgttacactcacatgacatttcatatatgtgctcatgtacacaaacatgtgtacac

SEQ ID NO: 144226 - DNA, 344 bp, Homo sapiens
agttctttcctatctttgtgtgaggtggacgatgtcactagcctcacgtggcagaacggggtcagaagctcagagtttaagtaatatggcctggaattagaacccaggagtattgctccttcttgtaaactctgatgcctgggtttttacatggtgtctatctgtaatggcttataacagagttgctcctccagaagttttagcctcgttcctgcttgataggcagggcctcccattgggcctgacccaggatacatgcttggttgcagaaagtcagctttgcaggttatactctcagcattttggccacagtcaaccgtgcagaaggcttcctacctagatgg

SEQ ID NO: 144227 - DNA, 165 bp, Homo sapiens
tatctatgttacttaattgtctcatcggttttgcaaaattaacatatggcccctttgcagacactgttccctctagtcctctcatctataaccgagcacctgaaataaccttaaaaagcctctcctggctcgccaatcttccaacatatccacatgctcccctgt

SEQ ID NO: 144228 - DNA, 396 bp, Homo sapiens
acttcctaacttttaattttatatccctatagcacctagcacagtatcttatacaaaagagatgatcaagaaataggtgttggattgaccaaatgaatccacctgctagcactgcatcaagaaagacatgttagccaagtacacctaaattagtttactgactctttagcctaaaaccctttgatggctttccattacccaccttcagataacattcaagaatcttctaattatttagctcctacctacatttatagcttcatctctcatcaagaattttgcaagtatttggggcataaagtaataataaagttgatttttgagaggaaaatcttaagaatcacacagaatgggataagaatggagatatggtggctcaggcctgtaatcccaaca

SEQ ID NO: 144229 - DNA, 260 bp, Homo sapiens
  misc_feature (49)..(49): n is a, c, g, or t
gtccgtcagttctggtccccactcatgtcattgaatcacccactgcacntccagctgggtacagagcaagaccctgtcagagtggaggggtacagggacggggtaagacagtgggggaccaggaactagttcctggtcccccacatttaaattaaataagcaatcatctggccagagccctaggagcggctgcatgtgtcctcagtcatccacagatcagggctgggcagaaagtgagctagggcaacctctccagctca

SEQ ID NO: 144230 - DNA, 374 bp, Homo sapiens
agtgccccagaggctgagtgacagacaaaacaatttctctagcttctcctgagctgtccatgagttcagttgccatgaagaacggtggtaaagtcagcactaagcactgaactggcatttttgcttccactgtgctcatgccctctctaccacgtcctagacactgagcctgcccaaggggtgtatgtggatgtatgggtttgtaaatgaactatagttcccctgttcaaaaacaacaaaaagtgctatatctcccttacccctcagaatagagagctcacttatcataggtctcaatttcctcaggcctcataaacacattcaacagcacatttccaaagaggaccttaatatctcatcctctgataggcatc

SEQ ID NO: 144231 - DNA, 172 bp, Homo sapiens
tttcctggattcagaataaacacttgagggcacacgtttttatttgctttctttacatctaccctcttttctttctggtgagtattggtgctacgtattacagacctggtttatttggagacgaaataattgcacgcagaggaagctttgtgagtgtgagtcctaccaacag

SEQ ID NO: 144232 - DNA, 501 bp, Homo sapiens
aactggcacatccaggacccaaatctgggcccgtttggctccaaagcctctgctcactctgctgtaccatgcacccattctaaaggcgaagaggctgaggctcagaggaaggcatagatacattcaggacctatggctatgagtgaggatccaaaattcaaacccacggctcacaggtgccaaagcctgctggcccaacttgaccctgctgctccctgagagactcctgtcagccacaaatgtcaggactctgaagagacaccttagctcacctgaattgcaggtgggcaggcgggcacctccctctgactctccagacccatctccaggccagtccctggcctccgtcttgggccccgctctgaccccacaggtgggctttccccgaggctggccggtcaccctgtgcaagtcagctccccagcccaggttcctaagggccatgccctctcgcccacctactctccaggtgacctcagagaagcagaccccttctctgaa

SEQ ID NO: 144233 - DNA, 351 bp, Homo sapiens
ctggagtgcagtggctcgatctcggctcactgcaacctttgcctcccgggttcaagctattctcctgcctcagcctccacagtagctgggactacaggctcatgctgccacgcccggctgactttttgtattttagtagagacgaggtttcaccatgttacccaggctagacttcaactcctgagctcaggcaatccaccctccttggcctcccaaagtgctgggattacaggtgtgagccactgcacccagcccaccactttaattttttacactctacccttttggtcaaaatttgctcaatctgcaagcttaaaatgtgtcatgacaaacacatgcaagcacatactc

SEQ ID NO: 144234 - DNA, 188 bp, Homo sapiens
aatagggtccctcatcttcagagctttctaagacagctgaagtagaattaatgtcattctagcctcctgactttccttacttgtttatttaaaaaaaaatgagaaagaagactttgaagaggtcatcaaaagccatagacacttgcaatagactcttggcctcacgaaaagtaaaacctaccctttgt

SEQ ID NO: 144235 - DNA, 302 bp, Homo sapiens
ccagcctggtgggcactgggcagcaaatgctacacaccctctcctcccacccactgattcctgctggtggcttgcactgtttaaactcaaccaagagccagaaaacaagggaactcattgacataattcagaaggtcggtgtcctgctatacagagcagggtagagaaaggtagaagatggttctagaggggcaagtggcatttgcagcatgctgccttgagacatacatgggaaaaaccatagccacaaaataaagctgtgatacaaaagatgtcacaagatgacagtgagtggtatagac

SEQ ID NO: 144236 - DNA, 386 bp, Homo sapiens
aagaggacatcacttcctctgtcgtacgagggatttatgtgagcagggccaccacacgtggtcatatatactgtccacagagggatgcctggccggggagtgactggggctgacattagcccagcacgcgtccctgggccatgcccaggaggttgcagcccacagacgcctatttccggtttgcacagaggggttgtatggactgttggggcttgtaggcaagaccaagaaagaatcaaggcattgcaatcccgcggtgagccaggtgtggtggctcacgcctgtaatctcagcactctgggaagtcaaggcaggtggatcacttgagcccaagagttctagaccagcctgggcaacatagtgggatgatgtctccacaaaaaaaa

SEQ ID NO: 144237 - DNA, 284 bp, Homo sapiens
agctgtattagttcattctcacactgctataaagaaatgccagagctttaattggcttatggttctgcaagctgtacaggaagcatggctggggaggcctcaggaaacttatgatcttggcggaaggggaagcaggcacatcttatatggtcagagcaggaggaagagggagagtgaggaggtgccacagacttttcaacaaccagatatcatgagaactcatgggacagcaatagggggatggtgcttaaccattagaaaccccctccctgacccagtcactt

SEQ ID NO: 144238 - DNA, 4375 bp, Homo sapiens
  misc_feature (994)..(994): n is a, c, g, or t
  misc_feature (2155)..(2155): n is a, c, g, or t
  misc_feature (3166)..(3166): n is a, c, g, or t
  misc_feature (4256)..(4256): n is a, c, g, or t
gggagttgatcccagagacctgggttctagtccccggcatgcttgctaactagccgtgtgatcctgggcaaactgcttctgtctctgggcctcagtttccacatctggaaaatgatagacttggaccagctcatctctgaggtctctctgggccctgacattctgtggttgtatatgtttcttttgttccctttgtcttttttaaggagctgatgattattgagatattttatcttccttatcctcatagtagcgtcggtagagtgatggaccacggatgagtttcttctgtctcataggtggtgacactgaaaggggactgcctcacctggactacgtgtgtgctcagtgtgctggaactcactgcctggacaaagctgccctagattttgccattcctggagctcacaggcctggagtgagcggctgcctgccgcggggctgggtcgggacaggagcgctgggttccagggtggacgaactcctgttggatttgcctcttcggacctccagttccttgcttagtggtggggggagaatcttccctgttagcccatttcccacttcagggtagcaagaaatggaagtcgtttctgggcctgggcaggagatggggccacagccacagcagtcagttgatttgaacacgccctcccccctgcaggggagggccttcacgccctctaagcaggtaatgagggggcgggctgccgtattaagcaccctggctacgctggggagaagctctgcaccttgtttgacacacagaactgtcgcggctccttcctattgttagaagccttaattactattgttccaattcctccctccagcgatcgtcattaggaagagcgttcttgtttcttcctccttccccccatccccctgaacacgtcttcagggctgttccctggcgctgcctgcctctcacccggctctaccctgttcactgtgcccttctacccagggcagcccctgacagcccacctccctnatcccctggccctggcctgcgctcccacctgctacctctttaggaaacaaacacatacccttcccacccccatccccaagtctccccattaaaactcatggctcaaagccagggatgctttaccttgtgtgtggattcaagaacctgtcctacccgcttctctggtggttgtgagaatccaaaccaagagaagggtggtgccttaaactggaaagtactgcacacatttagggggtgtccgtgcaccagcgccgcaggccatagctggctgggggaaggcttgggctaccctgctgctctgccattgactccctgggaggatctttgacttcagcttctcctcggtaaggtgggaatcaaatcttaatcaaacttgcctggccaacctgggagccttgtcagtgggctgcaatgggatggtgatcctgaaagtactctgaggcctaggaagggttctgctgattggaatcaggatcgccagcttatttttcttttcatgacttcctgttgttctctgtatctatttccatcccatctctcagccttcctagagggccctaaagctgtgcaatgatttgttccctggggaatttctccaccaggcagccccaagtcatgttgctggctcctgcagttgcctgctgaggcaccccagcgtctgacacctggggaaccccacttgtgggctgtctgggaagtgtgggggtgggaggggcccctcatttccctccagctgccatttgctgctctctccaggctccgtggtgggcccggcacagcctgtatcggagtggagaacgtaggttggtccagagcacgttccaccgggacctctccgtctggagcctgtatcagagtggagaacgtaggttggtccagagcacgttccaccgggacctctctgtctggcttgctcaggctcatttcttctgtctggggacttacggggatgagcatgaaaacctgtgcatcctggaatcacagggacacggctccatgttcccagcggttgatccattatccctggtcgccctgcttccttctcagtcgctctggcctctgctccctcctggagtcctgggctgggaagtaacctcagtccatgctcagagccaccccatccccaccccacccccaccccagccctggggccctctgggngctggggagtctgtgctgtgattggcaggagttggacagatttgcttgcttgggctatctgcctgtggggctctcagctggatcatcctgcgactactgactaagcagccagatggcttttgctgggaccttccagatgtgggagtaggttttggaggtgctcattcgtgcccacatggccctgggtccacatctcttttgctcccccgagatgtccaagctcacactgggcactcgctggtcagagtggttggggttctggaggcggggcttgggaggatatggggagcttctccagcatcaagcctcccttttaccaggattttcgtaccgtctcaaagcacccaaagctcttctcaaacacatctcgtcagtggggaggcttatacagagagggagatggggtgcctggtgtccaggtcccactgggcacagggcctgcagggctgaggtggaacccactggaacccggagtggccctaatgggcctggaagcccgtttgtcacaggtgtggtccggaggtggttctggcttccagattcagccatgtggatcccctaaggggtcacctgctgcctttctctgcttcccaaaaacgtccacgtgggcttttttctctgcaggcaccctagggaggtggaacctccttggccaaggccctcatctctagccttcagacacagatccccaaggcccctgctttggagggctctgagggctccctgggtcctggtgaaggtccaggccaggccaccaccccaagggcccactgtcctgggggaagctgagcctcctgagtaggcccctgaactgcagttggaggaagggctggagaggagatgagaagtggcagactggctgagagactgctcagagggcagcctgttgcccggctgtttaatttactggagttatttttcctcatcgttccctttctttggtgttcccttggcagagatggagtaaaagataaaagtaggacctgggaatggggaggaggagaggaaaancgcaaaggggaaaggaaggagaaggcaccaggaaggctagctactctagcactgggggctgagcccgcttggctgggtgcctcgggccgcctcccttcctctctgcagtgattaagacatcaccagctgcctgtgttcttagccccgctggctctccgctgccaataacaaatgcatctggctggaatctgggtcattaaaaaaaacaacctgatatttctctttttcctttaccccccggcaatccatcctctggaatatagctggagccccccaaagagaggtcagaggtcgcagaaaaccatggtggacatgtcagctgtcagggccactcaggcagccagccagccactcttgctggatgtctgttttctgttgtgtctgagttgttgtgaagtgaaggccccaaatacagagcgatgtgccagagacaagggcttacaggtggcccttcccacccgtgggcggccgggggaggccggacggtgtagtggctgtgatgggggctgtgtgtgtaagctcggagttggacagccttgggtgtcagtcactgttgcctgtgtgatctagcaagaatgttcgacctctctagactcagttttgtttctttttgtgaacaatgacagtgacatgcaacctgccctgtgcggttgttgagtgggatgcacagggactgtcctagcacaacactcaaggaagggtggccactgccttagtttgtcaccatcattatcctatctctgttgagtggcacctcctgcgggagctgtgtttgctcagccgcagtaccgacccccatctcccggtgtgggtcgggcacctgtccaaggcggaccttctgtgaggatggagggagggcgccttcacctcctgcctcaggagccaagagtcagccagacaggcagctctctcaaatggagatcctttgaagactataaagatttgtttgtacatctttctctgggatttgagaatatagatgagtagagaaaaatggagggaaggtggaagggatgacttaaaaagggaatgatagggaggggaacatcacacaccctggggcctgtcggggggtgaggagctagggganggatagcattaggagaaatacctaatgtagatgatgggtgtagcaaaccaccatggcacatgtataccaatgtaacaaacctgcacattctgcacatgtgtcccagaacttaaactatt

SEQ ID NO: 144239 - DNA, 586 bp, Homo sapiens
gagaggcctcatagtgcccacagaaagctagacttgaaagtatgaatttaaagtcccagggccaggtgcggtggctcacacctgtaatcccagcactttgggaggtcaaggcaggcaaattacctgaggtcaggagttcaagcccagcctggccaacatggcaaaacgccatctctactaaaaatacaaaaattagccgggcgtggtggtgcacgtctgtaatcctagctactcaggaggctgatgcagaagaatcacttaaacctgggaggcagagattgcactgagccaagatcatgccactgcactccaacctgggtgagagtgagactccatctccaaataaatatattaattaatttacagtcccaggtatagctcacgcaatgctattagatcatggggaaggtatactgcctcagttttcctcaataggggatggaggtggggaatgaggttaccccaatacaatgttgaacaaatgccaggagcatgttgctgactgatccaagggcaagccttggaggaggcaattaagatgcagcccagtggataagagaccaaagtagatgctccattcttgcta

SEQ ID NO: 144240 - DNA, 462 bp, Homo sapiens
tctggctgactcagtgtccgtgcatcctcaccagtatttgatgttgtcactgtttattttagcccttctgacaggtatgtgatggtctctcattgtggctgtccttaccatttcccgatgtggaacacctttgtgtgtgcttgtcatgtatgtgtcccctctttggtgacctgtctgtgcatgttgcttgcctgttttctaattggagtctttgttgagttttgagagttctttatatattctagatactagtcctctgtcagctatgtggtttgtgaatattttctcctagtctgtagattgtctcttcatcctcttaagagggctttgcagagcaaaagtttttaatcttcgtaaagtctaattgtcaaatttctctttcatagatcgtgcttttagtgttaagtctaagaactcttttcgtcaagattttcttttgtgtttttctaaaagtttttatag

SEQ ID NO: 144241 - DNA, 395 bp, Homo sapiens
agtccaaagtctcatttgagatgaggcaagtccatttttcctataagcctgtaaaataaaaagaagttagttacttccaagatacagtaggagtacaggcattaggtaagtgctcctattacaaaagggggaaattggccaaaactgacaaaattgctctatgtaagactgaaaccaagtaggacaattattacatcttaaagtttcaaaataatcttctttgactgcatgtctcacatccagggcacactcatgcaagggatgtgataccagggccttgggcaactctgatcctgcagctctgcagggtacagccttggcaactgcactcatgggctggtgatgagtgcctgtggctttaccaggtccacggtgcaagctgtgagtggatctac

SEQ ID NO: 144242 - DNA, 405 bp, Homo sapiens
tttgtattttcgtagtgacatggtatgccatgttggccaggctggtctcgaactcctgacctcaagtgatctgcctgccttggcctcccagagtgctgggattacaggcgtgagccaccgcagctggcctcaccaattagacttttaaatgcagaacattttcctctaaacacattgatatttgaaaaatgaatatagctaaatattgtatgggaggcagtcattacggaaccaaacagttcccactgtagaaactagaaaacctggggacacggaggatattaggcacttctcaaaggccaggccatgggagaaggctgaaaagaaggagtggttgagaattaggataagtagtccagaggttgcctgcccaagtggggctccccgccctcctcccactctagc

SEQ ID NO: 144243 - DNA, 121 bp, Homo sapiens
ccattttgaaataccacagcacggaaaccacttttcctctctaagacactcctcaccctccctgaccgtatacatagaattttgaagagagatgaatgtctcggcacaacacataaaaatg

SEQ ID NO: 144244 - DNA, 364 bp, Homo sapiens
atagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaa

SEQ ID NO: 144245 - DNA, 293 bp, Homo sapiens
tgtggccgtcatgtcggaagtgcctttcacctcctgccatgatactgaggcctccccagccacgtggaactctaagtccaattaaacctctttttcttcccagtctcgggtatgtagttatcagcagcatgaaaacggactggggtatgagctttccatgaactaaacacagtctacaatatgcatgtttatttaagcttggatttttaaacaaagcattatgaagaaaaagtctcaaaggaaatacaccaaaacaattaacagtggttattacaggttgaaaagattatggg

SEQ ID NO: 144246 - DNA, 303 bp, Homo sapiens
ggtggcctcgacgagggtggaggcatcagcgagggaagagggggagcccccggcatggctggtggacacagcatgggctggtggactagatgtggcatgtgagagacagataggtggcaagaaggacccctgctgtcagctgccccttcaccaggctgtgggaccaggacacagctcaggacaccagcctcttcctacctcccctcacctctggactctcccctcctcctccctctccttgtcttctgtcctgtcccctggcctctcttccctcacccccttctccccctcctcctctcctgt

SEQ ID NO: 144247 - DNA, 443 bp, Homo sapiens
gtctcaaactcccagcttcaagaaatcctccctgccgcagcctctgtagctgctgggatgagaggcatagccactgcacccagctatccctgccccctcctgccttttttttttatttttatttttttccagagatggggtttctctatgttgcccaggctggtctggaattcttaagctcaagcaatctgtgcccctcggcctcccaaagtgtgatcacgaggtcaggagattgagaccatcctggctaacaaggtgaaaccctgtctctactaaaaatacaaaaattagccgagcgtgatggcgggcgcctctagtcccagctcctcgggaggctaaggcaggagaatggcatgaacctgggaggcggagcttgcagtgagccgagatcacatcacactgcactccagcctgggcgacagagcgagactccttctcattaa

SEQ ID NO: 144248 - DNA, 692 bp, Homo sapiens
agtaaaagatagcataatagcaggatatagaatttcataaatttaacctttatcaaacttgtttgctcaatttttgtttatacattcataagttactaaccaagaaaatagaattttggctgggtgtggtgactcacacctataataccaggattttgggaggccaagacagcaggatcgcttcagcccagcagttcaagaccagcctgggaaacaaaggagaccccgtatctacaaaaaaaatcaagttagctgggtgtgccagtgcacacctgtgtcccagctacttgggaggctgaagcaggaggattgcttgagcctgggaggttgaggctacaatgaactataattgtgtcactgcattcaagcctgagtgacagagtgaaaccctgtttcaaaagaaaaaaaaaatagaatggaatttttttaagtcaaagaactgtcattgcacaccttttgtttccataaagattctttgctttatacaactgctatttttttcttgccttggaaccatctgttctttatggtaggaaccaacattttttttaaatgagaaaaacagttggatgttagcagaggggctatatatacttcagttacagattgaggtattttgaaagataccaggaaaactcgtaaaggatttagaattgaggtctaaaatagattttttaaaaaggcatatgggg

SEQ ID NO: 144249 - DNA, 361 bp, Homo sapiens
gcaggaggggtacttagcatgcgtctgtgaggtccccagcccaggagggggtcctggcctccagggacccactgtcagattggaaagacgagtatattggtccatgttctccagtgagaagaatgctagatgtcagccacaatagccgtacacacataagcgagcccaggacgagcccagcacggtgctaaatgcttccatctgctgtctcaggagatcttcccaggaccctgtgggagaggaatatcatcacagctagaaagatgaggaagctggggctaaggagcccggccaaggccatgtgcccaggagtgggccagggcgggcagctggctgcagagcccatttctagatgtcctgc

SEQ ID NO: 144250 - DNA, 351 bp, Homo sapiens
tatttcatttatattgtctttgaaggggactgtgcatttgttcatttagaaatatttatttcaaggtgtgattcattctaagtaaattttcctcagagacatctggaagttctccctcaaattgttagatatttccaaatgcttttggtagtaaattaattttttacagattgctaagtagtacttaatatttttctttaggaaacagatgtgtctcatgagagaattttgaagttacttcaatttaatcaaattttaggtattacagtagctgttaacattttagagattcttatatataaggaaagcactgtaaaatacacatatgtctttaaccatctgcagtaagaa

SEQ ID NO: 144251 - DNA, 580 bp, Homo sapiens
tttttggaaatggagtctcactctgtcccccaggctggagtgcagtggcgcgatcttggctcactgcaagctccgcctcctgggttcacgccattctcctgcctcagcctcctgagtagctgggactacaggcgcccgccaccacggctggctaatttttttgtatttttagtagagacagggtttcaccatgtgttagccaggatggtctccatctcctgacctcgtgatccacccgccttggcctcccaaagtgctgggattacaggcgtaaaccaccgtgcccagccgtaaagatttttacatgtaatttcagaggattcaggactcctggaagtttatcctgtattttttggtgtggaagtgaaaaattatgaggggtgatttctcccaccgccaatatttattcatagtggaagagtatcctttggctttgtgagcagattaaatgagttaatacgaataaagtgtttagaacagaaaatagcactccataagtgttagctactaagtgttattatctgacagagggttactgtatactgtttaatatcctgccaaataaagttttctgagttgt

SEQ ID NO: 144252 - DNA, 399 bp, Homo sapiens
ttgaatgaatattgatgtgacccattaaattcactttaagcctactaacgggttgtacctgatgtttaaaccacagtgcaaagctttgctacttaaagtatggaccaacagcatcagcatcacctgggatcttgtcagaaatgcacaacaacagtgtttgaataatttctaaactctatagtactcttatccaatctttgcctacatattgctaatgatggggaactcagtacttgtataggcaagcttaatccatatgttcatgattcatggttagaaaactcttgggctacaatgaattgccattttttgctgtgtagatggctttcagcagatggtttcagagctacttcttggagttacatagatgatacttatagaaagagttgaaagcattta

SEQ ID NO: 144253 - DNA, 573 bp, Homo sapiens
tctgtagctggcaagctggagtgtcagaagagccaatggtgtaagttccagtctgaaaacccgggctcaacaaccaggaagagccaatgcttcagtttgagtccaaaggcgggaaaaggctgacatctcagctcaagcagtcaggcaggaggaggtccctcttactcacaagtaggtcggtgtttttgttctattcaggccttcagttgattggatgaggatgcctacattggggagggcaatctgctctactcagtccactaattcaaatgctcatctcatccagaaacaccctcatagtcacacccagaatcatttttgaccagatatctggggacactgtgacccagtgaggtttacccataaaatgaacaatcacagagaccaacagacaggctttcttggcttgtttaccccttctatgtcctcatatccttggcttgcccagatcatattgtcagcacgcttccctttccatgaggtattctcccctgggctcaggaatgttaaacattgctgtcagaaaccagaagctagcagggaggtaagaaacagattttccctcaaagcctc

SEQ ID NO: 144254 - DNA, 496 bp, Homo sapiens
tgctgcatgtagatgagtagatggaattgatgatgactttgaggaaaattttaagtaagccaagtgccttctcagtgcctgacactatgccaagcaccacagcacatccaagagtttaagagtcattaagtcaacataataatggagcatctctatgtgtcaggtgctattaacaatgctgaagccacgcacagtggttcatgcctataatcccaacattttgggaagccaaggcaggaggactgcttgaggtcaggagtccaagaccagcactggcaacatagcaagactccgtctctacaaaaatttttttttaaattagctgggtgtgacggcacacacctgtagtcctagctacttgagagactgaagctggagaatcacttgagcccaggagttctgggctgtagtgcgctatgccgatcgggtgtccgcactaagttcggcatcaatatggtgacctccctatattgcccaggctggtcttgaactccta

SEQ ID NO: 144255 - DNA, 306 bp, Homo sapiens
ctttctgaaagataagctacgactagcttgaatttctaggtgaattggactttgaattctttgatcatttctttgcagagagtaatccaggttaatgaatgacaatgtaactgaatacactttacacggtatccttattacagagaaaaaaatataaaaatacttccttgtgtataaactgaactctggccttcacatctttgcactaacaataacactttctgacttcatgcagaatatttttaaaatctcagtattgtttttaaatgccatatgtcttattttccttctcccacatgcataatt

SEQ ID NO: 144256 - DNA, 292 bp, Homo sapiens
gaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctatta

SEQ ID NO: 144257 - DNA, 250 bp, Homo sapiens
tactgggatgatgaagagcccacagactttattgaaagaaaaatttacaaaggatgtcgcatctctacaaataggataaaggttgttatttgtaaaagactaaaagttattttaaatcaccctttaaagtgccaagtggcagaattaagaccagtgattgaattgagtacaagaaggtacatttcaactcaacctttagaaagttcaagtttctataagagatgtgaaaaatgatatgacctggcattca

SEQ ID NO: 144258 - DNA, 171 bp, Homo sapiens
tgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaa

SEQ ID NO: 144259 - DNA, 399 bp, Homo sapiens
ctaactagcaggttcatcaaatgattgtctgtattagctcaacagacacgtgtgtgaatgtcaaatacacgtctatttatagtgtcaaagcattgcctggagtgaactcactgctacttaaacaaaatgctcactgcggataagggcaatccctgctctcagatgtggaagacagaacaaggaaggccatggagctgtgggacatgacctccatagtcacacagagacctccacagccacatgggacgtgacctccatagtcacacaaagacctccacagccacacagatgagacctccatagtcacacagcgacctccacagccacatgggacgtgacctccatagtcacacaaagacctccacagccacgtgacgagacctctccgggtcacacacg

SEQ ID NO: 144260 - DNA, 542 bp, Homo sapiens
tagaaaacccattgtctcagcccaaaatctccttaagctgataagcaacttcagcaaagtctcaggatacaaagtcaatgtacaaaaattcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaactcactgctacttaaacaaaatgctcactgcggataagggcaatccctgctctcagatgtggaagacagaacaaggaaggccatggagctgtgggacatgacctccatagtcacacagagacctccacagccacatgggacgtgacctccatagtcacacaaagacctccacagccacacagatgagacctccatagtcacacagcgacctccacagccacatgggacgtgacctccatagtcacacaaagacctccacagccacgtgacgagacctctccgggtcacacacg

SEQ ID NO: 144261 - DNA, 783 bp, Homo sapiens
gacattttcattatttctggatggcaccgaagtactttttctttttttttaaacttctcttccagaagtaagatttttaccttttctttaatcgtaattagggactagttatgattgttactttacctcttggagtggaataattaaacagtagccattttccttttattaacagggtattatgagttaggtttcccccagtacccatgaacattcccagcatctcatcttccagaataacggagtggacgtaataatgtaatcaactatgttaataaattggcattgtttttctccaaggagaagatgctcgttattggaaatgtaaagcttctcaagaaagccttagagtcacagctacaagactccatgggttagtggagttagtggtttccttattgcaactccctaattgacactgatgttactgctctaataaaaaaagcagggcaaacatagcacctaccaaacgtggtatccttttgcatccatatactcttccctttatattcaagggttcagccaataaacatttactaggcatccattgtgtaccaaacaaagtaattagtgcccaaggattaaaaaaagagaatgtcatggtgccaaaacaatactagtgtgtgttaagtgctgtaacagaagagtacatataaaggagagacctgaggtttcacagagcaagcggcattggttttgaatgagtaggagttggggtgaggttaaaaaagcgagactacagtaagtggagggacagatagcctaactttaagcagagggaac

SEQ ID NO: 144262 - DNA, 1201 bp, Homo sapiens
cccacgcgtcgccagtgatgccactgagatggcacctgtcaaaagagcagtggttccatttctagattgtggttcttcagataaattctgccattttcatttcacttcctgaaagtcagggtcggctgggaaaagttgttaaacaatatgctaaatgtgaaatgtcaaccctcactctaaactttccctgttcacagcatcagatgaagacttcattgggttttagagtggctttcaagaagggagtttgaaagttgttgtatactcaatgattgtctgcccatgtcctgcctgaaataccatgattgtttacggaaagtatctttaataaagctggatacagtttgaaaaacaaaaaaaaaaaaaaacaacaacaaaaaaaaaaaaaaaaaacaaaaaaaaaaaaaaaaaaaaaacaaaaaaaacaaacaaacaagaaaagaagaaagaagcacacgagaaaaaacacaacacaatgcgcagggcgagcgcggcaacgaagagccacaacacaagccaggaacggaacagtcgccgcacaggacacacagatcgccgcacacgcaagccaaggtaacaaacacggaaagagcagaaacgaggagacacgcaacacaacagcgcaacacaaccacccccgagcaccagacggcgagaccccagacacgcaggcgacaccgaagacaaccgagacacacgcggcacaacaacccaacagaaacgcagacaccaaaccagcgaccaccacagaaagaaaacaacagaaaacaacagaaagaacgaaaagagaacaaatacaagcaaagacacaagaacaacagaagagaccaacattgtaccgagcgagtaatagacacagaaacagaacgagaaatgaaacgacagaaaacacgacaacacacaaaagcgagaagcacagaggaagcgaggaagcgaagaaagggagagaagaagaagacagaaataaggacaaagaggacgacgacagaagtaagacagaaagaaacgaacgtcacaaagacaaagcagcacgagcagcatcaggatacacaggagagcgaagcaacaggaggacaggcatacacagtcagatcagccactgaagacatgaaaaaagagcagcgggcgtcgggcgcaatccgaccgggcgcgaaggcgccagcaagcaggagaaagcagaaaaagaggcaaaagaaaacag

SEQ ID NO: 144263 - DNA, 312 bp, Homo sapiens
gccctcgttgctcccagattctctctgcatccagacagaatattcaggtcaattaaagacctaaatatacaaaacataatgttgaaagctgtagaaaaaaatatggcaatagctttataaagaattaattaaaagaccgggcacggtagctcacacctgtaatcccagcactttgggaggctgaggtgggtggatcacttgaggtcaggagttaaagaccagcctggtcaacatggtgaaaccccgtctgtattaaaaatacaaaaattagccaggcatggtggcacatgcctgtaatctcagctactcagg

SEQ ID NO: 144264 - DNA, 818 bp, Homo sapiens
ggcagaagagtcccgtcacagcatggacacacccagctcggtccatgctccaacgtgtcctggcccctcgggcacagtgtctcttgtcacctgtgttcagacacagcgtcaggtcgccttgtgggaaggcagcgtctctgggctgtcacctgttttcagacacagcgtcaggtcgccttgcaggaaggcagcgtctctgggctgtcacctgtgttcagacacagcgtcaggtcgccttgcgggaaggcagcgtctctgggctgtcacctgttttcagacacagcgtcaggtcatccctgagccgcacacttgcacatgggctgctgctcccctgggtggaccctccttgcccatggggaccctctgtggggccctgagctgggcctggcttctccctgagaagtgcctgccaccatctgaatcggcctgcgtccacaaagcccaaaagaacaggaggccacagtggttgcccaggaagctcagggtcagcagtgcctcggcccctgagctccgctgaccagactgcctcctggtgcagcggccacacacccacacaccctctcttcaacccacaggaggccgggtccagggagaaagctgggctctaattacatgtcctggaaagaaatcccagtttaatttagactaaaacaagaagccgtggttggaaagctcccccggagagccacctgcctgagccaggatgtgtttctctgatgtccccaagggccatggagggtagcaccagactggagccacaacaggggtggggacgcccagggctttggggttctgggggccctgacttgtcaccctgc

SEQ ID NO: 144265 - DNA, 206 bp, Homo sapiens
ttctctggacctccggtaaaaggcattccagttaacctaaagagaaaaactacattgtcagaatcttaactatatgttgcaaaattatattctgtatgatgccagcttaggtgggtagttcctacagtacaggaagcttaacaatctctaggattaaaagataaaagaatgcctcaggctcatttatctttagtacttcatggttt

SEQ ID NO: 144266 - DNA, 438 bp, Homo sapiens
aggcagatatggagttctacgtaaagggagaaaagttccatctggttgctactgaatctgtcattatgtcactgtgtgcagtgttcaacttccagagacatggtctatacttgacttggcttgccaggtgctcatgccttcagcaggagttggtaggcaccttgatttaggtcccactgagactatatgtaatataagaggtattgttcctgaagaacaagagcaggatgctattgcaagaaaaaggaggaatggatgctggacaggtataaacaacaagtagatgtctcaatcactgcacaagtgagcatcctctgtgtgcttatagtaatttgataacagatgcagaagagaatactgttacgaatcagtcatgatccaagccaaattcaaacataataagaaaaaaataaagaggaaaaaaatcggtagtgacta

SEQ ID NO: 144267 - DNA, 493 bp, Homo sapiens
atatgtctaagttaagagactcctcccactagtaagtggcaagactgggattcacaaccgggtctgaagggctgcaggactgaccccgcctgaccacctgtgtaatcaggaagggcttcccgtagaggtgaggcttgagctgggttcccagggatgcataggattccgtcagtgagcagagggccttccaggcctgagcaaggtataagccaatgtgtgttcaagacacacaagccccacgtggagtttctccctccccttggcatcacagggaggacgaaagggagctggaaagcctcacctacagtgttaactgatggaatttcacgccgggtccctgtaccttgcagctacctctggccccatccatggtcccaggctcacgatgggtgagaatcatccccttagccactgtctcccacacgtcacttaaaagccatctttaaagccattcataccttttcttaagtaaattgattttttggtttactcc

SEQ ID NO: 144268 - DNA, 836 bp, Homo sapiens
tacttgaagccagaagtttgaaaccagcctgaacaacgtagcaagaccccatctctacaaaaaattttttttaattagccaggtgtggtggcacatgcctgcagttccagctactcaggaagcttactggagttccagctactcaaggttggaggatcccttgcgcccaggagttcaagtctcccatgagctatgatcacaccaactgcactccagcctgaacaacaaaacaacactgtctctaaagataaaaattttcaaatttaaaaaggtaaaagaaagaaattcattcccatgtcttaggactttactagaaatttagcttaataaaaatcctaaattaaaaaaaaaaagctttggaggagacagaggtagccaggcaaaaagaaaaaaaaaaaaacaaaccgctttggttccccaaattcttttcgaacactcccttttttattaccccgaacatggaattacactggggaactcccgggcggtcaactactactttgttttaaccacttagggcccaggttgcagtagaggtggctcaggtcctgttaaatccccgagcacttgggcccaggcggggtgtaacacctgggaggcgcacggagttccaacacaagcgtgccaagcaagggtgaaacccccaattctcttatgtaacacattacaacaaattacgcgggggtatgggaggggggggccggtaaaaccccagctaactgcgagaggggcagacgaagaattccttgcacccacgcgagttggctgggaacaaaatgtgcctgacactacgccggtataaaagatgacaatctggtccacaaaaaacgcaaaga

SEQ ID NO: 144269 - DNA, 499 bp, Homo sapiens
gtcgtccatcctgtgcagagaagacggggctgtgagcagcaaatgaaccaaggggaagacccagccctgtcgacaggtgtgtctcagccaggtacacacacctgcctgagcgtggggaacgtgacaaaatggctggggatgaagaccatgcctgctgctagccccaaagccccttgatgccggaggctgctaggtgccgacagcttggggttccagggcgccgcctgccacctccctcggctcagccagaccagcacagagtggtcaagcgcccaggcccttccaaggctggcgagcaggctgggctgccctgacgtggggtggtccatgacatgactacaggcccctctgacctctgacaaggatgggcagagcttctccacggacccaggccagaccacagtgccaccgaggtctcctgctacacagcaaagcatcgcctctcccacgggcaaagccctgctctcttaacagtgacttgctgtcaatggaccccccg

SEQ ID NO: 144270 - DNA, 409 bp, Homo sapiens
gcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctac

SEQ ID NO: 144271 - DNA, 772 bp, Homo sapiens
tagggaattagctcatgtgattatggaggctgagaagtcccaggacatgccatctgcaagctggagaccctgggatgtccgtagcgtggctctctccaagtgtgaaagcctcagaaccagggaagccaatagtgtaattctgtctggggccaaaggcctgagaacatgtgaggctgctggtgcaagtcctggagttctaatgtccaaggtcagaagagtgtctcaagctccaggagagcgagagagagaaaagaaatcgccttttctttttcttttctttcttttttttgatggagtctcactctggagactcagagctggagtgcagtgactgatctcggctcactgcaacctctgcctcctgggttcaaatgattctcctgcctcagcctcctgaatagcgaggattacatgcacgcgccatcacgtccggctaatttttgtatttttagtagagatggggtttcatcatgttgatcaggctggtctcgaactcctgacctcgtgatccgtccacttcgcctcccaaagtgctgggattacaggcatgagtcaccgcacccggcccttttctctgtcttctttgttctgagaccccagctgattggatggtgccttcctgcattgatctcccccactcaatccacagactcacattccaatctcctccagaaacaccctcatggacacacccagaagtgatgcttcaccagttctataggtattccttaatccagtcaaattgacacctaaaattaagcatcacaagtcc

SEQ ID NO: 144272 - DNA, 321 bp, Homo sapiens
ccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtcctt

SEQ ID NO: 144273 - DNA, 245 bp, Homo sapiens
ctggtctgcatgatgagcacacgcacacacagcacatgtgcacacacagcacatgcacacacacatgcagacacagcacatacagcacatgtgcacacagcatgtgtgcacacacacagcacatgcacacacagcacatacacagcacatgtgcgcacacagcacatgcgcatgctcacacagcatgtgcgcacaaacagcacatacatagcacatacacacatgcagcacatgcacacacacac

SEQ ID NO: 144274 - DNA, 262 bp, Homo sapiens
tgttagtgggtttcccacttaaatcttctctgtatcagtgtttttcaaatattaaggcgcacaggaatcatcgagggatcttgttagcttggagatgctgattaagtaggtctgtggtggggcctgcgattccacattcctttattttttatttttattttttttttgagatggagtctcgctctgtcgccaggctagagtgagttggcacgatctcggctcactgcagcctctgcctcccgggttcaagtgattctcctgc

SEQ ID NO: 144275 - DNA, 442 bp, Homo sapiens
taatacccctccttcttgaaccaccggttggccactatactctatgcttcatcctagttcgagttaggccaacctgcacctgcctttcctgcgtaccctgttctccttgcccctgcctcccttaatacccttccccaaaccctcctcactactgaacaatgtgccatttgaaccctgctcaagttagcttcaacctgatttccctgattttataagcatcagctattttggtaacttcaaaatcttcccttttagagaagatggcctgggttttccagatatacttttgtacagtttgaatgcttaatatggaaatgtattattttgatttttttttattttttattttttttttttttttttttttttttttgggaaaaaggattcaactttgggcccccaagggggaggcaagggccccccccccggccccccgaccccc

SEQ ID NO: 144276 - DNA, 351 bp, Homo sapiens
agaaatgaacgcagccaataagcacagaaatatgttcaccctccctggaaatcaaaaacatggattaagccaaactatttttttctatcacatttaaaaatgttttaaataacagaatctattattggaaggatatcaggaatgcaacaattccacatatctctggagggaacacagattggttttggaatttcccataaaatgcctcctctctccccttctccaatttttttgtatatatggcttaaggtgtaaatcccatagcattaaatttgaaacatcagttcacaatggtaaggacatgggttccaaagccaggctacctaactcttcacttattagctatagtgt

SEQ ID NO: 144277 - DNA, 716 bp, Homo sapiens
cttgctgctactaactctttgggtccacgctgcctttgtgagctttaacactcaccacgaaggtctgcagcttcactcctgaagccagcgagaccacgaacccacactgaaggaaggaaactcggaacacatccgaacatcagaaggaacaaactcgacacgttgcctttaagaactgtgacactcaccgcgagggtcggcgtctccattcttgaagtcagtgagaccaagaacccaccaaccaattccggacacaatctcagcactgtgggagactgaggtctttcctgagcacacagaagatcaagaccacactcactgacttctcatagtcaagcaattttggccaattaaatgtcagttggaaactcctgtgtcagcttctctgtggcggtgagaagtccctgtgtgacatcccaactctcccctcacctgcgttggcaaccaagaaagccttgtgttggaggtggggccacaagtttaaagctaagttaccacctcgagggcacattcctggagagcttcccaggcccacagtggcacgtgtatgagtgacagatccacttctttattacctttttgaagaacaggaacctttgtctggaaattccacaagtatgccttttgcaagattaaaagtgccacaaagaacaaaaatgagcccaggaccagatgcatgttaaaagccatcagacacgttaagtttcatctccatt

SEQ ID NO: 144278 - DNA, 185 bp, Homo sapiens
taatttctctctcccagccaagctccccaacaaacctcactcatcaagatgagcctaattccctggctatagacatccaacagcaatatccagaggttaatctcatgcaaatatgtggacaatggtgggctgagcccataaccaactgagttgacccaggtgctgaatatggggtggataacatg

SEQ ID NO: 144279 - DNA, 200 bp, Homo sapiens
tcggccgctgcgggctctgctcagaaggggtggtgagctgcgcactacttttcagaatggaatctgctgccccaagagagcacttaagtcttaggcgtgtttataccctttcacccatttgcttttaagaactatttcaagcagctaaccagagacacggacaaagattgaaggcacggagatgtttgtggcagccttca

SEQ ID NO: 144280 - DNA, 383 bp, Homo sapiens
attggggcttagagaaataagagagaagagaaaaggaaatgaaaggaaatcttcaaagaggttttcaccttctcagaggaggaaaagaaagctatacaaaatagaattggagggctagtctccttgggacatactcaagtctgaatgctaattttacagagatattgccttctttctttgaaattttctttattttaaaattatgatataacctagtaaattgaagacccagaacatgttaaaacattttagcttgatacattataaaccaagtggcaaatgagttttaacttgcatgtcagggataattgattatttgtagctaaatgaagcactgtgccaagaatctttctgagtccagttctgtgactaagggcacctcg

SEQ ID NO: 144281 - DNA, 777 bp, Homo sapiens
acatgttgcttatccatttgttagctgatggacatttgggttgtttccatttgctggctgttgtgcataatgctgctgtggttatctgtgtacatgtttttctgtggatagatgtcttcagttctatcggataatacctaggataggcattgctaggtcatatggcaattctacatttaaccttttgagaaactgccagactgttttccaaaggagcttcacattttacttgcaccatcattgcattgccagcaattcccatattctgggaataattgttattgtctgtctttttgataatagccatcctagtcagtatgaagtgttatctctttgtggtttttgatttacattgtcctcacggccaatgatgttgggtatctttgcacaggcttattggcaaattgtatatctttgaagaaacgtcagatcctttgctcatttaaaaaatcaggttatagccgagcgcagtggctcacacctgtaatcccagcactttaggagtcttaggcaggcagatcacgaggtcaggagtttgagaccagcctggccaatatggtgaaacccccatctctactaaaaatgaagtatccaactgttattgttgaattgtctgtttctctcctgagttttatcattttttgcttttgtattttggggcttcatgtattgttaagcacatataactttttattttgtcttattgctggctgacccatttatcattataaaatgttcttctttgtcacctcacatccattaggaaggctactatca

SEQ ID NO: 144282 - DNA, 159 bp, Homo sapiens
cccaaagttaaaagcatgaggtcgattaaaacccatgcccagaggattctgaggaaatgggtgtggctggttcctgagtgagtaaggaccacagtatggggaagacattcttgggggaacgtgaggtggcattctgaatgtactatagcctccaaagcc

SEQ ID NO: 144283 - DNA, 378 bp, Homo sapiens
gataataacaaagtgtacgccagggatatttgcacaatagactcattttgtctttagcaaatatttatgaagtgtctattatgtaccaggaacttttctagtttttgaggacaccacagggaataagaaagttgtggtccatttacctacgaagttcatattgttgatggagaaacagatagaagataaatacattaaaaaagaaatccaatagtgagaagttctgtgaaagcaccaaaataatgtgatggagaatgactgggtggtgggggcaaggtttggtagctggttatggaaaacagctccgaagaaatagcatctgagctgagacctgcctgagatgaagccagctgatgggaaaatatagagatctcaggc

SEQ ID NO: 144284 - DNA, 374 bp, Homo sapiens
aggggtatggaatatttcaatacttttaacattgcctcagtgtaacccatgaagatgagccttgcctgtgaggctgtgggctaatagccaaataccttccttccatattgacattttttttgcttccaggctcacctcgaggtacttcctttcacctctttctcgggcagtgttctaggatagtgattccagctttttctctgttatacattattttctccactgccttagacaacagcgggtaatagttttgaatccattaagatgttgctttcaatttgaaatattttgtgtatacatgtatctaaaaaatgacccaatgtatgactcatctgaccgatgttcaagatcaataacggcttatatttcaacat

SEQ ID NO: 144285 - DNA, 724 bp, Homo sapiens
ggccaagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccagcttctgggccggagcaagccgaggccccagtcctaccagagccccaacgggttactaattacggatttcccggtggaggacggagggacgctctccgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtg

SEQ ID NO: 144286 - DNA, 379 bp, Homo sapiens
catgtcctgaaaaattaattctttaagaaaataccatgctgtgggcctatacatgcaagagtcatttccttaaagcactgatgttcagtcttgtcaaatatgtcacaaccaggtgctgataactcctgtcagtagaaaaaaacaattttttctaaaggatcttccaggctggacatgaagtttttggattatctgactccaattttccttcaagactgtagctagaaaaatcattcttatccagagaactcatcctcacagaaaggtccttcaatacccaatgccaattccttgcaataccatctgaaccttgaataaaaacaatataaagcagaagcagaaagtacttcaagtccatgattcctcagagagacaaggg

SEQ ID NO: 144287 - DNA, 144 bp, Homo sapiens
caaacaaattggcatggttggtcacctactttcagatatccaggctcctatcttccctgttttgttttactgctatgtggggaggaatgaatctacacagaaaattggctacatatactgggtagaatgagaggactaaaaaga

SEQ ID NO: 144288 - DNA, 760 bp, Homo sapiens
tcctcccacctcagtctcccaaagtgctggggttacaagcttgagccaccacacccagccaatagcaagaccttagagaagtgagaagaagaaagtatctctgagacaactgtatctggaatcaaaatgactgtctccttcccttcgtgatgacagaacccctatcaaaacagtgtcgaaagatggcagattaccatttttaaaactactaaaactttgacaaagcaaaattaagacttaaaatgtatcttcatgggaagaaacagacacccatacatatctaccaaaacacatacacacaaaccccaggcgttgagaaatacatcttttccgtatgacacagagcttatcaagtgctgtcagcaatgctatggcagacttcatcaaaacccagtcagaaaagcacaggaacttacacacttaggtacttcatgactagggaggagatgggctgtcacctcagtaacttcagatcacctgggaatgaggtgaggggcatggagggagtggctgctagagatgtcaacactcaaaatctatacttgtaatcagtgaagagtctgtggaaccagaatggtgctaacattcaccttattttcccagcttaattttgactgcagagcattaggtttctatataattctgcagtttgaaggcagtgtgtatataaattctgcagtttgaaggcagtgtgctaccacttcctgttggagctctggggctaaataagaggtatgggcggaagtatgtagtcgggtac

SEQ ID NO: 144289 - DNA, 778 bp, Homo sapiens
atcctgcatggagattttaggtttctgaataatcatttcaggagtcttcactttagtacctttcatctttccttccagcccaccagtagcaatctcaggcaggctgacatccccagagaccccaggaacagtcacttcacctgtaggcagtgtcacatcaatcccagtttcctctccctttgcacctgatacagagaacttggggactttcatcttgggcacattcagtttgctcccaggcccctgaacatcaatgtcaggggcctgaacttccacactggggccagtgatgctacccccaatttggggagcagaggcatccaccccaatgtgcccctgtggcttggcacctttcaggcctaggtcaccctcaagtgatggcccagtgatttgggggcccttcagcttcccctcaaggccctcaatattggcagagggcacactgacttccagctgaggggcttggatagtcaagcctggcttgccgcccttgtgccccacagagacttcaggtgcagaaaccctcagccctgcctttggtgtctggccctcacgccctgttgagacaccaaatttcggcactttcatggtgggaaatttaattttgccatgatcaccactctccagagatgggccctgtacctctactgccctacccccaagagaagatgaaatgtccactgctggaacttggacccctcctctgccacccaagtccaagccctttgcattgacattgacacctgagcctcccacctttatcccaggcatggtgacc

SEQ ID NO: 144290 - DNA, 663 bp, Homo sapiens
atcctgcatggagattttaggtttctgaataatcatttcaggagtcttcactttagtacctttcatctttccttccagcccaccagtagcaatctcaggcaggctgacatccccagagaccccaggaacagtcacttcacctgtaggcagtgtcacatcaatcccagtttcctctccctttgcacctgatacagagaacttggggactttcatcttgggcacattcagtttgctcccaggcccctgaacatcaatgtcaggggcctgaacttccacactggggccagtgatgctacccccaatttggggagcagaggcatccaccccaatgtgcccctgtggcttggcacctttcaggcctaggtcaccctcaagtgatggcccagtgatttgggggcccttcagcttcccctcaaggccctcaatattggcagagggcacactgacttccagctgaggggcttggatagtcaagcctggcttgccgcccttgtgccccacagagacttcaggtgcagaaaccctcagccctgcctttggtgtctggccctcacgccctgttgagacaccaaatttcggcactttcatggtgggaaatttaattttgccatgatcaccacctcttacaaggcgtcccgggttgggatactctataatcgcgga

SEQ ID NO: 144291 - DNA, 452 bp, Homo sapiens
ggcttctggtagaggcaagatagagaattacaaggttagagccggtatcacagttttgtgtttgacattacctacttttaaaatggattttagaattttgtttttatataggctgtagtctgaagttgtatttcaaatacttgtcaaagccttattcaggaataatggaatcattccttttttttctgtcagatataaaacttgttttaaaatgtttccattgttttctcctaaatccagacagaaaaagttaatttcattctcctgagttgagtgagtggcagagagtgagtttgcctcttagaagcctgagattagaagtaggcttgagaggccgggcatggtggctcatgcctgtagtcccagcactttgggaggccaaggcaggcggatcaactgaggtcaggagttcgagaccagcctggccaacatggtgaaacctcgtctctact

SEQ ID NO: 144292 - DNA, 185 bp, Homo sapiens
agcctagtggactaggagtaggtaaaatgaagggatgtgacattgcttttcacagctcactctgggtggctgtgaagaaagaattgtggtatgtcacagattggaggcaggcagggcccgcagttatacttggtaatacctgctaacatgtggtaataagtggcctgagagtaacagcacatttg

SEQ ID NO: 144293 - DNA, 761 bp, Homo sapiens
tacttgtttctgtgacaggcagtctctaattcttgctaccctgaatttctctggttgatatatctgatgctgcccatatagtctcattccatttgtctgcttgagcagctgactcgtcagtttcttctggtttaaatttaaatctgtattgttcctttccaattaagatcaccacctagagtaactgctgactacatggagattatagaaaaaagtggtgcttttaactgtaaggttttctgaccccatttctagaaatacacttcatcaataagtagaactttcctttattgtctataaatggcagtacaacatactggttaagagcacagactctgaactagacttgaaatagctggtcttgaactcctgatctcaggtgatccacccaccttggccccccaaagtgctgggattacaggcataagccacggcgcccagccaatatttctaccttttggggttgcttcctcatcatggaattaatacttgcttatggaggctgtttcctctttataaacagtacccctcacttgtagctccattctgaaaaattctgacagataattcagcagactaaacgatcaaatcaccctggcacgttcccctcagctgggctctgcagggcagctaagattgggcactgatgttcctggcttcagtcctacccgggttatgcagctacggcttcatacatacaccagttgcactaacttgggatgaaaattaagttaaaaccagtagaaaatttcatcctatgt

SEQ ID NO: 144294 - DNA, 311 bp, Homo sapiens
ttttctcatttcagtttcttcatctataaaatgaggattataataatggtacccacttcctggggttttatgaattattaatgttacatggaaagtacttacaataatgcgttgtacaaagtagaagctatatgttgttattgtattgctatttatctacttaaataactcttactgtagtatgtattgctcaaggacagagattgtgttgctcatctttgtgttatcccacttagcatagtttctaagcaaatagtatagttctttcatatatgcttatcaagtaaatgaatttgactctacctcctaat

SEQ ID NO: 144295 - DNA, 539 bp, Homo sapiens
ttctgtccactcacttccccgtgtctcccagtgttcttcctcggagctgtccgctgctgggaagaggagtcctcctgggcctgtgctggtgtccctgcagccttcctgtccccagatgtgctggcccagagacaggagccatgtgcctggcactgcacctgcccctcacttcccatctgggaaaaccagccctctctgctggcctttcactcagcagagtctccacctggctactgtgagcacatccctggagcaccccacataggacaggaggggccacaggcctgcggcagccacacaatcataaaggctgaagcttgctgagctgtgctgacaaaagctggggtgtggatcctctttactggctgtgcctgctgccgttcctcttcaacaatctccttcgtatcacgagctcttctcacctggaccacttcccccatctgctctcaagcccgcatcctggcacagcctctacgccttgtgctatggctgcattcaagaagtctcaggaagccagggacagagccgagggcctgact

SEQ ID NO: 144296 - DNA, 565 bp, Homo sapiens
gtgggctggacttatttattcaattttaatgagtagaccacagaagcagctatgggaactcacttccaaggttatgttataaaagaagagtgacttccatcttaagatgtctttatctgtccttcttgaatcacttgccttggtgaatgccaacttccatggcatgaggtgtcactgtgcagagacccacccacctgccaaggaaacaaggcctgtaagaagcatgtgaataagcttggaggaagatacctccatacctacatttgagtcttcagataaaactatagttccagatgacatctttgctgcaacctcataagagatcttgaccagagacactcagctaagcctcattctgcttcccgacctacagaatctgtgagatagaaaatgtttgcgttattaaattgcaagttttacagtgatccgttacaaagtaatagaaaacttacatagttagttaaaagaatgagaatagttgagagttgagctcatttaagaaaaggtggtagagaaagggaagtcaaaccctgatgctcaacagtggctaaaggttagaaccaaa

SEQ ID NO: 144297 - DNA, 440 bp, Homo sapiens
ccaagttagggctccctccttgccctgaccctgaggcttcctttgcactgggggtaaatatgaaagagattcactcctcctcctgtccatcgtctgccttctgggaaaatcccagaatggcagggtggtgctcaggctgggtcaggacttagtatgggggagatgggtctcacctatgataggttctgagtctagccaggaccactctgggctgacgtgtggcgctcagctggacagggccccgccctagcctttggaaagggacagggcaaagctgacaggcctcactcttgatctcaaggacagggactccctcctctccctctgggagagccctcgccctgtggcccactctgcctgccccctctgacctctccacccttcccactctgccttgtgaaaggcaggacatccccaaagcttgctgtatttggagcctg

SEQ ID NO: 144298 - DNA, 1620 bp, Homo sapiens
cccaccaggtgtaacaccaccctgtgccgtggacatcgcatcttaggaatgaggaagcaaatttggaaaagtaaatgacctacatcagacagcatggtcacgaagtgcggttaaattcccacatgcaactccaagccccaagcaccctccactccaccagcatctggcttcaggagcccctcagctcccaccgaaggccacacgccgggtggatctgttctctgcacagccatagcaactctcggatacagctcccagccagggctctgaggctgaagccctataatgtgtggcacagcatggctttgccactgggtgcccaggtggacaagtccagaggaccaagcaaagcgtctcaggctcagaaacatcgggcccacatctgctgccaaggaagtgaatttaactcccaaactgaggttgcaggcggaaatgtccagcgagctcaaacagctacacataaaacagggaagcgtgaaggctgccaggtgacgggggagccagccaacaacggacaactaaaaaattaaacaaaaatcaacgtgcaggccaaaccaaaccagtctgcagcctgtgtgaagctgaaaccctacggcagagtttctgaacactggcaggctcctgacatttggggccagctcgttcttgcatgggggccgtcctctgcaccataggacccttagcagcagtgtccctgatttctacacattaaagcccaaaagcatcccctcccccctccagttgcaacaactagaaatgtcttcaaacattgtcaaatggaccctggcggcaaaatcaccctcagtggagaaccactggctccagcccagggagtggagagtgtgcgctaccttgccaagcaccttggaaagtgtgctgatttgaatcattcaatgttcaaatgattaaccatccccattaaagagagtcctaacagtggaaaaaaaaaaaaaaaaaaaaaaaaaaaaaaaaaaaaaaaaaaaaaagaaaaaaaaagaaaaagagaagaaaagaggaagaagaagaagagagaaagagaagaaagagagaaaaagagaagagaagagagaagaaagaaaagaaaacaaaaaagcaagaaaacagaacaggaggggaggaacaagacacaacacagccgacagaggaacgagagagacaacgcacagaacagccgcaacaaaaaaagaaaagcggacgaagaaaaaacaaacaaaagacaagagcaacgaagaaaggaaagagggcgcgggcggggcgcgcagacaagcgaagcgggggagcacagagaagaaaggagaagaagagagaacgaaaaagagacggggaaggaagaagaagaagaacggagggagggagaggaggaaagaaacaaaagagggggacaggagaggcggagacggggatagaaatgacgaaactaatgaatattagaaaatagtaaataatataattaagggagaggtcgtaagaagtatagcgtatagaaaagaaaagagatagcaagaaaaagtgtgtgagtgagttgatcaataaaagtgaataaatcacagaagtagagggtaaagaaataaaaatagtaaaaataaataagagaagaagaaaaggaggtaaaaagaaatt

SEQ ID NO: 144299 - DNA, 282 bp, Homo sapiens
gggtggacggggtcactacgctgtcctcacaacagaggccctgcccacaaaggagtggaggaagctcatcctgggccactgccaagacatactgtgaagtgggaaaaaggaaggagttggacaatgggcgcagtgtgctctgattcaagtgagaagtgcagatgtttgtgactgccgaggggcgtgtacgtgcagacgacccctgcaaatgcacagccggcctgtggctggagaaccgaggactggggtggggccggggccacgaggctgcctttgtgtact

SEQ ID NO: 144300 - DNA, 528 bp, Homo sapiens
gaacatctcccctcctgctgtgtgcgctctactgctacagtgtgcacaggtccaattagaatgccagtggaagggctggccatctgcctgagggagtgggagccctggagctcctgaattgggagggtcttcatctttctccggcttcaaccttaagtctgctctccaaatgacttgataacaccataggaaccaaagattgtaaagcaaagtctctccatgtcttgctctgccccctctgcagattttcctgcattcatttccccttggcaccctttcccctgtcttggtgccagaggtgtgacctgacctgtcttaaggccaatcattctatctggccactggatcctatccccttgggtccacccaaatgacactttctttcctctctctcaactactgcaggctgtctggctccactgtctcttcctcaggtgcatttaacttgtttttatttcttccatctttaaaagaaaaccatctaccctccttccttaccagggccaatgcctgtcacagctaagttaa

SEQ ID NO: 144301 - DNA, 258 bp, Homo sapiens
ctcagttcagaaaatgtactaattaaagacagctttttacctttattactgtataaattcagtataactaggccccatgaaatgggcataagataaagaggaataaatattggaaagacatttaaaatattttagtgaacagggtagaggggtagaaatattttaaagtgcattgacttagtatctttttttgtgttgtttatattgtacactctaatttgcaagattttatgttcatatctactttgcttatagtga

SEQ ID NO: 144302 - DNA, 244 bp, Homo sapiens
ttcaagcctgcagtaagccatgatcacaacactgaactcaggcctgggagatagagacactgtctctaaaaaacaaaaatttcaaaaaagggtttttttgtttgtttgttttaattttataaaagaggcttgggactccagcctttgagtccttgggaacccagaaggacctgagagttggaaatccacagcattgaagagacggataaaggaatgatgagaaaaaggtgtctcttagcaggca

SEQ ID NO: 144303 - DNA, 422 bp, Homo sapiens
atatgtgtgatcacttcaacaagtgccaaaaagcatttgataaaattcaacacccattcctaccttcctaatgggcagtggaggtggggagctaaacatagaagagctaaaaatagaaagtaactctcattatttgcaaacgatatcatcatttaattgaaagacttaagataatcaatgacaatctattagaaccaataagggagttcagcaatgtggccagatacaagatctgcatgcagaaatcagtagctttcctatcttctggaaagaaggagtttgaaaatgtgattttaaaaggagtgggtgggcgcggtggctcatgcctgtaatcccaacactttgggaggctgaggtgggcgaatcatgaggtcaggagttcgagaccagcctgaccaacatggtgaaaccccatctctact

SEQ ID NO: 144304 - DNA, 340 bp, Homo sapiens
ggggagtgtcctggaaccaatccctcacagatactgagaaatgactgtacgtttatcttctaaggtatcaactctggaatctgataagggagaataaaaacaagtcttgactgagtgtagatggcttaaatagcagtcaggaattcaaactcccacaccagcccccaaattactgctttatggcaggggagatgggacttgactaaaatgtaggaatttggcaggggaaggatcatcagcagagtcaaggacatgggaaaaccacactcatggaatcaaatgtttagtgaatagggttcacgcagggcagcaaaagtggcctgggcagcctttcatcact

SEQ ID NO: 144305 - DNA, 263 bp, Homo sapiens
ctaagttgctattaaatatcttagggtgaggagctcctggtcagcagttaatgtggtccagccaccatagaagcttctggtgcagcagagatgttgagatgggaagaactcagagacaaccctgggcacatccctgggccacccacacaatctgagatacagaccatcatgctgccctgcccagcgggcccctgtgccgtacattcggctccatagcaagttttgcccagctctccttgtgtgctgaggcctgtgtggcagag

SEQ ID NO: 144306 - DNA, 324 bp, Homo sapiens
aatgccacatccaagttcacagatcacttgaattctatccaaggacccaaggttgagaattcctggaagtcaggagctttcttttgtcccttttgttttactcctgacgagaaaatgctctctgcacctaggtatagacccaaacaaactgaaagcagggatgcaaaaagatacttatataccaatgttcacagcagcactattctcaaagccaaaacgcagaagcaactgaaatgcaaacggacaaactgaatggacgaacacacacacacacagacacacacacacacacacacacacgtattattagtcaacctttaaaca

SEQ ID NO: 144307 - DNA, 281 bp, Homo sapiens
attgggggcaaggtttttgagtcattaataaatattaagtaaaaacaattttgaattgaaaaatgtgttatggaagtaataatttttacaaaacaaggcattcaatgcaatcaatcttattgcccactataattgcgcataatatatcattaagtaaatgaaaatttgtcttaatgcatatgaccctactcatgtcaactatttggaacatgacatgtctgttctcttctcaagaatttttggaaattccatttctgcagtttccttccattactcttaac

SEQ ID NO: 144308 - DNA, 345 bp, Homo sapiens
tgcgaagctaaactgttaagaaacatggatttttgaaacagatgtacttcttcctggcatcaccagttttttaaaaatgtgctgctcttccaaaagaacctttttatcagccacaggatgcctgcctctagtcacatttttttcccagtgggttatgccaagctattccttctctattgctcattcactcatgaaaacagggccattcagtgtgagatccttgtcaacattagaggaggtgggggctttggatagggaacttctctctaccgagtacttagtccatccacatccttgctccctttctcgcatggcatcatcccctcaattgcactcactttctct

SEQ ID NO: 144309 - DNA, 331 bp, Homo sapiens
acactcatcagaatgaggttctaggccaggcacaatggctcacacttatcatctcagcactttgaaatgccgagctggcaggaggaggaagaggatcgcttgagctcaggagtttgagaccagcctggacaacataatgagaccccatctctactaaaaattaaaaacaaaacaaaaaacaaattagctgggtgtgatggtgcgtgcttgtagtcccagctactcaggaagtaaaggtaggagaatctcttgagcctgagactggggctgcaatgagctatgattatgccactgcacactagcctgggtgacagagcaagaccctgtgtca

SEQ ID NO: 144310 - DNA, 179 bp, Homo sapiens
ccatccaatcttaacttccttaagccctatcaacaccattaggatatttgacttcagatatcctaagtttaattgaattcagtctggagcagatggcctgtgggcctcagatcatataaagatacactggttctttcctgagaatagaaatcccttgccagccaccttcccccctttcg

SEQ ID NO: 144311 - DNA, 182 bp, Homo sapiens
tgccaaatctgagtacctttcagtactatctcctctgccaaatccctagtccaagctgccatgatctcacagttagacttttgcaatggcctcgtaactgattctgttttcctccacttttgcctctctaggcctgtccttcacacagcagccagagtggtatttctaaagcaaaaatcagg

SEQ ID NO: 144312 - DNA, 473 bp, Homo sapiens
aaatttaaccttccatattccagttttatcagttgattccataatgtcctttgtggcactttgttactctcgtacatcatcccatccaggatcaggtatttcatttagccctcatgtgtcttcagtcacatttaatctggaacagttcctcagcttttgtcttttttttttttttttgaccttgatgtttttgaggaatagtctttgttttaaaatagagtatttctcatattgtcctttttttttttttttttgagacagagcctcgcactgtcactcgggctggagtgcaatggtgtgatctcggctcactgcaacctccacttcctgaggcaggagaatcacttgaacccgggaggcagaggttgcagtgagctgagatcgtgccactgcgctccagcctgggcaacagagcgagactccgtctcaaaaaaaaaagtgttgatatttctgaaatgagcagtttaaaaatg

SEQ ID NO: 144313 - DNA, 158 bp, Homo sapiens
ggatttgctggtgcagtacaactaggcttaatagggattcttataagttctacagaatacacaagaaaaaaacctcttagagctaacaaagtcaaaaagttgctggaaaaatacctgtatagaagaagtagtttgtatttctgcacaaaaaaacaatc

SEQ ID NO: 144314 - DNA, 390 bp, Homo sapiens
tcttggagaatgttccatatgctgatgaatagaatgtatattctgcgattgttgggtagaatgttctgtaaatatctgttaagtctatttgtggtagggcatagtttaaattcattgtttctggtttgaagtacttctgtcagcttcagcccattcctggtgttggctcttcccatccccctgccctgcccaggccttcaggatggtttggctcttggtgttcttgtttttagtgcctcctctgcaaccctgtctggaaacctttgcacagaccagttctcaaccccagctcctctgagagacccctgggctcctggggcctctctgttctttggccatgctcccgccccttcctcagatggattgcccccagaaatgtaggtgccacct

SEQ ID NO: 144315 - DNA, 610 bp, Homo sapiens
tcaagttcggtacttggcacataataggtgctcaggaaatatctgttgcctgaatggttggtgagtcatttaacaaacagcagagatcttctacctcttagtgtcttagcaattagcagagtgtcttacccctagtaggggggtgtttaaggcctctaaaccgtgctcagtctttccaagtgcaaaacctatttttactgtactttaaaggaatattgggttccaactctgcacacgtaggttcatctacaattaggggacaaattgtaggttttttcttgtcttccgaccagttcttgcttccagtcttgagtccggaagcacatttataaaataaaatagttgggtgggataacttctaagattctttcaaatcagagccctatatcactctgctaaggctaccataacaaaatactctagactgggtggcttaaacaaaagaaatttattttctcagagtcctggaggccgggaggtccaagatcaagaagtcggcaaattcgattcctgggagagctctttccagcttgcagatgccgccttctcactgtgtcctcacgtgccctctcctcagtgtgctctggacccaccagcaccattcgctttc

SEQ ID NO: 144316 - DNA, 476 bp, Homo sapiens
tttttgtatttttagtagagatggggtttcactgtgttggcaaggctggtctcaaacttctgacctcaagtaatccaccctcctcagccttccagagtgctggtattacagacataagccaccaagcctggctcagtttttttatttttcgtagagacagggtttcacagtgttggccaggctggtctcaaactcctgagcccaagtgatcttcacacctcagactcctaagtagcttggacaaccatgcctggctaagtttttgtatttttggtagagatggggtttcaccatgtttcaccaaactcctgagctcaagagatctatctgcctcagcctcccagagtgctgggatgacaggcatgaggcaccagacccagcatctgcatggggtttggtcagggctgggtctagggacccagggctgggtcaggaaggggagcccattccagcccagctcccactgttgcagcgtg

SEQ ID NO: 144317 - DNA, 734 bp, Homo sapiens
atgaccagtgatgatcggcagggaatcacagctcctctgagggagttagcagccgggccactcacagcctctccagacacaaggcctccaggcacagctcctgggtatgggcgtgggcatgggccaccctgggggcctcactggcagagtcatagatgctgctgctcccagagcagactccagtgcagccccttggggaccctttgcgtgggaggagtcgggcaacggcagcccagcgcctcgaggtcagcacctgtgtggccggctggagaggggcggaatcaccccggggccttcagagtcgatcagtccatcaggctgggctctgtccccgggcagggagtggcccattggtggttcctactgtcacgaagcccatgggcagagaaagtaaagcaatccttaacaaataagtaactaggaactcaaagatcttcccaataaaagcccatcagctatgtcatgaccttaaaatttgaccttgaaagaagagtttgggggctgggcatggtggctcactcctgtaatcccagcgctctgggaggctgaggcgggcagatcgcttgagcccaggagttcgagaccagcctggccaacatggcgaaccccgtctctactaaaaatacaaaagttagccggatgcagtggtgcacgcctgtggtcccagctactcgggagtctgaggcaggaggatctcttgaacccaagaggtcgaggctgcagtgagcggagat

SEQ ID NO: 144318 - DNA, 532 bp, Homo sapiens
ggtgctagggaatcggggttgcactattacagatggacggtcagggcaggccttgctttgacttgagcagagacttgaaggaaatgaggaaataagccaagtgctaattatctggaaaccttgtcatctcttattttcttaccgttcttcaacttgttatgtgcagaccttgattaatttaagtccctaattataacacatttgtatacctttaagtgtctcagtgttccctacattaaatgatataatttttcatctcttggtacagtgaaattatgaggaatctcaggataagcattgccggggagagaggttgattatggctcagtagaatgtaattcctaaaacctgaggacactataagactgaccatgatttaatgttctgttttatcctgactaatggaaggcatatagggccatgtatgtttaaatatttcctgttacatagtaactctcagtacatgtcttggaaaggaaagaattaaaatcttaaataaaatagttgattcctttttccaagctacagattt

SEQ ID NO: 144319 - DNA, 266 bp, Homo sapiens
aggtctatcgatgccaactgaaataaaaggtgtaaaagctgaaaaatgtggcatgaataagagactctgcctagaacagtagaagagctaggtaaatcagaagctgaagtttaaaagctacatattttaaacagcggttagaggtgaggggatatgaattgagtccagctgcaccagtctccttgtggctttcctgatatgccacatgtgcatttcctcttaggatatttgcacatgtggcatcgataaacaccgggtaccgagct

SEQ ID NO: 144320 - DNA, 765 bp, Homo sapiens
agcggggtcattccagatgcctgcaggtgatcagatatctaagtaaccctcttgccaccaaataccacacacacttcagttactctttcaaaaaaaattatcaagcaactgctctgtgccagagactcttctagtcctgaagatacagtgataaataagatagagacagttcctgctgccattcagcttggttctagtgagaaagacagatatattaaaaaataacttgacattacattttcaagaatttaagtactttattggaaaatataactgtgtaagaagacagatattgacaaggacacttagttcttgtagcgaggaagtatagacttaactcttattattaaaagagtgtttaagaataaaaatatatcaatacccctaactttggagacaaactgaagtactgaatgtacttctatttttgatttttcccttagcatggtgagttgtttgggaaatgattcaatagttatttgtagtttctaaattctcagcagcagttgcctcctgatatgtgtcactatatattctgagttgacatctgttatctgaatcaccaaaatagtgccttgttttaaaatttatccactattggcttatgtttatcttactctaggccatgttatcactacatgtgacatctctgtatatgtgtttgtgaaactgggataaagttggcaaaacttgagatagaggaaactatctatgaaacatgttttgcattagtagaacaggaggcataagcacatttggaataga

SEQ ID NO: 144321 - DNA, 266 bp, Homo sapiens
gaggtaattaaagaaggcagatttaggcctgaggtggttaagtctcaaggaactatggctccgggcaagcccaacctgtgccctgaatgaggaaataggaagccgcaggcctgacactcctttcctacaccagcttttcttctctcaggtttctaaagccagggaaatgccagttgtcagcctgatcgcttctttttctcagtcatttaagacccatttatgggcacccgctatgtgccaggcttcatgctgagtgctgcagagag

SEQ ID NO: 144322 - DNA, 289 bp, Homo sapiens
tcccctaatgccattgcctcgaggctcttctttttctattcttttaaaagtgaccattagaaatattaattagaatctacaattgggccattagaatcttcccaacttatgtatctacataacaggggccttctactgacaactagaactcaaagagtagaaggcaagcagtcatgcactcaagcaggtagcagggagcaacactcaggggtagggagctctgagaacccctccaataaaacagtgcttgcagctcactatccctcccatgagcagtcacggctggaag

SEQ ID NO: 144323 - DNA, 517 bp, Homo sapiens
ggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgt

SEQ ID NO: 144324 - DNA, 169 bp, Homo sapiens
tagaaaatcttccaaatacgaagcagagagttaatgcctcctgaatgcatttaagtagaagcatattattgtgcttattttatttggtcttttttaatgtttatttctaaccgtctacattgtggggccatttaatttctacatgtttgtaagaatacaataaggtaca

SEQ ID NO: 144325 - DNA, 536 bp, Homo sapiens
ctggagtctgtcagggggtggcggactaggggagggatagcattaggagaaatacctaatgtagatgatgggttgatgggtcagcaaaccacaatggcacatgtatacctatgtaacaaacttgcacattctgcacatgtaactcagaacttaaagtataattaaaaaaaattaaaaataaggacgtttgtaggcttgttttacaggaggccttgtcctagagcaagttcaatgacatcatcaaagaatcctcttccagactttctaatcttcaccctcaaactgcaatagttgttatatgactgtcactagcaattgagactacatgctcccttatttatatttggagggaaaggctggctttgtgtgctattttatgaagcaggatttttctctgccagatgcttctagccccacttttgattcattgccccaaatttatttaaagctgtccatccttgtatccaatcacttgtacggggcacgggattactaagattggcttaagatgaaacacaccccaccctgagctggga

SEQ ID NO: 144326 - DNA, 530 bp, Homo sapiens
cacggtcatgtttggagctggtttccagcaggtgcatgtgaggaggagccagactgtcccgctccccactccacaccctcagtctggcttctctgagctccatcctttggcagactcagcacagcacgctcctcaggcaggcactgatctcccctgggactgcaaagatatttccacatcattctcctttgtgccttcaggtttgatcccattgcaatctagcaaggattgagagcctcattctgcaggcagagctaagttgcagagtggacacaaagctacgaagtgaaggatcttggcagaacccgctgagttcagcctgtgccgtctggaaggcccatgcggcccaagaggctgggcaaactgctcactggggcctgggtgccgggctcccagcagctgctcctcccgggctttctgattcatagagcttctccttctcctcacttaatctctaccctcccaggacgttttcctcccagtgaacccaggccctgtaaggtgcaaacctgagttagtaaatcattggt

SEQ ID NO: 144327 - DNA, 322 bp, Homo sapiens
atcacccttttgctttgcttaacctcaactactccaagctgtagttggagctatgtaagcagtatgtttggaacaaagggcaaattcccaggcactgccaatcatccccagttactcacatccctgctgctagctttaacatgctggagaaaaccaagaagcatgtggaaaaccctctatgctggcttcttcagctgtcagctttttctgaataatgggacatgcatcaatcaatgtttgtttgtttcttccatctcttgctcttcctagccccactcgtccttaggcccttcccccacttacctggattcctgcaatagct

SEQ ID NO: 144328 - DNA, 307 bp, Homo sapiens
attatgtggggccaggatatcatggctgttaaatgactgcccatgtgacactgggcagggagtgcctctgatactaggcaggctagagatgatgtttttggaaccaggagggaaaagctagaaaaagtggcataaatataggaaaagaataggaatttcaagaattgagtatagtcttaaatgttgaccaaaaaaaagtaaattgagccctgaaaaatgatagaattttccaattaggttactaatgattttaccagcctggccaacatggtgaaaccccatctctactaaaaatacaaaaacatta

SEQ ID NO: 144329 - DNA, 536 bp, Homo sapiens
aggaaggaccttttaaaagcaaaaacagtatattttttaaatgacctgttttgtaaaggtatatgaaaaagatgtcggggtcacagtggataaaaagaggatacctctaaagcaaactctgcaggtaagaaaacaagtcagagggcctgaaaactagaaatattcatgatgattttggctttccaaaggagacaagattgttgcaagtagggtaataaagcgaagagctatttgctcatttcaaaaaaacactgaggggccgggcatgctggctcatgcctgtaatcccagcactttgggaggctgaagtgggcggatcacgaggtcaagagatcgagatcatcctggccaacagggtgaaaccccgtctcgctaaaaacacaaaaaattatctgggcatggtggcgtctgcctgtaatcccagctactcgggaggctgaggcaggagagtcgcttgaatctaggagacggcggttgcagtaagccgagatcgcaccactgagctccagcatggcgacagagcaagactccatctc

SEQ ID NO: 144330 - DNA, 472 bp, Homo sapiens
accccaggggtggagcagatgctaagtgttcaccacacccaattctcttcctggacacacaggaagatgacatttccagtgacatgccccacctctaggccctagtcttttttttatttaaaggtctgagtcttgttctgtcacccaggctggagtgcagtgctgtgatcatgactcactgcagcctcaacctcctgtgctcaaacaatcctcccacctcagcctccctaatagctgatgtcatataggcatgagccagtgtgcctggctcaggccctacccttaaaagcatcccacctgattcaccagcccccttctctctctcagtaaacttggaaaccacgcattccagatggtataatttacagcatgatggaaaaagccagctctccatgggaagctggccagtcttcattggagtacatttttattgcatgaagccaatgagacttgatattgtttaactctgtgg

SEQ ID NO: 144331 - DNA, 459 bp, Homo sapiens
tcatgtctccatccagtgagctccgcaagagtaatactaccctgacttctaacaccacaattttgtctttttttgaatttatatttgtgtttggctctttcacccaacattatgattgtgagtcattcatgttgggtgaactgtaattcattcattcttattgctctataatatcccattgtgtaaatacatcacaattgatctaaactatactatactacacaaggtatgtgcattcttaaactttaatggatattattcaactgctctccatagagtttagaaacttaccattaatatacggaagtagctatcttcctacaccttagtcaatagctaatcaaacttcttaatcatgttaatcgggtatttttaaaatgctttcagtatagtttcaatttgcttaactcttacactgactgcaactgaggatcatttcatacatttaggagccacttg

SEQ ID NO: 144332 - DNA, 339 bp, Homo sapiens
gacttcactgctaaagtctatcaaacatttaaaaaataccaagtactcacaaaattttccaaagatagagaagaagggaacactttcaaactaattgtatgaggccagtattatcctgataccaaaaccaaacaaagacatctcaagaaaattacagaccaatatctcttatgaatacagatgcaaaaaatcctcaacaataccagcaaacgaaatcaagcaacacagaaaaagaattagaattatacaccacaatcaagtgggatttatcctaggaatgcgaggttgggtcaacatctgaaaatcaattaacgtaacacattatatcaatagaagaaa

SEQ ID NO: 144333 - DNA, 384 bp, Homo sapiens
ggggtgacacagcttacccttacgggagcaaacccttcttatcctgggaagatcagtaactcacatttatgaggacctcatgctgtaggttctatgtgagatgctttatctatattatcaccaacctctatgactctgcaaagtagtgatactacacgcaacatacagcagaggaagcaggcaaatcacctgaccaaagtgacatagctgattaagtagtagagctagaaaaacaaccatatcagttctactctaaatactcaatttctggtacaatttagctctttttccctatactttcccttacttctaataatcaaattttaaatcctagtcactcagtcacacaattaatatttattaagcacctactctgtacagaaa

SEQ ID NO: 144334 - DNA, 188 bp, Homo sapiens
tactagcatcctgaagttggctctaaactcccagccactaccacttcagctggcacttatctgcaagtgccatctgtgagcctggaaatgggcccgcctagcccattgctgctaccaccaacatcaacacacaccaactgagacccaaataatttttctgccattgctattgccatcctccatgccac

SEQ ID NO: 144335 - DNA, 310 bp, Homo sapiens
ctaattgctgagaatttagacacagttttacctctctacaaattcataaattatatttcaagtacagttaattctgttgtataaatgaagtgggttcaatatttttgctacaattttatctaacacagttgcatgataggtatgatttaattctcctttcctaagaagaaccattcaattgcatgctcactgtcacagaactgagactttttttgagatggagtctcattctgtctcccaggctggagtgcagtggcttgatctcagctcactgcaacctccgcctcccgggttcaagtgattctgctgc

SEQ ID NO: 144336 - DNA, 664 bp, Homo sapiens
gcggtaggcggtggggtggggggcagtggcaatgccctgggcctccaagtgatgagcttggaaacctgcttcaagttgaactgagcaaaggatgcaaaggtaggaaatacagaaatacacctcacaagagaagaggaaacataccaaatgttttaacgggtagaatttcagataaaaaacaaatcctgtattgaacatggaaaaggcacaagggggacaatgaggtctgggagaagcagcagctgcatgaagcaagtacacccctttggtgatgggatctgctggtggaatgatcagaactgagaagcctggaggaccttgcagagctccaggctgggctgtcatctctgatagtagcacaacgcagctggttccaagtatggaataaacaacaacaacaaaagccctacacactaaaatcaactattgttatgggacaaagtcctgctgccaggaaagtattgctacggtgacactgtcaggcacaggaggcaaatgggaaggggcaaggccctccgcccttcccacctgccagttttcctttgaacaaccaggtctggccattctgggcctgcagactttcagggccataatcagcagccacagactggccatttccccctttatactgggcctacacaaggaccatagtcaaaacatttct

SEQ ID NO: 144337 - DNA, 681 bp, Homo sapiens
gctcccgcccagaacagcccagatctgccggatgactggctttcttccctccctcctgctggcagtctccgtcgcctaccggctggattactggtagtgggtgctcaggaaatgtttgttgaactgagaggaagccacagcttgtgcggagtccgggtaattcagcagacgtgggcctcaggggaggggcggggatggaggcttagtaggaaagacaagtcctgatgtcatacttagctggaagttgtttctctgtctgtggagtagctgtctgattcttgccttggcctggccctggtgctagtgcaggacggtggggaaagaggaagtggaaagagcaggaaatgaccctgggctgcagggccaggcccttgcctacattcagggtgcacgtgatgtctgacctgggtgtgggggcctgggagtaagctctcccatcctgctgtgggaagaggaggttgtcgctccccatcccaacccatttcagagaggaggactttccagagatcctccttttcaccaagaagacgtgagctctactcttctttgcccaggccagaccctgccagctgtgtggcctctcctcctccaggcctcagccaccactcaggagaggcaggaggctggcgcatggttactgggattcccctggttgggcatcctgggaatctgggactgggg

SEQ ID NO: 144338 - DNA, 464 bp, Homo sapiens
ctattctctgcgtaatagccaaagtgatccttttataacctaagtcagattatgtcatttctttggtcagaacctactagtggcttctgttctcactaaatttaaaattcagaattcttatcaaagtcctaggtcatctactatcccttccctcactgtaatttaatcatattggccttttactattccacaccaagcacattgtcacctctggactttcacatgtgatgtttcctcaagcaagctcttaatgccagagagccacagaactcgatactccctcactccattcaagtctttgctcaaatgtgactctaacagtgaggccttccctgactacacaacataaggcggcatcttttcttcattctctatttcttttctttgtttatgtttattgtatttattacaacctgccataacatttaagagcaagagtttttgtgttttttttttcccccatg

SEQ ID NO: 144339 - DNA, 172 bp, Homo sapiens
tgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcag

SEQ ID NO: 144340 - DNA, 557 bp, Homo sapiens
attgctgggtcacatgtaagtatatcttaactttattaaaaatcaaactgttttccaaagtggccgtatgattgtaaatttccactaaaaaggtatgtgagttacagttgctctacacccttggaaaaagttggtattttaagactttaattttagtcactctcgtagatgtatattggaatttaaacgtgattttaatttgcattaccctaatgattaatgatgttgaacatctttcatgtgcttatcggccacagatgtatcttcttttgtaaggtgtctgttccaatcttttgcccacttaaaaaagtagattgtccaattaaactaaagagcttctgcacggcaaaggaaactaccatcagagtgaacaggcaatctacagaatggaagaaaatttttgcaatctacccatctgacaaagggcgaatatccagaatctacaaagaactcaaacaaatttacaagaaaaaaacaaacaaccccatcaaaaagcagacaaaaaatatgaacagacacttctcaaaagaagacatctatgcagccaacagacacat

SEQ ID NO: 144341 - DNA, 348 bp, Homo sapiens
tcgtattgtttctgttcacagctgagctttaagctgggtagaatttcgtgatgagtcactcctatgactggtaaacagttaatgctcataaacaattaacaatcaccttcccagcctcctggatttgctgggagaggaaaaagtactactgagggctctgaagcgggctgcagcagtaagtctgtcttctgtggcagccccttccaactcactgatgctggtgtcagctttacaaaacagaccctggagggtcacgaggagctgcttttaatagaattccacacatctgatgggtacgtggaattctattaaaagcagcaccaagcagcacctcgaattagcggggtc

SEQ ID NO: 144342 - DNA, 735 bp, Homo sapiens
tctgattgcacaattttactccagcctgggcagcagaacaagaccctttctcaaaaaataaaactttacaaaaaagaggatgtgactttttatgatatgggagagaaggagctactgttaccaaataaaattagcaagtagaaaggaaaaaagaaaattacagtagattatacaagtttagctatcagagtatgaagtttctgaatccaggattgttatgctgtcccatggtataagagacccaggttctgtttgtctcatagctcttccagcctcagcacagggccatccgcctcatggtctagggtagctgcttgagctccggcaatcacatgtgcatttcagccagcaggttggaaggagagccaaggggcacactccctttaagaacccttccctatggttgcacacagtccttcttatatcccattgactaaaacttgttcacatgtttatatctatctgcaaaggagtctgggaaatgtatcctgatagctgggactacaggcacacaccaccacgcccggctaatttttgtattttttcgtagagacaggatttcgccatgttccccaggctggcctcgaactcctgagctcaagcgatctgcccaccttggcctcccaaagtgctgggattacgggcatgagccatcacgcctggccctggatctgagcttttaaccaccgaactacactgtctggaggtctgcagcttggggctgtggttctggcc

SEQ ID NO: 144343 - DNA, 619 bp, Homo sapiens
aaccacaaaagcagcattacctacacccagaatagacacagacatcaacagaagcacaaagtgagatggaaccctgtctcccaacctgagagggagagtttgggctaaaacacgcccatgtgaggacagcatttggaaagttaatgctaaggaaataagaaggatgggagtaaaaagaggacaagccccgatgtcctgtttatcagctccccctctctcctctcctgtctcatccgctcccgccttgaggatagcgtggtttccctggactcctttccagaccagctgcagccccattggcaataccaacttccctagctggggttggctggacggtgtggttcttggcagaagatgacacatgggtagcagagtgactttggctcctgcatcgagtgcttgtctcagccccatccatagccatatagaatcctagtggtgaacatgcaacacccctgagagccactgaccaggcaggcactggggtgagggaaagtgaggggactgtgtgggaccagctgtgctgacgacagcctgccacccaagggatgcctgtccctgcaccctggctttgttcctgcacctggtccccaggaagccaaatccagtgcatttttcc

SEQ ID NO: 144344 - DNA, 403 bp, Homo sapiens
tcagccccaggtgtgtgcagaggggctcggcgcaggggctcttctgtgtgtggccgttccccgtctcgttcactcatgcgtgtgccagcctttgtgcacagccctgctttgccctgcccagctgtgtgacatcaggcaggtgactatctctctctgagcctttagtttcctcatccatgaagcaccctcacagtgttgctgagaggcttaggagactcagcttattgtaaagggtcaagttagggctttcctcatcccccacccagggaggggtgtgggcattcgattctaagatgggtcatttcaggaggctgtgccatccctgctgtggaggactttgaagacaggcaaggttttctactgcctcgggtgaactcctgcaggattcaggaactcaagagtg

SEQ ID NO: 144345 - DNA, 168 bp, Homo sapiens
ctctaaaataaaactgtaaaattggaaaggtggttaagctatttattttaaagctaagactctctcatcattcatatctttccccaatttccatcattctatgactcaggatctttctccttatcactttaacatggcacccaggcttacgggccatgaaaaacctca

SEQ ID NO: 144346 - DNA, 190 bp, Homo sapiens
gtgctctctgaggcccacagtcctttgtacattgccaaacaaatatgcccatccatttgattacatctcagaaacagcacaattctaattttagtgacaaaatcaagaaaatgaattccctcctgagggtggcttgggggaaaaagtgctgagaaaaaggctggaattaacactataggtcaatagttgt

SEQ ID NO: 144347 - DNA, 871 bp, Homo sapiens
ctgggagcttgggttagtctgtggactgttttggacaccagtggccagctcttgggttaaccccaaaaaacaatgggaaatggctctgagttctgcagacagcctccatccttttctcctgctcatggctccacccagagacagacctggtgaactgcagagctgagggaaggtgtctagctgtgaatcaggtctggcagcttccagaaagtcagtcctggagggaagccatcatttaattttacaaagctgagtgttcccatactgataaaaggtactaactaggtaacctcagtgtgccatgggggtaaagctctgggctagagcttttgactgtagagcaagaggtccctcgctcagatccaggttctccattctttatgttcaatgttggtagataactttatccacatacaacttagactggcataggccacacagagggtagggtcaccttctcagtctcattctccacgttgcccccaaacaacagctcctccactatccctccacgcttctcctctctcaaaaccatctcctttcaccactctctcctctcaccattcatgtcttctctgacatatgggactccacaaacagtggacacttttagaaccaggctaacaatcttattttcctcaccgccctctccttctgtcctcaggaatgtcaaacaccatggcaatgtgcgtcatgtaaggctccggattcatctgtgcttagaatgttaaaatccctcatggggctcagggggggagcagagaccgttccatagttttaccggttgggggggaagtgaccgggagtgggagcgatttctgtcccggaaagaacgcccaaaaaaaaaatgggggcgaaaaggggcgaaaat

SEQ ID NO: 144348 - DNA, 781 bp, Homo sapiens
ctgggagcttgggttagtctgtggactgttttggacaccagtggccagctcttgggttaaccccaaaaaacaatgggaaatggctctgagttctgcagacagcctccatccttttctcctgctcatggctccacccagagacagacctggtgaactgcagagctgagggaaggtgtctagctgtgaatcaggtctggcagcttccagaaagtcagtcctggagggaagccatcatttaattttacaaagctgagtgttcccatactgataaaaggtactaactaggtaacctcagtgtgccatgggggtaaagctctgggctagagcttttgactgtagagcaagaggtccctcgctcagatccaggttctccattctttatgttcaatgttggtagataactttatccacatacaacttagactggcataggccacacagagggtagggtcaccttctcagtctcattctccacgttgcccccaaacaacagctcctccactatccctccacgcttctcctctctcaaaaccatctcctttcaccactctctcctctcaccattcatgtcttctctgacatatgggactccacaaacagtggacacttttagaaccaggctaacaatcttattttcctcaccgccctctccttctgtcctcaggaatgtcaaacaccatggcaatgtgccttccattgtgaagtggcaacacacaggtgactggtcatctgggtgtgaccgcacaagtcaaaggcattaattgacccccacagcagcagg

SEQ ID NO: 144349 - DNA, 718 bp, Homo sapiens
taaggatttcggagagttgggctgtgcctcctggcttctcatgctctcgggtgtgtgtgtcttaacacactgaccaccagcttgtcctacctggtcagcatccagttctaggtctctgggcactcatgcctggacaggagagctggcacagcctggaggcaaagtggcaaatgtgagctgttgtctgctccacgtggacgcggagtttgctgtgtttttttctgattgagatagaggtgcactcatctggtccagggctcagcacttgtacctgaggctgcaggggctgtgccctgtcttgcccaggagtgttgccagcgagcccaggactgaccagcccaggctgcagaggtctgagctcagtgactctggccctgtcctggcagggaaggctcgcttcgtagatggcgctggtcagtcttatccgcatggccacactccctccctgtgcgaggtgctggcacagagccccacaggtgcactccctcaacgggccaggctgtggtctaggttcctccagcccccaaaccctatcttttttttgagacagggtctctcattctcacccaggctggagtgcagtggtgtgatcagagctcactacagcctcaacctcccaggctcaagccatcctcccacctcagcctcccgagtagctaggactgcaggcgcacattaccataagcttttgtacagacggagtctcactgtgttgccc

SEQ ID NO: 144350 - DNA, 461 bp, Homo sapiens
ctgtactttctgttcctatagatgtgcctattctgggcatataaatggaatcatacaaacgtggtccttttttgggactagctttttccctcttagccatgttttcaagatttatctgtgtaacatgtatgagtacttcatttctttcttttgtcaaataatactcattatgtggggaatattaccttttatttattcattcatcagttgatagatacttggatgtttctgagttttggcttttatgaataatgctgctgtagacatttatgtacaaattattctgtgaaagtatgtttcaattctcttggatacatacctaggagtagaattgttgggtcatatggagctctgtgtttatccttttgagaaactgtgagactattctccaaagtgtctacaccattttacattcccaccagcaatgtgtaaggattctgattttgtcatatccatgccag

SEQ ID NO: 144351 - DNA, 670 bp, Homo sapiens
agatagtgcagaatcctatatatactatgttttttctgtacatacatacctatgataaaatttattaattaggcacaataagacataaacagcaataactaataataaagtagaacaattataacactattctaacaatttaggtgaaagaagcattactcaaacacaagctctacaataccacaacagttgatcttataaccgagatggctactaggcaggtgggtagcatatacatggttacactggatagagggatgattcccctccttggcaggaaggagcaggaccactccagattttaccaccctatttagaacagcatgcaatttaaaacttatgacttgtttgtttctggaacttgccatttaatattttcagaccactgttgaccgtaggaaactgaaacttcagaaagcaaaactggggaaagtggaggactactgtattttatttcatttctctcacagaattttattctaatgtaacacttttctgcccaaaagtcttttagtaatctcattatacttctgctacaaatatataaattaattaaaaattagctttatttctgatatacataatattctaaatattaaacgttttttctaatttgtgttattacaattattagtataactgatcaaaacaaatctattagagaaactac

SEQ ID NO: 144352 - DNA, 253 bp, Homo sapiens
gaggtctggctgaagtgtgggggtggtcttctcctctcatccctgaggtctcttctgtagcttcatatcagtttttaaatggtcatgttatcttgctaggatatgtagaaactttgtcttatgtttagctttgaagaatttcttgaagcacatcacttataaatgtattcaatagaaagatgagcaggtgaagccactcatctcaaacaacagttactgcatcaaactttctctagacctgagcaagccaggc

SEQ ID NO: 144353 - DNA, 315 bp, Homo sapiens
aagagtttcgatgcgatgtggtggtctgtggagagacccaaaaggtttttgagcaagtgagtgacagaacaaagagctataatcacaatggatgaagaagggagagactggagtccaaggagaagctagccaggaggttgccaggaggttgctgtcccaggacaggctggctggcgtgaggcagtagctctggggacagagagaacgggtcagccaggcgagcttccaaggaaaacccagcagcacttggtgtgtgctcagtggctgcttggctggatctgggtttctacagagcaagacagagatgatacatgt

SEQ ID NO: 144354 - DNA, 364 bp, Homo sapiens
atggaagagctgtctaacgcagtttgcctttgattggctcccgtctccatgaaggtggcacgtctccgactgcttacaaggagacagggtctcaccctgagaggactcacccagagaaacaagcggagctgctctactggcttagaaatgcctggcacctgacttgtggaggcttctagttggcgtgaaattgttagccttggaaacaactgctgctcacattggaactgcaggatctttcttgaaaaagccatggaactaactcaagggccacaagcccaaatgccttcagagggcagattaataagagagtctagcagagttagtgctgatggagttccttctccatccaggccctgttccg

SEQ ID NO: 144355 - DNA, 297 bp, Homo sapiens
ctctgtgcgctctgacctccccagcctgggttcgagcccagtgccagccctcaccagctgagcagtcctgggcaggctgctgacacccatccctgccccaggcagcagtgtgagctgtggatggaccgctgctgtgaccaggtgaggggtggagaccctggctccagcctcacagtccctgcccccacccgatagagggactgggctatgccacagccaggggagctgtcacctggaggcactgtcacttggaagcagtgcctccagcactcagtccttccaaagcatgacctcctg

SEQ ID NO: 144356 - DNA, 479 bp, Homo sapiens
acagtaggggatgttagttaatgatacaaagtaatggggtagagagtgcagaggagagaacagtaactattttaagtgctcagctaaggcttctctctgtatttccttagctttgtcagctccattttcatctcctgttatctcaccctcatgctttttgagttcttttctttaggtttttctgtagggtgaaatagtcccaggaatgcttttattttggtgggttttttttcttttcgagtagattcttcacctatcttctgtatactatgcttcttttttcttttttcgctatagttttgcataaatgcacttccctttttccttatccattttgcttatccttacagtgacagtcctgtccagcccttctctttctgctggtttagtgcgggtgaatcccccttgaccaccttctcctgatgtctgaggcacgtggctgctgctctgagctggagttgcagtgctgggtttggtag

SEQ ID NO: 144357 - DNA, 234 bp, Homo sapiens
tccgccacgtgaccaagcccagctgagcactgggtctcattggatttgccatcagacactcacagtttttgtcactgttaaccctactgcacaatacatgaacatggtctaagcaattctttttttttttttttttttttttttttgtggggaaaacccgggtttaccaattgtggccagggaaatcccccccccctggagtaaaagaaaccacctgttggggcctccataaag

SEQ ID NO: 144358 - DNA, 263 bp, Homo sapiens
ctgacagccctgacagaatatgttagctattctccagattttattttaaagtcctaaaaaaatttgatttttgcggggttaacttttacatattgtttttcaaaattaatataatttttaattgacaaattgtaattgtatacgtgtatgggatacatgatttcaatacaggtaagagacagcgtaatgtagaatactgccgtaagataggaaggcagcagatggagccaagtgtgttggcatgtacctgtaattgaagctac

SEQ ID NO: 144359 - DNA, 201 bp, Homo sapiens
agtccattcattccccaggatccacaggggattggttccaggaatcccaggataccaaaatccgcggtccctgatataacagggtatagcggtctcagttcaagtccctaatataacagggcatagtgtttgcatataacctacacacaccctttcaaatactttcaatcatctctatattacttataatacctaatacaa

SEQ ID NO: 144360 - DNA, 491 bp, Homo sapiens
ccacaatcctacagtccactgaactctgcttctaaaatagtggacttggagaatggttgaagtaagaaaggaatggatccagatgctgtaggaatttggtaggatttggtgatgtaccagggatactatggggcaagtgtagaccagggatgggatggaatgatcacagtaaggccagagtgggtaggagatattagaatcaacatttagaaatgtcagaagttcaagaccagcctgggcaacatggcgaaaccccatgtttacaaaaaaaaaaaatacacacacactagccgggtgtggtggtgtgtgcctgctgcagtcccagctactggggtaggaggtgtgtggtgggggtgcttctgaggttggaggaaagtagagacagcgaaaccctgtctctactaaaccttgagctcaggagatcaaggctgcagtgaccgtgattgcgtcactgcactccagccagggtgacagagcaagaccctgtctca

SEQ ID NO: 144361 - DNA, 236 bp, Homo sapiens
tcaaactgatgataaagggaagtcccaagagcacagctgtgtagcaaagaggaagaaaaaccaatcctggttggagaagtcagttagtaagggtattccaggtagacagacaatcaatcaatcaatcaatcaatgttttaagctgcaattgatgggattatgtgaccagtttgaccacatttgagggtgtaaattgctgagtttaagtaagcaagtagtaacacaacatacaagca

SEQ ID NO: 144362 - DNA, 311 bp, Homo sapiens
acgagatgcacaagtttagaaatctaatgtatgatatgagggctgaagttaagaaaatcgtactcgggattttcggatttttgttacataagtagatttagctgctcttggcacacaggaaagtagctgtgagatgactgacaggttaatctgcttcactttagcaaccaccttactatctgtacgtatcctatgacaacatgttgtaaacctcgaatatacacaataaggtttagtggttcttttgtttttgttttgttttttttgaaatggagtctcgctctgtcacccagactggagtgcaatggtgt

SEQ ID NO: 144363 - DNA, 588 bp, Homo sapiens
ggctgaaggtggagtgctgacctctcctcctcttcttccaacacaggctcatgggcctctcctccctgcttccctgggttagttttcctctggaaaatcaggtaagtgatcatcaaaatagcaagcatgagtttacaaaggttctagaaccaagctgagccctcatacgcgctccctggttggtggtccctgactgcctctgagaaggacattggaagcccaggtggaatgtgaactctacatttatttctaagagtttagagtttactaagacccccacttttacccccacccaattctttccttcccctagcccctttgtttggtctcttttggtggccagaggtagtgaaggcaggagggctcacactttcttgggtgggctatttgcttctctgtgttttccattccatcccaccccagcctccccctgttcccaaggaagccaaagatggggcattagatttgcgtgttttagtcttctatcttcgcatgagcaatggccagaccctaattaaccctagagatgaaagctgtctcagaatccacctgggagaccataccttaaaaacattgaagagtggggcc

SEQ ID NO: 144364 - DNA, 156 bp, Homo sapiens
acagcaaaaggctcatcagacacattccagaacggagggaaaacacaaagagactttactccagtaagagaccaaaagtctctacaaagaagacatctccctaaagactaaagaacagggcaaggtattctccaatattgccttttaaaaaataat

SEQ ID NO: 144365 - DNA, 272 bp, Homo sapiens
tgtctttccctgctgctccttcacctcctcagtgaatctggggcatgttgttctacccaggatctggagcttctagcagggaccatggcagttctggaagggccattcccaagtttcgcccctgtacacctctgaaatccacactcccaattctttctgcgacagaataatcctgtttgtttgcgatcacagatcatggccccagaggcttgggccttatctcctccccagcttcattctcctgctgctcagaaaacctttcacctctgagc

SEQ ID NO: 144366 - DNA, 316 bp, Homo sapiens
cacagtgccgagctctttgtacacggaatttcctctcatgcttacaacaacctcagtaggtagatattattgttattcccactctacagatgaagaaccaagtttcagaaaggtcccaaggccacccagccagtaagtgaccaagatgggtctcaaatccaaagctgcctaacacctaagtacatgtttgtcaccaacatactctgatgcctccatgaactctggctggcacctgcccaggctaagggctggctggggaagtatgagaggaacaggctgggcaaatatttgaccagccatcatcattactgcctaa

SEQ ID NO: 144367 - DNA, 1165 bp, Homo sapiens
cacagtccacatacagggttcttaacctgcgtttttacctacattttagactgaccctgcttgtgcctgtgaaccaaccaacaatctctggctgcagctcagaaaggacaaaagagaatggatgagggaaacttcccagggcttgtctgggtatgcccacagtggactggagcccaaaatgcacactggaggaagtggatggagccacgtggatgtcatgccttatgcaggggaggagcctgctctcttcagctcctgtggtaatgtgggaatcgatctgtgaggaaacactttctgaaaatgtcagaactcttgaaaacatggatgaggaaaagcataagtactgctttatgcttttcttatgaattttaaaagatgtaatttaaaggtactttaaagtgatatttgtgcccttgtaactgattcaaagtagactgctaaggacaataagtaataagagtctacaaatatcagtaaattatgagaaaaaacggtctaatggtacttaaaattgcattgtgatttattaaataacattgaacagctccacctgtaacattaagattccatttgagcatatagaaaatatatttatcgcaacctgaagtgatttggaaagtatgctgggaagaaaatatatttacaaattagtctcagagggtaggtatcctgtagccagatggaataagaagagagggaagggagattttgttcaaagggggagcataagctaaggaataaagccacaaacaatgattaaattaggtaaagtgcaattagctgaatattgcataagcatacatatgggaagaagtggaaaaaggagtgacaatatgaagctaaagggtttgaagtgttcaagataatactaggcttcctagcctattccgagacatcttgttttagagtgcaatagataagaactctaaggatgaaagtaggagacatgcattctagtctacgttttggttaatggactgaaagtgaaagatggactgaaattgggggatggaataaaaatgtgatagaatagaaaatagaaaaagcaattagcctaatgtcattgatacttagagaaaatatggaaaatagtaaattagtgatatatatcttttctaattcaccagggtgagtgaacaaaggaaatcggatttaaaagtattca

SEQ ID NO: 144368 - DNA, 400 bp, Homo sapiens
aatactagcacagtatgccacacacagtggtgggggggctgccatccttagcccattaaataagcccatctgacgagacagatgtgagcatttcttccatataaaccaggaaatagaggattagagactttaacttgctcaagttcaaagagctagtggcatgcagaactgggatttgaacccacatccatatgattttacaactccatccacattaatggatatttaggtatggcctacatctgtccatgtctgcagatactggacacaaaatagtaaacgagagacaaggtccttgtcctcaggagctgacatcaggagaggagacagtaaacaagacttccagtagcaggtgccatggagtgggtaactgggtggtgggtagatagcaacccaggtg

SEQ ID NO: 144369 - DNA, 175 bp, Homo sapiens
gctcctggaaagggagagtttcaaagcaaactcagcttcctcttttccctcctcaggctcaatcccttgtgaaggctctttccatgtgtgtgcctccctgggcaaagtccagcacacaggcttctccctgggagtccactgatgtcagctgtggtcactaggcatcagggcttct

SEQ ID NO: 144370 - DNA, 400 bp, Homo sapiens
tgtagctggttatctgtggaagctgaaaaccagttaggaagttattgtattcaactcaggtgagagaaactggtactgagactggagtgagagtggtgctgctgagaagtgcttagaacgtggatgtactggggaagtagagctgatcaaatgtgttgatgaattggacgcagaatatgagagcaaaagagtcatcggagtgactcaggtttttggcccgagtgccagtaagaatgtcgtcgtaaaaaattagccaggcgtggtggtgggcgcctgtagtcccagctactcatgaggctgaggcgggagaatggcatgaacctggaaggcagagcttgcagtgagccgagatcgcgccactgcactccagcctgggcgacagagcgagactccatctcag

SEQ ID NO: 144371 - DNA, 221 bp, Homo sapiens
gtagatacccaggtgaatttctcatcttttgcttggtggatgttactctttaatctggcactttatgtccacaacttacctgcaacatacctttctaaaggtctctctcactacctctttttcagctccctatccatgatccttttttcttttctctctctaggtcattccctctgacataaatgctcatttcttccaatttccacacattcaaattatat

SEQ ID NO: 144372 - DNA, 199 bp, Homo sapiens
aaggattcctgatacatgacatcaccacgacacagaaagctaatctaagaactaagcccagccccaggtaaactattctgtgattcaacttcttggtatttcgacagtacactttagagtcttgtttcaaggcccttcgcagtggctcacgcctgtaattccagcactttgggaggtcaaagcaggcagatcactttgg

SEQ ID NO: 144373 - DNA, 968 bp, Homo sapiens
accgcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgttttt

SEQ ID NO: 144374 - DNA, 300 bp, Homo sapiens
tataacccaggccctgagccaggaggcctgggccagtgcagagctgtctccttcatccctctcttcaggttccttccttatgttttctccaagtctgtagcctgaattcagctggagaacttgccaagggacatttcctagtaggtcccaaactttctatagcatataatagggggatctgagtagtagcttctctttgtggaatctttctctttgaatagtctttagccaattatcctaagactcccccaacattatggtttagaaagccttatgttatgtttccttgcttttgttttt

SEQ ID NO: 144375 - DNA, 243 bp, Homo sapiens
tcagagggtgggggcttgggaggagggagagcatcaggaagaatagctaatggatgctgggcttaatacctaagtgatggcatgatctgtgccataaaccaacatggcacacatttacctatgtaaaaaaccagcacatcctgcacatgtgcccctgaacttaaaagttggaaatttttaaaaaagaaaaagtaaaatctaacattttcagtcaaaaaatctggatgtatcgaacaaccaata

SEQ ID NO: 144376 - DNA, 274 bp, Homo sapiens
tgcttattagatgcttatgttgcttagcaatttttctgtcagtgtctttgattttctcttaaagatttgtacattcttcacaaattaaagctatatactctgcctctcagatatgttacaaacttttttttcttttgccatctagatttatttgctgtgtttcactgtgctctataaatatagtaaaaaataataatagttactactttgagcattttgcatcaggcactgttttcattctttaagggtatgtacaattattattattttacat

SEQ ID NO: 144377 - DNA, 92 bp, Homo sapiens
aaacgtcatcagcctcatttaacagattaggaaataggttctgaggggttatgtcactattctcaagacaaatagctgataagtggtgaggg

SEQ ID NO: 144378 - DNA, 362 bp, Homo sapiens
gcttccaggcctcagagaaagccgctgtctctgccacaccattactgtcaccatcactgctgctgcgaaaatgcaattacagcaaacaacagccgccgcctcacttgagcctcgccatccacacctggaactaattaacttaattaggccttaatgagctacactggtcggaatgcctatttttacttaattatcccctaatgtgcttggcatggaggagcacaggacccggaggatggctttggcggtggcggtggcaaccacctcctctccctgaagaagagacactcaggaggtgatgcctgtctgcctggggcgggccccaaagagctgagaatcacaggaggatgggtgaggcaggg

SEQ ID NO: 144379 - DNA, 1116 bp, Homo sapiens
gacctatgaggcaggtagggaggggttcttcctaacatcctcatcttacaaatggaaacggaggcacagggagggctggagtgcaatggcaagatctcggctcactgcaacctccgcctcccgggttcaagcgattctcctgcctcagcctcccgtgtagctgggactacaggatgatgggattacactagctctgacctgcggtggcagtggcaccctcaatcagcagacaaccgagtacagcactagtgacgtgcgtccctcgttcatctatggagtattcttgctactgcactagtgcagctcgatgtacgcgagataactagagggatcttcaacacttgtgtagacttacgtcgtatcattcgtacgctggtccgccgacccagccaggagcctgcaccacctggactgtagaccaattgccatcgcgtaactgaccttcctacttgcatgccgtgtcatcatctgcccatgttcaacatgccttccagaagactaaaatctatacttatcagctgaacgttggcataaaatgctccagtgccttccacttgcacccaggattcaatccaaagcccctcccagggctgcccaggctgtttccccaagctccttagggccatctcctcctggctcctagccctccttggaccacttgatgcccccggatcaaaaccaggtcctcgcaggactcagccctggactgttccaggaccttccacttggtccttgccttctgtgagtatcccaaaggtccatctacgcagagagacttacctggacccttgggtaaagctgcgtctccctaagttgatccagacagcagccctgtgagtccctcaaatgctaacagcatctgcatgccatttgagagaagaaccaaaccgggcgcagcattaaaatcccccgacggccaggttacataacagctctggcaacggccacaaagccgcacaaccgacacggcgcgctaacacccggacggcaaccgccgactggagaaccaacgggcaaggaaccagagtaagccggcaaccgatgtgcaagcacgcgacccaaacccacgacaaaacacaacaagacgcatcaacgaccatgcaacacgcaccacac

SEQ ID NO: 144380 - DNA, 455 bp, Homo sapiens
gcttgctaccgagaaacctgtattaccttgagtctagggaaaaccctgcctgtcccatctaagagatggggtgggggtggcctgggaaatacttgtgaggttgagagtccaggagaacaggctcacaaagagacagacctaatcaggggcctacagaatgctcaccctttcctgacatctcatcaccacattagtaaagtactattaaaagtaattccttttactcagtacatcatgtctagctatgaatgtaaagggacaaggcaatactaaaaggcaaaaaaacatagggcaaccacgcgccgtggctcacgcctgtaatcccagcactctgggaggccgaggggggtagatcacctgaggtcaggaattcgagatcagcctggccagtatggtgaaaccccgtctctactaaaaatacaaaaatcagccgggcatggtggagtgcacctgta

SEQ ID NO: 144381 - DNA, 118 bp, Homo sapiens
gtagtattgtttgtttcataacaaaattactctcatactaaagaacataaatatacaaataggtggagattccaatccaaaagtaaaagagagagtcagaccatggagtaaatgagta

SEQ ID NO: 144382 - DNA, 335 bp, Homo sapiens
attggcccgagagaaattagaagtagaggtgatttcttctatgccttctctcaggttaggttaataaatcctttacttaataggattagctataaaatggtagattgtttttcttataaattatttttcttatatttacctttctccgtgttctgtttccttgacagttctattaaaacttgctaatttctctcggaccaatcattggtccgagagaaattagcacttttcttttaaccagtagattaaaaccatacagatttctatattgagagttgctgagaatgttgtacacatttggaatttacatctagatgtgtcatttgtggactcta

SEQ ID NO: 144383 - DNA, 330 bp, Homo sapiens
tctccgcgtagatggctcatagggcttcaaactcataacggccaggacttcagtcttcatcttccccttaaacctgaactccatcttccccatcttactaaatgtaccaccagccacctgtgcacccaagtcggaatcctggagcaccatcttcaacactccatttctcacagctgccataaccaattttcaaattctcttgcttctctctcctaaatatagcaaatctgacacccctccacctgcactgccaatacccaattcaactcaccatcctgtctcctaaccacatataggaaatatgtgagacagggtccccctccattctcc

SEQ ID NO: 144384 - DNA, 150 bp, Homo sapiens
taggaaacaacagagtaaagttaacaaatagtatagaaaatactaaaagcttgagttgttttcagtcttttatacgtaaatgaataattccataatctattctagcaatacaagtgaatatttagaaactggaagtttaaattttttaaa

SEQ ID NO: 144385 - DNA, 283 bp, Homo sapiens
cttagtgataccagagatgtacagagtaaacttatttgctgagttaacattccacattcatttcaaatattatcagaagacttataaaaattttgtttagtattaaaaaaaaccccaaacataaaacattgctataaatggtatttaacataacatgtattcagtttgttctccaggcttacagctagaatattccactgcagtgagttaggattattaagaattacatccaccaatacgggatgaagcctgtaccatctttctcatctatcgacagcccaag

SEQ ID NO: 144386 - DNA, 377 bp, Homo sapiens
gattgccagtaaagccagagaatctctcatcctcatctggaagcctgtaaattctatttcttcagtacttgtctctgtccccttgcatgtaccatttaacttcccagatgtatttccttttgttaccaaaaaaatatatactttctactttaatcattatgttgtattttatgctccagaccattttttttttgtacttttggaaactggttttgccattatttgattgacagttgaactttgttaatttaatggactaataggtttgcaaatactgttcaaatagaccggtttattgttgatagttaattaaaattgagtagaaaaatttcacccatgatttagacaaaaaaaaggctcataaaaattatccaccc

SEQ ID NO: 144387 - DNA, 222 bp, Homo sapiens
aaaagaagtcttataagtcacacatagcttaaatgctgcagcttttccccaaattctggaatcctttctaaatcagtcagcatctgtctatgtgtcttcacacacaaatactcatttcattgaggtagattgtctcttgttaacaaggagaagctttagagtttaaaaattattttgacattgggttgaataaaatctgttgcttgtgctctttcaagcttt

SEQ ID NO: 144388 - DNA, 214 bp, Homo sapiens
acagcccagctcacacacgcagcccgtcacacacacagctcagctcaatacacagcccagctcacacacacagccccagttacacacacagcccagcttacacacacagcccactcaatacacagcccagctgacacacgcagcccagctcacacatacactccagctcacacacgcagcccgtcacacagccccagccacacacacagcccag

SEQ ID NO: 144389 - DNA, 425 bp, Homo sapiens
tatgcggtaggtaccagatactggatcatggacttcatatacactattttgttgttttaatgtcataactgttagtttcatccttatgaatgaagctaaagttgtaataggtcaagtaaattgctcaaggttttagacttaccatatggtggagctgggattcaaacttctccctactttcaggctgtttttagcagcctgtttataccaaggttagctacgtgtttggaacactccctcctgggggatgccttgtcatcagagggcagctgacagatcagaagatgctatggtggatatgaggatccttccatcaggctggtaaaaactggaaaagttgtctctggtctgaagaggtgtctatttttatcagacgcgtagcctgtcccatgcacaatgtagaatgatactgtcaaaatcgcgtt

SEQ ID NO: 144390 - DNA, 760 bp, Homo sapiens
agcggctttgcgagtagaacaatttgcactcctggtcagttggacaacggctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttgatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcac

SEQ ID NO: 144391 - DNA, 318 bp, Homo sapiens
tagcctcagtgttgcatatgtcaggatggacgaacgtgagtcttggcatggtgcaagtgcatctgaattgcatgtctctgtccttgctggagcaaaaccctgttgtttggatggagcggagctgacctgacggttccaggctgttccctgttgtttggttggacgctgttccctgtttggatggagtggagctgacttgacggttcccggctgttccctgttgtttggttggagcggggctgtcttgtgtccctatcctgttgtagttgaccccattgccggaaattctttctggggccctcttgttttaagtcttgg

SEQ ID NO: 144392 - DNA, 170 bp, Homo sapiens
aggagatgtttcttcagtaagtggcaaacaatatggcttctactctatggcggtgttggtatctgtgttggtctgtgggtttggggcagaagtgacttttcaggcagaactagatcttggcaagacccaatctgctgaatgatctaccaggttgtctaaagtacagcttt

SEQ ID NO: 144393 - DNA, 407 bp, Homo sapiens
atgacagagcttcaaaatacatgaagcaaacaaggttgaaagaataaatagacaaatccacaattatactgagaatttcatcaccccactctcaacaatttatagtacaagaaaaattcatcaaaaatataaaagaaagcaatattgaccaatgagatctattgaattttacagaagactccatccaatgacagcagaatgcagattctttgtatgcactcatcaaacttgtaacaaaatagaacatatcctgggccataaaagcaaaacttgggaaatgttaactaattgaaatcatgcagtatgttctctgaccacagtggaacaaacgaatagcagaattagaatcaatagcagaaagaacaggaaaacatccaagtgcttgaaattaacaacatacttctaaa

SEQ ID NO: 144394 - DNA, 711 bp, Homo sapiens
gccatgcagttctttacaggaggggctttatttccataagcagtggctcttcagccttctgttgaattccctgggcctgtttctagctgagtgacttagctttctgccaggtgtgacttgtccctgtggataccctgggaggagtggagatctggctcggtgaagcgtgtcctcacttgctccactgtcttgcctttcgtcattctttttccccttctgtgacaaggcttgtccatcccactgcaaaggatgcagtgggtttatctttggccttgatttttatccccggagttggatgaaacaattgtgaactttattttcctttatgtggaccaaacagcgacttaccttactaataactgaaataatacagattatttacaacattcttttcacgaggtaaacagcgtcaactcatcagcttctgagagttgaaccttattggggctagttctatacttcctcaagcaagaagaatgaccaaaaattgctctgtctttctcttaaagattcttggttccttaaaattcgttttaattaattttagtatgctgtgcctcaagcaagcttaatataagagaatctagatttacagaagaagatatattagggaatgtttttattttatggaaagatacttgattggatccactaaagttcggaaaatataacttcattgattaaaatgtgacactgtcatcaccaatttat

SEQ ID NO: 144395 - DNA, 513 bp, Homo sapiens
ccaattggctatactcagcttgcaccacagtcaaaccctcaagggaaataaagtaaaaacaaaaaagctccatccaaaggacaaaggacagcaacatcaaaagataaaggaacacctgccctcacagatgagaaggaaccagcacaagaactctgacaattctaaaacccagagtgtgttcttacctccaaatgatctcactagctccccagcaatggttgttaatcaaattaaagcagctgaaatgacagaattcagaatctggatggtaagaaagctcaatgaaatacaggagaaagttgaaactcaatccagggaaaacagtaaaatgatccaagagttgaaagatgacacagccattttaagaaagaaccaaactgaacttctagaattgaaaaatttactacgggaattccataatacaactagaagcattaataacaacagatcaatctgaggaaagagtctcagagctcaaagaccactccaattgaatcaatgcaggcagacaaa

SEQ ID NO: 144396 - DNA, 349 bp, Homo sapiens
ttaattatactgatttcctaaacttgaaaagattatgttaattcaagagcagtagagctccccgctttcccttcagttttcaccaaaatgcatgccagtatcttctatatttgtctctgtataccatctgcaagcagtaattctgatcatatacaattttttattttggatattcttagtttcatgaaaaataatctcttctaggcatttacttgtaacttgtatcaggcttcataacatgtaattaaacatttttattggaataaaaatttcaaagttaaacatatatatgttaaatgtacagttaaataagttttgctaaatgcattcaccacactaataaccacca

SEQ ID NO: 144397 - DNA, 437 bp, Homo sapiens
ctccttggcctcccaaagtgctgggataacaggcatgacccaccacgcctggccgggttgataggggttttcagccttacctacacatgcaaatctcctttccctctgtaatccccaaatttagactttaattctcctgtctttcaaggggagttgccttactctgtgtgggttcagggtgagggaaacttttcagccagtttatgtcattgaagtacattgaagtttatcagggaatttctaataatagtaaacttaaaatggaaggccttggagttgtagttgtttaccagaagagtttttggctttttctgcatacttctacacacctcttacctcccttcctaattgatagagacagatttttatcaggtcacacatggaatctgctactccctttgaattcaggtctgtttgcttcaacgacgtaactgaga

SEQ ID NO: 144398 - DNA, 107 bp, Homo sapiens
tgtcaggactgatctcaggaacagagctacatggtatcagcacagcctctaaagcctgtacagatagacattcacaaggcagagattgcccgtgcactgaattttcc

SEQ ID NO: 144399 - DNA, 428 bp, Homo sapiens
tttgcggcctcatattaagagtttagaataaacaggtggaatatacaaattgaatttatgaatgcttatggcattgaaattactttcaagccacaaatgtaaaattatatataaaaaagtgagagcagcataatactacacaataggaagaaaactggactggaggttttggggacttggactcttgtctggcctgcataaactggctgctaaataacatctctgaaatggagttttcttatctgtgaaaagaaggtattaatatagctagtatttaagattactcagcactgagattatgaaatggtgtctggaatattatattgcatttataaaacacatgtttttaaataacacttaaatattatgcaatgatacagctacataatacaaatgtcatagaaagcttcaaagaacctatgagtaga

SEQ ID NO: 144400 - DNA, 280 bp, Homo sapiens
tgtgcatgtgtctttgcacccatgaatgggcgtgcccaccagaggaccccccccagaggtgaactggctaggcaaaacgtttgtgtgtttaaactgggataggtgttgtcggttgctcctcaaagaggttacaccatcgtgtgtgccccccatgatgggtgggtacacctgcttcccatgcccttatttggccaactttggtgattacactcatacttgtaacccactgagggcagctctaacagcatgatcaaagaataatgattgccttgggaggccg

SEQ ID NO: 144401 - DNA, 712 bp, Homo sapiens
tgactttctgaaggtagaatttgtattagtccggcagttaataaagtggtaggcataatatatgtttcttatacatcttcaggaagaaattttctttatcatctctgttttcctttgaagataggctctgtcctagtcagtgatctttcttaagagagaagtgaaacttctgatttccagtttctggtagtagaggactaagtcattcaagggaaccaagttccccctgaaaactactaaaaaatgctagataaaacataaaaaccttgtctttaaaagcaccaataaactaacaaggtattttaccaagccaaaaggaaaatggggacctagagaagtggagcccagaagccagttgtgccctgacagcatttactaatctgagaaaatgtgaattttctatttaataaccccaaaggtaaagggacaaaaatcaccaactaagatatgcacaaagtggggagtctaaaagagacccttcagctgggactccatgttgacaggtctcagcccctgactagactgatatggttccagagtgatgctgcctccaggtgtctggcagaggcagcgcaggcccaccctgaaggaaaggaactttacttagccttcgaattactcttacaagtaatttctgtccctcaatgagacacacaaggaaaccaggaactatgagcaagagccagaataagcgtcagaaatcacctttgca

SEQ ID NO: 144402 - DNA, 303 bp, Homo sapiens
atccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactggacctctagcaggcaaaggcagtaacttttaattctggtcatctcccccattccctttattaaaaatgtgaaatacttctaggaggaggag

SEQ ID NO: 144403 - DNA, 328 bp, Homo sapiens
cagctccaaggtaaacactaggatcagcggctcctgcctgaatgtgaatggctgaggccatctgcattgcttgcaaaccactgagccatcgtgcaccatttccattagttttatttcactttccgatctttttttggtcaaaaacatctgacctcactgacagtaggaaacacagctataggtaagtgtgcatttcatttccacttcattttcctcagttacgtcctggattttttttttttcctgagactgggtcttgctctgttgcccaggctggagtgcactggtgtgatctcggctcactgcaacctccgcctcccgggttcaa

SEQ ID NO: 144404 - DNA, 292 bp, Homo sapiens
tgtaatctcagcagtatctggctgtcagcaaggaggtggcataatggactataatcattttgcacagagtaaggacaggtctagcagaaaatgtttaattctaggtgatggctcttgcagagtcagtaaagggcacgtactaataaggaactgcaaaaagtaccggtgacgacatgcttgccttgaagagcaagctcagcagattttccacagctaatagaaccattaccgctacatgtcaagctatgagaaataccaaaggacataggcatcggagtgaaagagataagaa

SEQ ID NO: 144405 - DNA, 732 bp, Homo sapiens
cttttcccaaataaggtcacattcacaagttctgggtgttaggacataaacatatatttttgaagttcacccttcaacccattataccaccatgtcccctatctcactttcctttctaccagattcactttacaacactccaaacaaggagtttcaggtttgtagtcatgacacattcgtcattttatgtcaatatatgctgtttatgaacaactctaaaggttaaaaattattcattctattgagctaaatctattctggtataatatttgagaacacattctagatctctcctgcacagttaataggggttaagaaagactagtcccatgattctcaggttgagggagaataacacatgcactgcctctccaccattctgacacggcattataggaggtgtaagatcctctctaacaccagccccgcaaaacctcagacttaatgaacagttcatgacattgtgagccagttgtgatggaaatgtaatgaatcccctccaggagggttgggagcaaacaaaaaagactgaggaacagcaatttcagtcttcctcatgatagccattcagatgaagacaactactatattttcctgagtctgttcttttccaagatcaacacctttaattttaattattccccatgacatggcttttattctattcattcagcaaatatttattgagggcctaatatgtgccaggcagtctagtaggtattagaatgatgc

SEQ ID NO: 144406 - DNA, 255 bp, Homo sapiens
aggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgc

SEQ ID NO: 144407 - DNA, 400 bp, Homo sapiens
caaaaaagctgttgaaccagtacaggaataaaagagcagatcaactgataaaactgcacccacaagcaaattaatgtacaaatgggaacctcatataggtaaggattgtgttttgaattgagggagagactcatcaataaatacatggtattgagacaaccacccagccattgaaaaattgaccttagatatctgccttgcactattcttggaaaacacattccaaggtgattaaaatctgagatgcaaattttaaactacatcaaaatttcaaacttctaagcgacaaaagaaatcatgaacaaataaagacaagtgagaagctacttgcaacatgcacagtcgcccacccccccaaccttgagggatccattccaagattccctagtggatgcctgaa

SEQ ID NO: 144408 - DNA, 450 bp, Homo sapiens
ctattacaatgatgtgatcattgtagcataatatataatatcactataaggcagtatagcccgatgtgtagtcagactgcctggattggaatggggctccatcactcactagcattgagaccttgggcaaattgcttaaccctctctgtctcaatttcttcattgaaaaatgagtataataatagtatccatcttgtgagattgcaatggggataaaaggagatgatatgcataaggtgctttgaacagttcctgatgcagtgagcacttagctaatatgcttactatggcaatctgattgctgggacaggaatagaattacatacatgtaaaaggattatggttggttgatatctttttcttgttttatatggggacgaagttaagaagtttagggatgaggggacaggagtttcaaatcagctcagttctgtctcattccccaaggaa

SEQ ID NO: 144409 - DNA, 372 bp, Homo sapiens
aggtggtgtatgtgggtcatgggttgggggggatccatgagaaagggaatttatgcaggaactgacaggtgggtttattgctttaatttacagagttaaaaggttgctttaagtgggatagaaaaaccttgaagaaagttcatagcaggtcatcagtggtgaagggaaccagtccaaagtggtgccagcacccatctaagttcagagacatttgatggactaagtcaggaccctaaactgaaggcacccctggggactccagtcagggcctagaatttttccagggggatgacccaggtaaaatttgagtcacttgataaaccctccacttttcaaagtcctcttcccttttccaggccactatggacaact

SEQ ID NO: 144410 - DNA, 102 bp, Homo sapiens
atatatgaccatatgtggcctgtaaatggagcaaaaattatatttatttttagtaaggttttcaagttgctgttgtgacataaaatatgaaataagaaacat

SEQ ID NO: 144411 - DNA, 768 bp, Homo sapiens
gctatatcactcaggctggtcttgaactcctagacttcagtgatcctcccgccttagccccgcaagtagatgggattacaggtgcaagccactgtgcccggtttctgcatattttaatatgccagtccctatgcaaggtctgggattccaaaacgtcatgttgtccttgaggccgctgatattatcatctgctggccacctgacacttggcagcttgtagcagtggctagagaatcttttatgaaggatgagacctggattcaacaaaatttctgcacaaactcaccatgtgactttaggaaaaccatcttttctctctgggtctcattttccccatctgtacaatgaaagggttggattctaaaggccttgcatggccaggtgcggtggctcatgctgtaatcccaacactttgggaggccaagctgaggcaggtggatcgcctgaggtcaggagtttgagaccagcattgaccaacatggtgaaacaccatctctactaaaaatacaaaaaattagccaggtgttgtggtgggtgcctgtaatcccagctactcaggaggctgaagcaggagaatcgcttgaacctgtgaggcagaggttgcagtgagccgagatcgcgccattgcactccagcctgggcgataaaagcaagactccgtctcaaaataaaataaaataaaattaaattaaaattaaaaaataaagcccttgcacatcctctggttgctgtgttgctctgtagtctgggaaaacagcagaaagaaag

SEQ ID NO: 144412 - DNA, 268 bp, Homo sapiens
tttttatatgccaaactaagaaagtatgtagggatagaaaagcccagctaagatatatagtctgggacattttgtggagaaatgcatcgaccttcaacttgtccctcaccctccctatactgactcattggtgattcccaaagttaggtgtcaggctttgaacacatgaggcaggtccttctttcctttttttaattttgtttttgtggctggttaaatttttctaattatttcggctagtattaaaaaagtgtttttcagctgggtg

SEQ ID NO: 144413 - DNA, 261 bp, Homo sapiens
ctggctctcccttttccagctctatggactgcacaaaagtataatactatctaacttctcggcatttctgttttttcaccaataaaaaaaatgaaggtaacaataccccctcagaagataacatgcgagcaagatggaagcacagacctggcacaggcccattctttactctgagtcaagtctagtctccttagggacagggcatcaataagggacccctcagcaccttgcacgattcatttagttctcaggaattcattt

SEQ ID NO: 144414 - DNA, 839 bp, Homo sapiens
ttcaagaccaacttgaaccagagtcttgaatctgcaactttactagctgtggcttctttttaattgattaactttctttttctgtaaaatgggaataatgattcctacctcttacaagcgttgtggtaggaggtattccaaatgagataaatatgtgaaatcactaaaacttccagaatacatggaaataatatatgtctgtattggcaaattatgagtgtagtaatgagggatttacatggacacatttacattctttagttcagactccctttgacgacacataacaaacacacacaagaatatttgccctgtgtccagcactcttttgagaatttctctcttctcctccttctgatatcccaaccaaccaaccagtaggaatgtgccctagaaactatgttttacagctcagtccacatcttttcaccttacaaattacttattgttagtttcttgggaaagtaaaattgagatattaagattctatgaaattggttggtggtattgaagactgtgctgctgctgctgctactgctccagaactctagtggagatattacaaatgggagcagaaaaagtgagaaggtggtctgtagagacagagcacagcacagaggtagaaaggttgagataaagaaacaatgcagtgagagaaggagagaacacagacatagaaacagagacataaaggcaccagacacgagagcagagataatttaataaggccgtagtttctcttggatttccagttccttcttttagtcagttctgatatttagcacactgcactgcaccagatatcttgtcgccttcaaataaagtatttttccccctta

SEQ ID NO: 144415 - DNA, 1170 bp, Homo sapiens
agaagaagcttttgagttgaataacgagttccacgttccaggccaagtcatgctttcagtctcctgtttaaaagtctatcaagttttggggcataagggtgggaggaaaataaaaccaaggcccctttgtcagcatacagcttcagtagataccccaaattcttgaaatctgtatagcagactgctggttttttctccttgtcagagcccagcccactgacactttacagttgacagcccagcccagatatgggccgctgtggcttctatcgaatcatgcttgggattgccacagttttcttctttggattggggcttgaggtggttgggaagaatgcatgccaaccagccctgcatctgggacttggagcctgtcagctccctgctctttgataatggaatagtctgtggacttcttcccatttgtgagagaaaactcccccttagaactcaactggtagagcttctcatagcttacagttccaagcaatagcttggttgtaggtccaggcaggactctgacatggccctctggaatagcattgatgtgttgggttctttgctaagatgatttccagtctgtgttccagggagattcaggaaagctgaagttcattcttagaacctaggtctgtgtttgttgttttgttttgtttaaaaaaaaaaaaaaaaaccttgcctgatcttaagtgccagctgggaacttgttcagcatccacatgccagggcctcttgtcaccctcatttagttagaatttccaggggagggaccaggaaatctgtatgctccaacaggtgctccaaacaggcaggcttgggaaatgctacactaggtagccacccattttccttgttcagaaaaaccttaatctcttcctgtccatgtgtggtatatggctgccatgtagccagcaaccacatcaggctgtagaagacacttgctattcctttgttttacctcggttgcatccagtgctccgggcctttgcttcccagtacagctgaccaaccacacggcttccaaggacttgcccccttgtttccatgataacagccaatcgcataaatccatgtggggtgcaaaacatggttatgggtttcagtgatatatctctcaagaatgcttatcttttaacccaggaatgcaaataaaaatttgtatgaatttta

SEQ ID NO: 144416 - DNA, 838 bp, Homo sapiens
agaagaagcttttgagttgaataacgagttccacgttccaggccaagtcatgctttcagtctcctgtttaaaagtctatcaagttttggggcataagggtgggaggaaaataaaaccaaggcccctttgtcagcatacagcttcagtagataccccaaattcttgaaatctgtatagcagactgctggttttttctccttgtcagagcccagcccactgacactttacagttgacagcccagcccagatatgggccgctgtggcttctatcgaatcatgcttgggattgccacagttttcttctttggattggggcttgaggtggttgggaagaatgcatgccaaccagccctgcatctgggacttggagcctgtcagctccctgctctttgataatggaatagtctgtggacttcttcccatttgtgagagaaaactcccccttagaactcaactggtagagcttctcatagcttacagttccaagcaatagcttggttgtaggtccaggcaggactctgacatggccctctggaatagcattgatgtgttgggttctttgctaagatgatttccagtctgtgttccagggagattcaggaaagctgaagttcattcttagaacctaggtctgtgtttgttgttttgttttgtttaaaaaaaaaaaaaaaaaccttgcctgatcttaagtgccagctggaattttttaaagattccatttccgaggcctttttgcccccttttttaattaaaattttccggggggggtacatgaaatttttattctgcaaccgggggctcaaaaaaggcggcttgggaaactctaacactgggaacc

SEQ ID NO: 144417 - DNA, 444 bp, Homo sapiens
gaactccttacccttactgtggtgctttagtattttgttgacagaaagcatttaaagcaaatatcacaaaactatatataaaaaaaaaatcacaaaactatacatcaaaaaatttaaaaaggcttttatattttgttctctggacttttctgtattttttcttttttctttttttttgagacagagttttgctcttgttgcccaggcgggagtgcaatgatgtgctctcggctcactgcaacctccgcctcccgggttcaagtgattctcctgccacagcctcccaaatagctgggattacaggcatgcgccaccacgcccagctaatattgtatttttagtagagatggggtttagctgtgttggtcaggctggtctcaaactcctgacctcaggtgatccacctgccttggcctcccaaagtgctgggattacaggtgtgag

SEQ ID NO: 144418 - DNA, 387 bp, Homo sapiens
gcgctacctacagaagggtccatacagctttgttgtgaattcccgtcgtaacttaaagggaaactttcacaatgtctggagcccttgatgtcctgcaaatgaaggaggatgtccttaaattccttgcagcaggaacccacttacgtggcgccaatcttgacttccaaatggaacagtacatctataaaaggaaaagtgatgtgatctacatcataaatctgaagaggacctgggagaagcttctgctggcagctcgtgccattgttgccattgaaaaccctgctgatgtcagtgttatatcctccaggaatactggctagagggccaagctgacgtttgctgctgccactggagccactccaattgctggccgcttcactcctgaaa

SEQ ID NO: 144419 - DNA, 2604 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (11)..(11): n is a, c, g, or t
tnanncntganccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144420 - DNA, 2593 bp, Homo sapiens
cgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144421 - DNA, 2543 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (11)..(11): n is a, c, g, or t
tnanncntganccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144422 - DNA, 2482 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (11)..(11): n is a, c, g, or t
tnanncntganccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144423 - DNA, 814 bp, Homo sapiens
ccctggaaccagcccctgacagggacctaggaggcttccctggaccccagtgtcagagctacagaggccggaggaccagctgatccacactccagcccagaaaggaaaaccaagggctcaaggagccacccagagatgcagtgacagagcagagcctatggccgtggctgccaggccttgccccgccccactagggtgcagcctccagacgcagccccctcactcccacagctcaacttcatcctcttcatcaatatcgtccgggtgctcgccaccaagctgcgggagaccaacgccggccggtgtgacacacggcagcagtaccggtgagcccaccatgcctgccatgccctggctcctcaggggtccctgagtcctggtaccatgtaccccaggaaagacagtggccccatgaatgatcctggggcaagggaaaggacccagcgtctgactccctggctgtcctcacccacctggcctgcccagcagtgatgggaggccctagggcaccccaaagccagcctgcccacttgtaccaggccctgcactagagctggagtctgtgagtgtgcaacgaacttgaacctctcctcaaagagttggttgcagggggtctgaggaacaggtaggcggtgagtggccccgggaaggctgcagctcagctgaaacctgaggagcggactgtgggatagtgaggttcgaccgtggaggggagtgcttgccagctgagggctccacaggtgcgaagggcccagggacagggggactgtcatttgaagtccgctccgggacaccgctgagaaccaacgggccc

SEQ ID NO: 144424 - DNA, 2484 bp, Homo sapiens
gggcggtacggtccggagtttttgggatggagcggcagacgccgagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144425 - DNA, 2349 bp, Homo sapiens
cacagccatgctcggactgcagggccccggccccgccttggcgcgtctgaaggatgcagctctgccgcggagctgaggagacgtagccttctggggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144426 - DNA, 2355 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (11)..(11): n is a, c, g, or t
tnanncntganccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagcgctgggggctggacctgctgacatagtggatggacagatggaccaaaagatgggtggttgaatgatttcccactcagggctggggccaagaggaaaaacagggaaaaaaagaaaaaaaaacaacaagaaacacaggaaaacaaaaaaaaaaaataaaaaaaaaacaataaaaacaaaaaaaacaacaaaacaaaaacaaaacacaacaaaacaaaaacaaaaaaacaaaacaataaaacagaaacaaaagagaaccgggggcggcggcgctctacattatctatctctcctcctccgagcgggggccagaacacctagttaccgccgcgcactccgcgtttttcttttggttaatgaaaagggcgcccgcctccccaaattagagagaacggttcgttcattatttaatgcacgagcgagagaggcggggcgtggccgagcttttaataaccaaccgtagaggactagcgcgttgtgagaacccaaaacatccaggctcgcgcggctgcggcctcattttctgcagaggacaagaagcagcccccttcagttgagggcgtgggcgtcgaacatactatgatgggagacacaccaaccagagg

SEQ ID NO: 144427 - DNA, 493 bp, Homo sapiens
taatgatcaatatcaatcctagacatgtacagctctggggagttaaagtagctacgacattcgggcagatgactgcaaagaagctatctaggcttcctgaaatggaaccacctgggcaagggaaggaagcaaaatgtggaagcccaatgagcagggaataggaaatttacacagtagctcaaatcctgcacaatcccaatcctgcaggacaacgatcacagcatcttagcactggaagggttcccattcatcatccaacgcagccccctccccagtgcagaaccctcatgacagtcaccctagagtcatccacactgccctacatacttccaatgacaaaatgctctctgcctttcggggtagcctattccatcaatggataactatttttagcaagtttttaatttagtcaaaaagtgatacctttctaatgtgtggctgtcatgctaattctaattctgaaccaagtagccactcaataaacgttgaatga

SEQ ID NO: 144428 - DNA, 750 bp, Homo sapiens
tcaaaatagaaaatggtaatggaagatttacaagtaaataatgtttggatttgtggataatggagcttattaaaaaattagaaaaatgcccttctctgaagcataattttaggctagttggagaaatgactgattgtagtcttgaggcaggaagagtccagggtgagtctagggtgtcttgtcataccagaaagcaggaaaggtatcaaattaagctagagtcatgtcagaagaacacaggagccaacctgaaggaatgtccattgcccagaaaatgggaaaatttgagcataagaaagaataatgactgcaatagattaaaacatattaaatatgtttaaatctctgagtttatgcttctttgtaaaaagttactctgaaaaaagaaacacctaattctgaaaactgtaaagaaaatacaaactatattttagagtaatcagatttctgatgagttaattaagaaaacgtgatagaattagaagtcaccattttgtacatttaatgaaataaggcatctgggcaatgatcatcaatgctacgaaaactgttaagtaaaaggcttgtgggaccactaaaatgggtggaccaggctgataacctgaccagttttaacatcacaaaaagtcagaacttatgtgcctttttactaaatgcaataggaactacttagtactactgatgaaagattcttgtcaaaaaagtcaacataaatctgatgaaacctctagatatagccaccaatttaca

SEQ ID NO: 144429 - DNA, 154 bp, Homo sapiens
acaaacatgtagaaaacatagagaagacaaatattttggacaaatacaagccaagagcaagtccggtttggagcactaagaattgagggaacattcccataactgatagagtcagattagaaaaaattcaacaagaaattgtgaagcacaggag

SEQ ID NO: 144430 - DNA, 576 bp, Homo sapiens
tgtagacataagcatcgggattggacagtcctctggatgaatgcggtgaatgaagattctaggcctctcagcttccttaccttcagtattggaataataatgatagtgaatacaggagggaaagagacaaagaagaaaactgagcccctgtttatgccatgttcatagaatttgattctgggggcacggaatccagatggctagaggccctcatggacacatcagagagtgagctttgggttatccagtatttatgcattttgataatatatgcagaaatgagcagcactgtgcatagattctgtatcaatagccaaaagattgaaggttcaggggcaatctagggaagacctacttctcttggtaagaggtgattcaacacttgtcaacaaaggagaaaaccctcagtgtccaatgacagagaagcaagctgggcttggcccatggatcttagaagctcagcttagaaggaaagcctctgcttctcagaggtttgaggcttgttcaaagatgtcacataaatacacaataagtgccctgctcgttgtgtatttatgtaacatctttaaacaagtc

SEQ ID NO: 144431 - DNA, 424 bp, Homo sapiens
attattttcctagattgtaccatatattgaatattatgagagtccttgtgtacttagtatgaggatactagtttgcaattgttttttcattctaatttaaaagtgcctgatttgatagcctctgacgttttcataagcagatcaaatagtttgtttcagcattttttgaaattgcattttctctttcatgcaactatccttagcctgtggctaccattttctggctttgagaacttgatatggtattaacctaaggtcggatacggctcttgagctcacctgcatcagaagcacctgggtctaatttaacatgctgatccctgaaccccattccaaacttacaaactaagaatctcagcaatctgtgttttaagtcggctgcctatgtgatttgtataacctctagagattcataaccactaac

SEQ ID NO: 144432 - DNA, 547 bp, Homo sapiens
tggggtccgagaggcccttggaatccaccatggcatgggccggagtccctggcgacgcagaagatgtgctcactgattcgtggggtggaggacactgcacacccagccatctggctaggaagggggcgtctggggcagagggagtcacaagtacggttttcttaccggatatattgtgtagtggcaaagtctggccttttagtgtactcattgccctaatagtgaacattgtacccaaaaggtaactttttcacctttttcgccctcccgtgttttggaatcttcagtgtctgtttttccattctgtatgtgcatgtgtacccattgtttagctcccacttgtaagtgagaacatcggtatttgactgtttctgagttgttttgcttaggataacggcctccagttctgtccaggttgctgcacaagatatgctttcattcttttttataactcagtagtatttcttggtgtatatatacactgcattttctttatccagtcatccattgttggacacttaggttgaggccgtatctttgctattgt

SEQ ID NO: 144433 - DNA, 159 bp, Homo sapiens
cctaattacttctgtgttttatatattgaaaatgataatttgatatggatgcaacattttttcagattacaagtatttgccccattgaaccaaatatctgtgtatgatatgctctggaaatgataaagtactccaattataaggatcccgaagattgga

SEQ ID NO: 144434 - DNA, 572 bp, Homo sapiens
caggccaccaggctgagtgaaggtgctatacagaggcttcttggccacctggggcccctttgagcctatgagggatcctgggagggtagtggagtgaggacagcagaggagcaccaaagacaaactcagcccatttcacaattttatcgtgagccagccctatcttagccctctcgttttgaagaaaagccaaatttgtatttaaaaaaatacttatgcctgatgcattccctattgtgaaataagcacatttattacacagaaggaaacctgatgtctctcagaccttgagcagactatttacaacatttgggctacaaggcaaggtgaccttcagaccacgaagtggcgatggcttgcatagggcaaggcagggtctctgagagaacgtgagacacacaggccaccaccatgttttaggggacctgggattttgcaacaggaagaaataacaggttagaaaaatgcatgctttaaaacatttaaaatttaaaaatagaatgctttcacacacacacactgcaacacaatataattgtgccatttactagtaatgatataaacatatctga

SEQ ID NO: 144435 - DNA, 355 bp, Homo sapiens
acctcggctcccagtcttttagtacctctctcaaatatgaatgaacaaataaaggaatggaaaaaagactacaggtcaggcacggtggctcatgtctgtaatcccgcactttgggaggccgaggtgggtggatcacctgaggttgggagttccagaccagactgaccaacatggagaaatcccatctctactaaaaatacacaaattagctgggtgtggcagcacatgcctgtaatcccagctacttgggaggctgaggcaggagaactgcttgaaccttggaggcagaggttgtggtgagccaagatcacatcattgtactccagcctaggcaacaagagcgaaactgggtctc

SEQ ID NO: 144436 - DNA, 98 bp, Homo sapiens
aaatgtgatcatagatttatacctcagtttgaagtaatggtctagatgtgcacatggcagcctaaggatcttagagacatagtgctgagtaacaacag

SEQ ID NO: 144437 - DNA, 261 bp, Homo sapiens
ggcccctgtgttgctcagggtctctccctccactcactgtctattgcttttacaggatttgccaccaccctccaccctcatccaaacagaggcctccagaccagaagccaggtcttacactgatagttcaggcttcctgtagtactagggataacataaacccagccatgccacagtcaggtcctggttgcactgctctctctattccttggcaccccagaaacacaactttaaatgagccacagacctgagcaatccagg

SEQ ID NO: 144438 - DNA, 331 bp, Homo sapiens
ggtaggggcaggatccaaacccagcccttgcctgatggcagagcttcactgctccaaacggtctggaacaccactgttttaattaagtgtgcaattcagtgtgcaagtgtcttgtaattaagtgtgcctctgtttcctcatctataaaacagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggtgccatgctggggcctggggcacttctagccacagcca

SEQ ID NO: 144439 - DNA, 226 bp, Homo sapiens
catgcacacatgaagtatatacgcaaagcaatatcacaggtacaaattcccttgaaaattcacaaataaggccaagcgcggtggctcacacctgtaatcccagcactctgggaggccgaggctggcaggagttcaagatcagcctgaccaatatggtgaacccctgtctctactaaaaatacaaaaattagccaggcgtggtggcgggtgcctgtagtcccagcta

SEQ ID NO: 144440 - DNA, 382 bp, Homo sapiens
tcctttaccctcccactctgctgtctctgagcctcctcctcccaagtagcttccctgcaccactcaagacaggctcaatcaatccaggaatatctgcagagctccccactctggccctcccataattctggtcataattctcttccttttcactagcagggccctcagaggtccatagcttttggtgaaaactgaccatccaatcacaaccacataagctataaccacaccgtaactttcaggaattttaaccaatttcttcacacacatgcacaaaaggctacattgttttgcctgttctgatctggcctaagcagagatgggttaaggcttaaagcacctatttccccataggtgagctacatggtaacctgcaggtgaa

SEQ ID NO: 144441 - DNA, 124 bp, Homo sapiens
agagccttcccagtagacctgactagaataatgcctctgtctttccaggtagacaagctaagtaaattaagcacttcagtgaccaagaaaatattgaattcctcctgaatctgcatgaattttg

SEQ ID NO: 144442 - DNA, 366 bp, Homo sapiens
acactggggcagggctctgaaatatagtttcataggataacaagaagcaggatttgtcgcagaatggcgacagtgagaactcagaagggtctggaagctctagtttcagaacacatcagcctggatgagagaagatgaaatccagaattcagaggctaggttgcagcaatgtcataataggctatgttgtgggagtggtgactagcagatttatagagaatgcaaaaaggggagagttcagtcaaggttacaagcaatggaggccattggaagagggaaatggaacactgtggtatgtgaagatgttccatttgaggataagaaatgcctctgaatctgggatggcattttgtgaaagcagagaga

SEQ ID NO: 144443 - DNA, 829 bp, Homo sapiens
attaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaa

SEQ ID NO: 144444 - DNA, 317 bp, Homo sapiens
tgcccactttcatggacagtgttcagaatatatatatgatgttctatcttacaagagtgaatttcataaaaagttcattcagagatgtgaaatcctcggtgctgcgagtgatctttaacaacagtcataagcaatgttttgttaaaaatagaagctgaagagcattattgaatattaacatgacctgggctttattctgtggcataaatgacgtggaaatcaaacatatgctactcattctcacttgaaaaaagcttcatttatagggcacagataagaatctatgaggagattaaaaacactgaatgatccctttt

SEQ ID NO: 144445 - DNA, 468 bp, Homo sapiens
agttgcacccctctccctactgtgagaaccccaaatgtctttggacattgtcaaatgtcctctgcagggcaacataaccctggaatgagaaccactagacaaggctgaggagactggactggaaaccagtaacaggcaaacccaagaaggtaatgaaaaggccaatgtgatcatccaagccaaacgatgactgaacctgaaaggtgatttttccaatcctccctcataccgcgaccctctaatctagccctccatgatcatctagagagtattccacgtccatcctgagcgtaacccactccacttccaaagcccgtatcacccaggggtatcagcatctacccctcctcatcacagaccctgacaaacctccttggtatagccttcacatgtcaaggactttaccacatggtcctctctctgcttctcaaggttgactcttctacattctatgggacattaagtccc

SEQ ID NO: 144446 - DNA, 367 bp, Homo sapiens
gtgggttcagcttctatcttgctcaactaaatttttaaaatctatataggtgagcatctgttcagattactatctagctttaataattgctatcattcatatttgcctggtacatcactgtccatccttttattttcacctctttaattaaaaatcatgtagctatcacttaaactactgaaaaattcattgagagtttaactggtgagtgtaaaccatttatattaattttaaataatacttgtttctggcatttcatttcatgtttttcatttatttcactctttcatttttttccttcttgattttcactttataaggtctcttatgctaccttaaaagataaaaattgttattactgtggttg

SEQ ID NO: 144447 - DNA, 423 bp, Homo sapiens
catttggtcccagagaatcagaaaactgaattattttgctttcccttcacatatggagctctctattaatattccttttctcctttgctttctatttccaaagacccctttcacctttttaagcaagagtagattatttggggagacttttaccgatatacgggccactttcaattttctagataataagcacttgactgggccatgactctgcctttactttctcagattgtttcttcagagcaattttttagtaactcatgctatgtagcttttcattttgagttacaaaagctccagtcttgtcatccaactgctaaaaatcctgggcccagtcatctcggtcttctccctctttacaaaggctagccccttcctgaatactctgtatcccataccctcctaatttctctcgaggattgc

SEQ ID NO: 144448 - DNA, 575 bp, Homo sapiens
tgctctgtgatgcaagtgtctaacagtctgcaggaatacttttatctatagtgcaacatgtaaccctcacaaccaccctgtggagtagatttcatctgcttattccaaaatagaaaactatgacccagaaaactgaagtgacttgcccaagaacacccattcaagaagtggtaatgtggaggttcaaacccaagtaagagtattcccaaagctcgtattcttttcaggaaactccactcgcttgtagctccaaactaggtgcattaacagatggcacctcaaaagcactgagggagtgatgtcatgcagttgaaagacaggctcttagaccactcatgaggtcacaggagctaggcttgtggaagacatagagatttcacctatccctgaaacacacggtgaactaggatgatgcaaataccagtctcactctatcccccttggttaggaaggttatgcctcctgcttgtgccacgggaagcagaatattccagtatttcagagataaaagagagctaatcctctttttgttcagatgaggacacttgcatccagagaaggaaaccgatgtttcc

SEQ ID NO: 144449 - DNA, 117 bp, Homo sapiens
cccaacacttagaagagaactatcttaatatagtaagtaatatccttgtatcaagcattaaccacatgagaaaattaagcccattcctgttacaaccatttaaatttgatactatat

SEQ ID NO: 144450 - DNA, 415 bp, Homo sapiens
catatctgcagctgagctgtcacctgctcccctctcccagctatgttcagtttggggcaactagagccattgacacattaagggagaggcctgggaagtcttccctgtttggggactaatgccttaagcatttgcaatagggctgggcctgcttagcttggccctctatggggagtccctgtgtgttttagatgctacagatttcacccctctgtagccatccatttcacccctcctttccccaaggtagtggaccaagctgagtctctccaaactcagtcttctaaagctaaggtggccagtgctattcttatccctgagcccaggtgtgcaagcaacacttcagctctttcatttctggataggaccttaattttaattctaagcccccatccccctgggctggtagaagatt

SEQ ID NO: 144451 - DNA, 359 bp, Homo sapiens
tcctggcgcttactaagatgaggcaattaggaaagaaaagtggtttgtgaagggtggagaggaaggagattttctatttcagatgctgaaactgagatgataaaaatctataatagaaatgtgcaatacacatgttggaaacacagattacaaatgagtggctggacacagcctctttcacagtgatagtaattcctgtgtgtaatgtaataggaggaaactataagaagtgagaactgaaaccacaaggtaatagctgaaagacttaagacccttagatgagaattccaagataaacagcacaaaataacaacaataaacagtcaaaggctgaaccctgcacccattgttggggatat

SEQ ID NO: 144452 - DNA, 393 bp, Homo sapiens
tatctgcttgaaatttcaaactgtattaacaaatactaacactttgggaatgagtaaaagtgaggaacatatataatcttacattaaatgatcaaaacacaaaattccatttttgttatcttttagaattgaaaataagttacatactttccaaatcctaaaaggaaagtaaatgaataagtctgtatataaaaatggaagctgaaggaaacagaaaagagcataaaaaaccaaaagcaagatggcaacattgtttgacttccctgactacagtagaaatcccaaagccaaagagtttctgtctgatcggctggaatttaccagcttcgggaagcatgcctgacacataatagaggctcaatagttatttgttgcctgaataaaagccaaaca

SEQ ID NO: 144453 - DNA, 467 bp, Homo sapiens
tatctgcttgaaatttcaaactgtattaacaaatactaacactttgggaatgagtaaaagtgaggaacatatataatcttacattaaatgatcaaaacacaaaattccatttttgttatcttttagaattgaaaataagttacatactttccaaatcctaaaaggaaagtaaatgaataagtctgtatataaaaatggaagctgaaggaaacagaaaagagcataaaaaaccaaaagcaagatggcaacattgtttgacttccctgactacagtagaaatcccaaagccaaagagtttctgtctgatcggctggaatttaccagcttcgggaagcatgcctgacacataatagaggctcatcacttgagctcaggagttagaggttacagtgagctatgatcgtgccactgtgctccagcctaggtgacaaagtaactcattacgtagtgtgttgaaagtagtttac

SEQ ID NO: 144454 - DNA, 794 bp, Homo sapiens
ggacatttcagttgggaacagattgctccatggtaatacgatcactatgtacccaacaatggctctttcttcctagcctcaatgcagatgttattttcaccttaactattatcattgctgtttctaaccacataaaagtgtatcctttatatatctgaagtaaattcatactagtggtgtaacatctccagccatttaagtgtaaaaacagaaaacatatgatgtgtttacttactgttttatactcctaatgcatgaagagaagatccttttattcattgcctatacttttatttctaaactttctgtaacactttatcttatatccagcatagaattgagatttgctttttgatttaatctgacaatattttttcctctaataagagtcaagcccacttacttttaatgataaattgtgtttggttatattttgattacagtatattatgctatgatttatatgcacatatctgtcttttgctgtcttgttttattgcttttgttttgatgttgtgatatttggaagagttaaacttttattctgatggctaccttatgtaatttcataaaatcatctctttctttagacagtagctaatgtctctaaactaagaacaatggtattagctgtattctctttcttgtcctccctatgtgatttttcatcccacaatttgatttaatcatattaactttgtttcccctggtgccattaagtatgcttacatttctataaacaatatcctttgactcccaggcattacagatgagcagtcagtaaaatcattctg

SEQ ID NO: 144455 - DNA, 589 bp, Homo sapiens
tgtcagaaaacaagccttaacaaatttttaaaaattggaattataccatgtatcttttctgaccacaatggcatgaaactagaaataatagcaggaagaaaactggaaacattatacatacagggaaattaaacagcacacttttgaacaaccagtgggtcaaagaagaaaccaaaagggaaattggaaaatatcttgtgacaaacagaaacaaaaatacaacataccaaaacatatgggatgcaataaaagcagtactaagagtaaggttttagggtgaacacctatgtttaaaaagatttcaaataaacaacctgactctacacttcatggaactagaaaaagaaggataaactaagcccaaagttagtaaaagaaatgaaataaggatttcagcagaaaaaaagcaaaatagagtatagaaaaacaataggaaaatagtcaacacaaccgagttggttttttgaaaagataaacaaaatggacaaatcattagctaaattaaggagaaaaagaaaacacaagtatatacaaaatgagagagaagacattacaaccgatgccacagaactggaaggattataagaac

SEQ ID NO: 144456 - DNA, 335 bp, Homo sapiens
ttatgtcatggattctgtgggtcaagaattcggaaagggtatagtggggatgacttgtctctgcttcagaatcactgagacttcagctgagaagacttggaagcctgagatgacttaaaagcttggggctggaatcatttggagttgctcattcacatatgtaaaaggtaaactaaggcacaaaaaaaaaattttaagagctcatttgaccagccgggtgctgtggctcatgcctgtaatcccagcactttgggaggccgagtcgggtggatcacgaggtcaggatttgagaccagtctggccaacataatgaaaccccgtctctactaaaaata

SEQ ID NO: 144457 - DNA, 544 bp, Homo sapiens
tcagaacagaaactaggaacagaggagggacaagggagggagggcagaaggtccggtgccctcagtttctatccatccttgggtcggaaacctgggatggaatgagtgaggagctgggtccacagggacaggaactgggggataccaggggctagggctgctcatcctttcccaaggaggagccagggaaaaattaagctcatagggaatgtcgggttcaccgggcctggcggactccagatcccagaggcagggcacccacacatctctcaccggcacgcaccagggccccgatagccgggcaccatcatggcgaattacattacattgcattacccggggaccactatcatgaccacgttgggagaggaaactgaggcactaagctgccaaagtcacgcagcccacaacactggaaggcaaagcagccgtctggaccccagaactggagctgtcccctcactgggcgaaacccagaacccagtgtttgcttctttctcagagtagcaagaagacatggcagagctgccctcaggctggaggc

SEQ ID NO: 144458 - DNA, 192 bp, Homo sapiens
ggaagtctagtggtgctatttattgacctagaaaaaaaaatggacaaagcacaaactctgggagagtgagggaaggaaaatcgtgcattcattttggaccatgttaagttggagatgcctttaagatacccaagatgagatgtaaagtaggcagttcattaaactaatttggaactcaaaagagtattatgg

SEQ ID NO: 144459 - DNA, 329 bp, Homo sapiens
cgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccat

SEQ ID NO: 144460 - DNA, 247 bp, Homo sapiens
acacagttccacaaagtgcacaccaagcagatggtacagacaagaacatgggttatttacagccagtagagtagacgaaggcatatgcgctaagccctcttaaacccactccctgggagccattaacacatccatttagatgaaagagtcccgaggttttgccatgggcatttctgctacactcccctgaagcatcgccatctgccctgcctcctcccagaggccttgtcacccccactcctgccca

SEQ ID NO: 144461 - DNA, 226 bp, Homo sapiens
tgttcacctcttattctcttactaggttgttttcaaattaaaaacaaacaaacaaacaaacaaaaccctgtatttctccaatcttaaaaaaggaaaaaaaaaaatcacaccacttctgcctccagctatcaccccattctctgctccactctgtagcaaagccaccaaaagaatcatctgctcactgcttccaacttctcttctcccagtctctttgggtcttact

SEQ ID NO: 144462 - DNA, 432 bp, Homo sapiens
tctaaatgtgaaacttaagagccctgttataatacaggagagtgcctcaaatgaggtgattcactttaatcttcctaatactaatggcaaaattttcgttaattcttaatggtgaaattaaggagggataagcctgtattaaaaatgttccggccaggcgcagtggctcacgcctgcaatcccagcactttgggagaccgaggcgggcagatcatgaggtcaagagattgagaccctcctggccaacatggtgaaaccctgtctctactaaacctgcaaaaattagctggatgtggtggtgtacgcctgtagtcccagctactcgggaggctgaagcaggagaatcgcttgaacccaggaggcagaggttgcagtgagctcagattgcaccactgcactccagcctggcgacagagcaagactctgtctcaa

SEQ ID NO: 144463 - DNA, 397 bp, Homo sapiens
atctgggcacctggagtcatgggctttgaccagtgaggggtataaataggagactgaaaggtagaagagggtggtcaggggattcacagtcctggcttcttccctacttctggcagtggctgagctcttctgcaggtgtagttcctgtaggctggtccctctgccaagtctccagttcttcactgcactttgcaaccaccactgcctctcctccttttcaggatttgggatggtgaagcattcctgctgttgctagtccttggatacttcagcatccctgcatggttcttttcaccccacctgcacctttaatacagttctttcatttgaccttccatagtgaaatccttttgaaagtgttatgctgccttctgcctgaacactgataggcacatcc

SEQ ID NO: 144464 - DNA, 170 bp, Homo sapiens
gcctcctctgtgcctaacacagtgtgctgtccaccgtagggatcaatacaggttgctgtgggttgcctgaatgcctctccttctgattgcccaagaacactgcagtgtccatgcatatgggcacagacaaacacagcattgatggaagaaaaccatagatcagtgtttgc

SEQ ID NO: 144465 - DNA, 347 bp, Homo sapiens
tatcttacacttaatggtttaaatgttattagggttacaagaggcccagaaaaagacattcagagtagcaatcaatcactttaatacagcttcagcttataaaactggacagaattactttttttttcttatgctctggtgaagcaagtttttattctgtttaagcaaaacatcactctaacacattttcagagttacagctgctgataataaaatgctagagtggaagtcaaaatagatatctgggaatgcaaaacataggtttttctacagcaaggcaaatttcccattattcccacatgggaactcaggagcaaaattgccacatgcctcttgtatcatatgca

SEQ ID NO: 144466 - DNA, 334 bp, Homo sapiens
tgttgttgccagctcctctgttcaccctaaaagtgatacatgtcccctttctgcacattccattgacccaaactagtcacgtggccctgcctaacctgggaaatgggaggactgtcagatgagtatcactctctgccacagatgatgcagagcacaccttttggtaattagttcattgaatctgagtaaaagctcaggcatgagtagtgttgggcccatttactagagaaaatgaagacttgagctcttcaaagtcaagggctgtatctctagatctctcacaccgggctgtctgcctcacacttttctcagcactcagcaaaggttagttgag

SEQ ID NO: 144467 - DNA, 587 bp, Homo sapiens
ccaaaataggagtcacaaaagaactgacatccatttttatatgactcctgagctctataatctgcaaaacccatactgacttttacatgtatggcagggtatggaggaaatggccaaagatactttgtaaaatgttcgtcaaaataaaacctgaattttaagcaagagcagaaggggaggagtggaggaaggaaggaaaatccctcttttttaccataatcctagatgcactaaatccagcaatgtatatgaaatatttcaggagcaggaaagtggggagaaatgagggaaagaaagagggggagaaggaaaaatacagaaaggggaacagtgtaaagagaaagccccatgctaagtcatcccaacctgaagctgcctcatagccttggtcctgctctcctctccccctacttaccaaggcctttcaaaagggagttctgcaattccactctaaccatcaaacaccaaaaacacaacaaaacctgacaaaataattgtactaagtcagcacccaatctcctgcaaaatcagaaaagcaaactgacaaatattaagtggaccaccataaataccagacacagaatttg

SEQ ID NO: 144468 - DNA, 739 bp, Homo sapiens
atttgtcaatttctgtttttgttgcaattgtttttggagtcttcaacatgaaatctttgcgagaagctatgtacagaatgatatttcccaggttatcttcctgggtttttatagttttaggttttacatttaagtctttaatccatcttgagttgatttttgtatacagtgtaagaaaggggtccagtttcaatcttttgcatacgattagtcagttattccagcaccatttattcaatagggagtcctttccccattacttattcttttagttttgtgagtaaactcttcttttctttccctctgaagtcttgtcagattttctcctaagattcagtcttcagaatttaaacagagcatgtgtctaaggtgagttctttaggaattaatccagtcctggaaacaacgtgctctttcggtgtcaaaatttgagacttccggccaggtgcagtggctcgtgcctctaatcccagcactttgggaggtgggcagatcacttgaggtcaggagttcgagaccagcctgaccaacattgtgaaaccctatctctactaaaaatgtgaaaattagccaggtgcggtggcatattacaggtggtgcacctgtaaacccagctacttggaaatctgaggcagaagtgcttgaacctggaggcagaggttgcagtgaaccgagattgcaccactgcactccagcctgggtaacagagcaagaccctgtctcaaaaaaaaaaaaaaaa

SEQ ID NO: 144469 - DNA, 361 bp, Homo sapiens
gacttccgggtcaccctgatggacatggtggaggcaggcgggccgaaccagacggaatcccagaaggagtggagaagctgcttcttggtctgcacacagtctttacttctctgctcttcttggggattttagcaacattggtaaagaaaaaaatttaactgcacccatcctctaacaaactaaaccagcaaaaataaaataaaataaaataaagagaatgagttgaagaagctgcaacctttacctgttttcaccattaagtcgggtgtcacatagcaacggggatacattctgagaaatgtgtcgacaggcatttcattgtgcaagcatcatacagtgtactgtgatggttaatactgag

SEQ ID NO: 144470 - DNA, 881 bp, Homo sapiens
gaggcagggtctcgctctgtcacccagtggggagtgcagtggtgccatgaacgctcattgcagcctcaggctggtctccgactcctgggttcaaatgatcctcctgccccagcctcccaaaatgctggaattacaggatgtgcaccacacccggctaattttttgtatttttagtagagctagaacatccagtacaacattgaacagaaccaactagaacatccagtgcaacgttgaacagtattagccagaacatccagtacaatgttgaacagaaccaactagaacatccagttcaacgtggaacagaaccggctagaacatccagtacaacgtggaacagaaccgactagaacatccagtgcaacgtggatcagaaccggctagaacatccagtgcaacgtggatcagaaccggctagaacatccagtgcaacgtggaacagaaccggctagaacatccagtgcaactttgaacagaagtgttgaaagcagacacccttgcttgtttcctattataggggaaaaacactcagtctttcaccattctgtaggatgttagctagggttttttaaaaatgcccattatcaagttgaggaaattcccttttattcctagattgttgagagtttttgccatgaatagacgttggttttgctaaatgccttttgctgcatctattgaaatagtcacatagtttttgttttttattatactgattttcagtgttgaaccaatctttcattcttggtatatattccatttggtcattttacaaaatcctttttgtacgttgccagattcagcttactaacatttttcttaaacagctttattaagttataaagtgatatagaataaactgcatgtatttaaaaaaa

SEQ ID NO: 144471 - DNA, 104 bp, Homo sapiens
tgagtacatgtgtatacgtgtgtgtgagtgcgtgtatatgtggtgtaaacatgtgagtgcgagtgtgtgggaacacgagtgtgtatatacatgcgtgcaagtgt

SEQ ID NO: 144472 - DNA, 346 bp, Homo sapiens
aaagtactggccagtgggagtctgggaaccagcacagggaccagcccagctctaatcaccctccagagatcccatccggttcttccttccagggatactgggagggtggggcacagactcctgggctgctgcctgctcagaggcctctgcctcctcctttccctgctctggggtctgggtgttctgcactggaagagggctaagccactggtacacgtgggcacaagggaggaagctgctctggaaaggagaccaccagaggggaggcagaggagcaggccatgtcttcagggtccacgtcctgcctggctctccccatcggcgtcctagaggagggagcttgtgg

SEQ ID NO: 144473 - DNA, 240 bp, Homo sapiens
ctgtagtcccagctactcagggggcctgaggccagaaggttcgcttgagcccaggaggtccaggctgcattgagctgaaatcttcactctagcctgggagacactctgtctcaaaaaagaagaaaaaaatgatgctttagaagaatatttagaaccagccaaatttttataatagtgtaagtgaaaaaggagttaataaaacagcatattcagtgtgatctgaattttcttaaaaaatat

SEQ ID NO: 144474 - DNA, 820 bp, Homo sapiens
  misc_feature (628)..(628): n is a, c, g, or t
gtcttagtttttagtatgcctcactatttagatttatctggttcttttctcatgattgcattcaggtcaaacattttttggaagaatactgcatagacgataatttgtcatttttactcaatcacatcaggagtcacataaaatctattggtgatgttttattactttggttaagacatcagttattttagtctttgataattcattatctagataatggttactttgtattgtctgtttctttctagttgttgtcacttggttttgctttttttttccccccgacgtggtctcgctctgtcatctaggctggagtgcaatggtgtgatcaaggctcactgcggccttgacttcctggctcaaataaatggacctcccaccacagcctccaaagtagctggcattacaagcatgtaccaccacatctggctaatttctttttttctttcttttttgtgtagagacgaggtctcactttgttgcccaggttggtcttgagctcctagcttcaagtgatcctcccacctcagcctcccaaagtgctaggagaactgcttgaacccgggaggtagaggttgcagctgagccacgatcatgccactgcactccaggcctgggcaaaaagagncaagactcccatctccaaaaagaaaaaaaaacaattaaagggttggggtgggtgcacaggggctcatgcccggaatcccgcccttttgggaggcccaggtgggaggatccacttgagggccgggggttccaaatggctgggaggtaaaagttaaaaattgcccggttggactgtggggggcagctgtgggcc

SEQ ID NO: 144475 - DNA, 139 bp, Homo sapiens
tctcatgcatacaggtgtataggccacacagaggcagacacctacttttccccatccctacaggctcaatgctttgcaacatgtgcacacacacacacacacacaattgatgtgcatgtatgtcctctcttctatacac

SEQ ID NO: 144476 - DNA, 534 bp, Homo sapiens
ttattgtattgattaattgacaaaaatgtgatcagttgctcacaggaaactaccctgtatatcccctaggagcaggttatccaaacccatcacgaagtcctacagattctactgccagagcataactcaaatccattaacttctcttcgtgacctgtgctgtcatcctagctgattatctcttgcctctattgtttccctacttctaattcattctcaaagaggtcaaagtgactctcaacatgggttctatgttagtccctcacttaaaccatttaatgactttctttttcttttttttcttttgagacggagtcttgctctgtcacccaggctggagtgcagtggtgtgatctcagctcactacaacctctgcctcccaagttcaagcaattctcctgcctcagcctcccaagtagctagaatacaggcatgtgccaccacgcccagctaatttttgtatttttagtagagatggggttttaccatgttggccaggctggtcttgaactcctgacctcaagtgatccacctg

SEQ ID NO: 144477 - DNA, 560 bp, Homo sapiens
cttaacaggtaagaaaactgaggtcctgagcagttagattaggctgcatagttagttctgcaaggtctggaatccacgtcctggaatcctcccagtgccctttcagtgcatcagctgacctcgaaataatttaacagaagcagttaagaattaactttcctcaaaatgcttattaagcaaaagtaatctacattgaggtagatgagtaaagaataaggacaggttagggtagaagaaatgaggaaaaaaggaaacaccagaatggtccatattcatgcctaaaccctccctaatcctaatagggatttctccaccgatggtaacttgcaacttgaggggggccatgtggcataaagagttgtaaaccactatttccgcttaccctgtccattatatttagacaagaggaaagtgatgccagagaaaagatccaagaggacctgtctgtctctaaaccttggacaatcatttttctgaaatttgttgagttggagtagatctgagaaccgttccaggtaaaggtatgtactaacaagaaaatgaatgtcagattgtggcat

SEQ ID NO: 144478 - DNA, 378 bp, Homo sapiens
taagaagcagttagactccagatccctacttaactccacatggcaggtaagtgaccctcccccacccaagattggaagtttatcctttagataaaatagtgaaatgtaaaatgcaaaaaagagtaaaatggaaagtctgcagacacagggactccaggcataatttgaagatggaattatatactgcatatgagactccgaacacactttgccactcatctcccagaatgctagcagtctgtctcacccatacaagcagactgaagattcttttctggagactataactagtccaccaaaaaaaaaaaaaatccataaagatacagatattaccccacaaaatggcccacagtgtaccccaaagttgacacattccac

SEQ ID NO: 144479 - DNA, 550 bp, Homo sapiens
aaagaaatggggctgaagcaatcccaacattattagttttaaatgcttataggtgtaatataatctaacaagatctctttttcaaagcaaaaaatccatacaaatttagaaattatttcttataattgcaaatgctggatatgactatgcaaaagtccattaaagataactttaagaagctagagatcaaacatattcacctatagaacacatataaaaagtaactgtctccctattatacaaatggaatgtgtggtttgccatatagttaaccgtgacagaatcatggttttataaaaaaaaaaaaaatactgagtctcaaaaaatttaggcagaaatgatgtgtgctggacaactgggtgagatgactgaaaacaggggagttggtgatgacagacactgatgccaaatcacatgtgaagcactgaataaagtcaatgaactgtatgggtggaaaaaagtagtatttctaaattaatacttcatgtaatatgtgactttaaaaatgtatatgtggaaataaattaatacattaaaatgtgggtagata

SEQ ID NO: 144480 - DNA, 301 bp, Homo sapiens
tagtcaagtaagtcagaacattaatttctttgatctaattctgagaaagaggtgtcatgcatgagggtgctccagtactgcataatctcattaagtctggccaggtcataatttccatgaaacacccaggcttatcagtgccactggttgtgatgaacagagcagactgcaaatagcaaaatgccattatgggcctagtattacaggaacctaactgacttagaatctggaggagttctggcttaagagtcagcctctgggtaagatgcaagaggcagatgaccttgcgggcaggtagtgg

SEQ ID NO: 144481 - DNA, 387 bp, Homo sapiens
aacagcctaggagctcaagttaatgcattagtggtttccaaggtaggatttttttggtatgtaaaatattttagtgcattattgaactggtgttagaaataatgaaaaatatattttttaaaaaactaatcaggtatttgtgggacactctgacactgcattattttgattctgtgtgatctgcacattaagtaagtcatcttgtatcttttttttctgatgaccttaccattgttaccttataatggtgaagagcagaggagtgtccgctttttcatctgatctcgagcgtttcatcattataattttacagtaatatgcataatcttgtaacccccatggctctcctgtttctgattgggccacggtgtagctagagccatgttc

SEQ ID NO: 144482 - DNA, 365 bp, Homo sapiens
gctgctgctgttgattaaattactctacaaatgtcaaccagatcctgttgatgaatgatggtgttgaactgttgtcttttttttagatttgctgctgaaattttctctgttctattgtttagagaaaaatgtcaatatctccaacgataattgtgtatttgtcttattgtctgtttctcctctgtttgttccagtttttgtttcacatttttcatgtctgttgatttatgcctacacatttaggactgctgggtcttctgggtggattaagctttttatcattatgtaatttctctccatgtctcaatttttttctctgaaatctactttatccgatattattgtaactactcatgctttccttg

SEQ ID NO: 144483 - DNA, 485 bp, Homo sapiens
cggcatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggca

SEQ ID NO: 144484 - DNA, 588 bp, Homo sapiens
gagcaagactccgtctcaaaaaaaaaaagagacaatagaaacaaagaccctcaaaacacatagaaagacagcaacaaccatccctagagacagggaaattcagagaacagagtacaggcccaagtgcagacaggtccgggatttgggggaagaggaaatggaaaagtagagaggaccaccagagaagcaaattgcagtgtgaggagggagcttgttgtctagtggtgtgggcagttaagacagactgaagaaagaggcagggaaccagggagccatagaaggtgggggagggctggtgacaacagcactattgttctgatagggggttggggagcaggcccctggggcaggaaactggccctcttcccctgctcagaggcgggatgctggcccagccaggggagctggcagccctcttaggagaaacaggtgcaatgctttgtaaggacgcccaggtggtcccctccccctgcaaatacccgccaggcagggaccaacccctcttaggaaatccaacagtcccagtcccctctaaatccctctctccagaattctagattcctccaaggttgtgccacacaaagagag

SEQ ID NO: 144485 - DNA, 598 bp, Homo sapiens
tctagcaggagcttagcgaattctcctcctcctgcctgggcagtagagcaagaccctgcctcaaaacacatagaaagacagcaacaaccatccctagagacagggaaattcagagaacagagtacaggcccaagtgcagacaggtccgggatttgggggaagaggaaatggaaaagtagagaggaccaccagagaagcaaattgcagtgtgaggagggagcttgttgtctagtggtgtgggcagttaagacagactgaagaaagaggcagggaaccagggagccatagaaggtgggggagggctggtgacaacagcactattgttctgatagggggttggggagcaggcccctggggcaggaaactggccctcttcccctgctcagaggcgggatgctggcccagccaggggagctggcagccctcttaggagaaacaggtgcaatgctttgtaaggacgcccaggtggtcccctccccctgcaaatacccgccaggcagggaccaacccctcttaggaaatccaacagtcccagtcccctctaaatccctctctccagaattctagattcctccaaggttgtgccacacaaagagag

SEQ ID NO: 144486 - DNA, 436 bp, Homo sapiens
ggaaataaatcctgatgaaattatttgtattaatcatttttttattgtgatgaaatatacttaacataagttaccacttcaaccattaaaaatgtgcagttcagtggcattaagtacatacacattgttctgcaactattgccaccatccatctctaaatctttttcatcatcccatacagaagctctatgcttattaaacagtaactcccattctctcttccctgcagctcaaggtagccacttatactacttgctgtctctatgaatttgttccaggtatttcatatatctgggagatcatggatatcccccttttacccccatttaatcactgcttctctccttagagatgtccactgccagtagtgtggcgtcgccttccagcttcctttcatgcatttacatccttgtatccctccttatacacatttctt

SEQ ID NO: 144487 - DNA, 615 bp, Homo sapiens
ggcctagtcactggttttaagagttcaaaaccaagctgccaataacctactctcttagcagtcttatctctttacagataaacaataagcccattttgattcttaggtattaagtaagttgccatgatttttgacttgtttaccttgttagctacacatgtaatacttttatttgaactctgtaagaatgtttagattgctttggggaggagatgggagagatggagatagtatatatcacatttacaatgtgaatttttaaagtgatatgttaccaaactagaagtcctaaatttgtcagtgattaaacttgggatcttgagtgaaacccttaaattctgagcttcttttatgtcaaatattacacaaattattcttgtattgcctattttcctcactgtgttccttgtgttattgggagaatcaaataagattttatgtatatctatatacatacacacttaatatgtatagactgcataaatgtgatgattgctgttaaaatttactgattgctgtaatgtcataaagccaaagaattttgaatttcaaaaaactaagcaaatatttagtaagctatacctcactatctgaaatctgcttggttcctgggtg

SEQ ID NO: 144488 - DNA, 233 bp, Homo sapiens
ctggaggaaaagacactgggtagacacagacagtaggcaaggatgagcggttcccattttcagttctagttgacaccactgtgggcagcagcagcagtctctgcaaagcctgggccagccacaacaccatgcagaaagttctgtggatatttaaaagccagctgtcagttcaagcttgttccactgagctttcagtcctgatggctagactggcagtgttcccacttgtaaac

SEQ ID NO: 144489 - DNA, 564 bp, Homo sapiens
gaacctgagaggcagagattgcagtgagctgagatcatgccactgtattccagcctgggtgacagagtgagaccctgtctcaaaaaggaaaacaagaagattacagtctaatgatttctgtgaactcagattaaacatactaaataatataatagtggaatccagtcggatatgaaaaacattgctcattgccaaatgtattcatccactctcatgctgctaataaaaacatacccaagacagggtaatttataaaggagagagggcagccgggcgaggtggctcacgcctgtaatcccagcactttgggaggctgaggtgggtggatcatggggtcaggtgattgagaccatcctggctaacacagtgaaactccgtctctactaaaaatacaaaaaattagccgggcatggtggcgggcgcctttagttccagctactcgggaggctgaggcaggagaatggggtgaacccgggaggcagagtttgcagtgatccgagatcatgccgctgcactccagtctgggcaacagagtgagactctctcaaaataaataaataaata

SEQ ID NO: 144490 - DNA, 358 bp, Homo sapiens
aaaagagaaatcctctaggctccatttgcttgttactactttccagtgcctttgtcttggtgatgagagttggtggttttgttagttcaggtaaaagtgtagtttttaatcagaatagacttgatttgggttaatccatgaaatttagaaaacaaataggacaaattgagatgagagaaaacacaatttaagaattttttaatgaaagaagatattccttctttgtatttttgttacagtattttattgcttagggtattcatatagttctattgggcttcaaagaactagaaagctaaatattgagaaacggctaccgggattacaaatataagtctccatcctttcttcctgttaa

SEQ ID NO: 144491 - DNA, 204 bp, Homo sapiens
acatttgagttctctcaattcgtacaaccatttagataccaacaagctggccagttgcctgtgctttccaaaacagttgaaagatggtaactgcatagaactttaaggtttgaaagagacctaagggaaaccgcacagctacctggcaatgatcctctggcagacacatcagttaccatgggaagaatgtctcatggttgacag

SEQ ID NO: 144492 - DNA, 534 bp, Homo sapiens
ccatagcttagcctagcctaccttaaatgtgctcagaatgcttacattagcctacagtctggcaaaagcatataacacaaagcctattttataataaagtgttgaatagctcatgtaatttattgaatatggttctaaaagtgaacagcaggatggttgcatgggtattcaaagtatggtttctactgaatgcaagtggctttctcaccaacataaaatcaaaaaataaaaaaaaaaaatctccttgtagctatcaggagacttcagtgacttaaatgcaagattgaatcccagtgctctttgcgctctttctatccctgtgtcccctatgtataactataataagtgacaccaggaaaatgttatgagagtataaaacagggattaaaaataatttgggggtaaaaggagtgggtcataaatacttcccagggaagatgacatttatactaggccatgaatgatgtaagattttaacaggcattcatgggggtggggcaggcattccaggcttagggaacaataggagcaaaa

SEQ ID NO: 144493 - DNA, 554 bp, Homo sapiens
acgttctttgacaaaagaccatgttattgtagatgtcgtgtgttccaccttgctatgttttttaaaagatagttatttctgttttcatttatgcagaattcagtgatgaggatttaatgaagcagtgcatttcagaatatacaagaaatactttagtcaaataccgggttacaatcatctagttatgtttaatgtcagtattctgtaccttaaatacattatatattcatgccttattttaaacagatctttgtataatatacataataggttatatattatactaatctgaggaataaaggtaagaatatttttgttagatggtagaaatttataaagcaagtagcaatgctgatgtttctgtacgatcaatatgcagcacaatctttgaagtgtgaagagttgtctctcttcattcatccttggttttgctgcctgcagccattattgtaatcaaatggtaactttattctctgtgctttctacttgagtcagactgtattttcttatacccccccatgcattccttctattcactgttgccatggtatcat

SEQ ID NO: 144494 - DNA, 428 bp, Homo sapiens
tagaaacagcatgtgatttttccctaacttctacctgtcaaggtttttggttgcaaactacagaagtggactctggctcacctacccaggaaaggaatttattggacagataggcagtgcctctcagagtcaacaggaaacctggagaatcaagctcagaaaaataagcacagacagctgagaatacaaccaaggtgctgccagaggaagcctgttaggagacagactctggtactgctggctttggggacttatccccaccactgccaccaccctcgattctgctgctacctctgaggcatctgtagtaatcctgtctctctgcttagctccctcaaaacacaagactgggcatggctggcgttccaactggccaagcttagtgctcttgcttaagctgccagggagagggaacaagggaggatgtg

SEQ ID NO: 144495 - DNA, 846 bp, Homo sapiens
gtgctggcatattgctttattttgttctgctttattgagaaagagagagagagggcaagaactgaaaccagcagaaaatgatctgtttgatgaaaggtaacaaaattataaaagtagtcagattccacagaatcccgccaaatatgaagaaactacaatcagaatatgcttctaatagaaccattggcccaagaagggactgcagcaggatgagtcagtgccccaagtcccagacacatttcagcagctttgagaaatgaggacaggagcacctaagtagagcacctggattgggtcaccacagtggtgatgataccttgtcattattgagctggattaaggaggtgaagaccccaccagaaatggagagcacacagcagaatgggtggtcacagtgttctcaacagcaaatagtgggtgtctaaagtccatttctgggctttgcatgggtcaaaggtaatccaatctcaccctcatcttgccccacccttcaggagtttccagagaccaagaataacttctatgaggaggcttctgttctctccccagtacgaattttgtccataaacaaacttgttgtttgcgtcaactttacttttttaaaaaaattttaggccaggtgcggtggctcacacctgtaatctcagcactttgggaggccgaggcaggcggatcatgtggtcaggagatagagaccatcctggctaacacggtgaaaccccgtctctactaaaaaatacaaaaaaacttatccgggcgtggtggcgggtgcctgtagtcccagctactcaggaggctgaggcaggagaatggcgtgaacccgggaggcggagcttgcagtgagcc

SEQ ID NO: 144496 - DNA, 369 bp, Homo sapiens
taatacatcaatttcttggcattcttaaattctaagtaatttttcatcatgtttatgtttgtcttaacaacctcacttcaactggaatctacaaggtatgactaaagttcaaaaagatgggccaactagataggactaagttttctggatgcagagaagaaaattaccacccccatatatatgttgttcatgtctgttcttcaggaagtcaaatgtagtcaataaacgtgaccaagatatgtctgcccttcccccgacacacacacaactttagaaggatgctgagacatcacgttatctaaagagcattagataatctatataagcagttgtaaaactttaggaaatgcagtactactgaagtatttg

SEQ ID NO: 144497 - DNA, 783 bp, Homo sapiens
ttaagacatgcaatggggggattatgtgcatcttcccgacaccaacatgatgctcaggaaggagacttcttgttttctcttaggattcttttactaaccaagattttgcctctactgcatatttccctttgctgattgtccctcccttttgacagaagatggcccagggcattcactactaagtctcaacctcttacccaaagccctcagtctagtgttgctctttccttcatgctatttttgtttctttcttttcttgtaatcatcttggcaataaaataatcagttttttctttctacctattaaagatgttaccttagttaattacagtggtttccttcagaatgataagtggtctttcaaaatgatgtaaagagatctaaatccgtgtgctccagaagttgaatgaagctctgtctagcacgggtgccagtgactctcccagagtgctccatgcagctggacccacagagtccctctgtgctgtcataccacccactgccttctgtgaatgagatattctgattagaatcctggtggatgctatttgagccagtgcccccacaactcctatgaaagccgaggaccacaggcccctgaagacaatcacaggtctctagactcacagctcatgaccgtcctctgcagacacagcttctcctcggatggctgagggttgtcattggctgtgtccttccttgtgcatgacaacaggagacatagaaggtctgtaagcagccctgcaagccaggttctgagcaagccctcctgtgtggggccct

SEQ ID NO: 144498 - DNA, 376 bp, Homo sapiens
tgcaggtccgacctacttggtctcatcacttctggagcatctcaggttcaagagcagccgcctctgcctgtgacggcttagatgttattcctttcttcctttcatgggcacattctgaaagattcaagtgacatggtactgtcctgtcagccacagaactccagttcaatcaaatgggagtttcttaactgaaacggacatccctccatctcctcccagctgcagttaggcagaataaagttatttgataatggaattagttcacaatccacagtgaattgtgcctgacagattagctggtatttgtttgtttttttatttgcttcagtgagatctggggacacatgtattttgccttcctcagatttactgcctg

SEQ ID NO: 144499 - DNA, 256 bp, Homo sapiens
ctgggggcggtggtgcacgcctgtagtcccagctactagggaggatgaggcaggaggatagcctgagcccaggagttcgaggctgcagtgagctatgatcatgtcgttgcaccccagcctgagtgacagagtgagaccctgtctctaaattaattattttcacaaaggaaatcaaagggcttttgttaaagtaaatgatatcctcaagctatagagtttaacactaaaacttttctgagggccgggcgtggtggct

SEQ ID NO: 144500 - DNA, 254 bp, Homo sapiens
taacgtatcaaggaaggcatgtaaccataaaaatatttttaaatgccaaaatgttttcataaagatgtaagcgtgcatcacttgattatttttaaaggatgttggggttgccctggctaataaccgtagccagcaaagtcgcccatggttatgacttcagtctgttctgcagaagtgattctgatgtcatgaaactgcctggacttggctgagaggatgatggcgctcgtaggagggttgtttaagccatatgt

SEQ ID NO: 144501 - DNA, 189 bp, Homo sapiens
  misc_feature (11)..(11): n is a, c, g, or t
tctcaggcagngacgactctcccctagactcagtctcctccatagacggattctattaatctttcaatggcttcccactgactttaggaaaaatcctaaacctttctaatggcccacaaggccctgcatgatcagtccctacccacctctccagcctcaccctcacctgtgtctctctcaccctccctc

SEQ ID NO: 144502 - DNA, 767 bp, Homo sapiens
acgttgtcttgtagtggtcgcgggtctgacacacgcattcaagttgtctgcgtcccgcgaagtctcacgccgaggtccaagcagcaggcgtcccgctccgcggactccctccgaggcccatcgcctgtgctcagggcggcgcgggcagagtggaagcttctctgcagctccggagctccccgcgcagcggtgcccgcgcccccgcagggaggcccgcgtgccgaggagattttggactttcgctctgagttctttactccttcgggtttcttcccacggttgcgtgtctgcttttccagtctcccccctcaggacactgtgcgacctccgcctctcgctccccctcggagcctccatcacgcaccgttcgctcttcccccggacctgatttttggctttgctgggtccccactgagcggcagaggcctttccagccctgctaggaacagagcagagggaggggcagccggccgacctgaggcctcggggcgcggcctggagagcccgggttgtttttttttttttggagacggagtttccctcttgttgctcaggctggagtgcaacggcgcgatcccggagagcccaagttcataaagattaagttcctttgtcaacccctgggctcattgtgtatcagaaatcttcattcctgtgttattattttattaaggagaagacgttttcatgatgttgctgaatgaagaaaaccttggctaagcaaaaaccccatcactgtgcacattctcataaagtaccaagaacac

SEQ ID NO: 144503 - DNA, 325 bp, Homo sapiens
actcactagccacacagccttgggcgagctactgattccctggtgcctccgtttcttcttatgaaaagggcgtaacgggagttcttagttcagcctgtcactgttaggatgatctctgtaaatacatgcaatcacctaaaacagtgcctggcatgtaatgtgcgtgtgtgtgcgtgtgtgcatgtgttacgtttcatgcatatctatttcccaactggactataagtttctctgagttccagtataaaaatgtatttcaggccaggcttagtggctcacacctgtaaccgcagcactttgggaggtcaaggcaggaagattgctt

SEQ ID NO: 144504 - DNA, 763 bp, Homo sapiens
ggcactgaggtggcagttcagctggctgttgagtctctgctcccagactggtgagttgggaagcaaacttgtttcttctgttctttcttcattctcccaaataataccaagtaggggaagctcaccccaagcccccatctggctttccttttttttcaacttgaggtataattaacatacaataaaatatgcagatgttaggtgttcagttggtaagttttgataattgtataaaccatgtaaccagcatgaataaagaatacacagaacatttcatctccccagaaatatcccccatgcctctttgagtcccccaaccccacacatatatacaaaaccattttctatcactatggataagttttgtttttggatttcatataaatggaatcacacaggatatactctttcatagctagcttcttttagcttagcatgtttttggaatttatccatgttgcatatatcagtagtttttttctgttttgcttttctgagtggtagtcaattgtgtggatatataaggagaaaaggtagaggttggtgaagggctttcatctggcacgtagcctgactaccctttgctcaagagcatttggaccaccagaggcccccctccttaagattaagatgttcacttacctgctttaaatgtaccacgtcacagcatatacactattatgtagctatgtcttgtaaaagtctctaatcggcatccattagatgagccgaattctcctggccaagccttagcctctcaggg

SEQ ID NO: 144505 - DNA, 396 bp, Homo sapiens
ctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctct

SEQ ID NO: 144506 - DNA, 121 bp, Homo sapiens
actcaggagactgaggtgggaggattgcttgaactcgggaagcagtggttgaaatgagatgagattgcattactgcactccagtctgggtgacagagcgagactctgtctcaaaaacaaca

SEQ ID NO: 144507 - DNA, 1342 bp, Homo sapiens
agcggagttttgcccatgggcacaggcaattggtctcaactgcgcatggtttgccctgtaatgccctccaaatgaccagctgaaaagattgatagtctagagcagaggacctgcggcacctgatccacagaccagacagttaggaggcttctttgtcctcccagaagtgcaggcaaagttttggtgttcatcaaatgagtgatcaatgacaggttatcacacctactgcaaaaatatatggcacttccctctccacctccacagtgggctgtgaaaattaattgagttcaggctgtgaaaaacttaagctgctacatgaaatgcaaaatcattaagcttcagagattgtaacattctgcttgtggccttgggactgaaacaccagatgtcatgcccaataatgacttcacttttcatccaacttcaacaactcaagattgagcgcattttgggttttgaccttgcactgctatactgagattcagcagaagttaactacccgcaagactcgctccagagaactgaggcctcaggatcatcttcaacaccttcacccagagtacggagacaaaacccttgccacatagacctgccacaccacaataccaggtggagatgcaccgttgcttgagttggtccaccaagaaagttgccatagaagcctgaagttacgacagcttataaggaagtggttatcgattatgacggatggagaaaatggcaaacgtggctgaaagtggacatttttgccttgacaactccatctgctcctcctctatgaaagctccatccagggccaggcgcggtggctcgtgcctgtaatcaacactttgggaggccaagagatgcccaggtcccaaatgtaataattccatggtatgatgggttgctgctgcacctgtctgatttgagatgtttcccagtatggtcttgaattcctcagctcaagcgaccctcctgccacagcctcccaaagttctgggattacaggcatgacccaccatgcctggctaccttgaggaccttaaaagagggagcatatcctgaattatccaggtggacccaatgtaatctgaagggtccccatatgagggaggtagaggaggatttgactacagaacagaaggcaatgtgacaactgaagcaaaatgctacatgctggcttggaggatggaggaaggagccataagccaaggaatgccagcagtcactgggagctgaaaaaggtgaagaaatggactctccccgagcctgtagagcaagtatggccctattgacccttgatctcagccaagagaaattgatttcagacttctgacccccagaactgtacggcaataaa

SEQ ID NO: 144508 - DNA, 225 bp, Homo sapiens
acccctgtgctgccttttccatgaacacagggacaacctccgctcctgctgtggcttgaggtgctgagtggcggagacgcctatgtggctatgagagggcacaaatcattgtccctatgttcggagaaggaaatcaggtcaggaaaggttaaggggcttgcagttcccacaatttttttttctttgagacggagtctcgctctgtctcccaggctggagtgcagt

SEQ ID NO: 144509 - DNA, 247 bp, Homo sapiens
cgacccagcgggaggtcagggctcagtgttacttacccccggagtggcctgggctcctcaggctcagcatgtggggttgggggtaccccagtggttcaatttggcctccagttgttgcagactttagcaccttgaagtgcccaaactggagagatcccagggatcatcatcccaggcccatccgtgtttagatggggaagccaagtccctgagggagggaggggctggcccaaggatgcactgttag

SEQ ID NO: 144510 - DNA, 133 bp, Homo sapiens
ttttacatacatgaatgaacaaatggacaaatgaacatacatgacttcctaaaaggatgtcatagctcctgatagtcatgacagcactagtattaacctttgttttgtaatgagtttcaatttaatgttaagg

SEQ ID NO: 144511 - DNA, 355 bp, Homo sapiens
tccctccccttattgacaattttgctttccaaaagttaccagcttgagttaccagccatcaactgtggtccaaaaacataaaatggaaaattccagaaataattcatattttaaattgcacctcttagccacttagtagctgactcagttatcaaatccactgtggcagcattgcagtgcatgtgttcaaggaacccttattttacttagtaatggcccctgggtgcaagagtggcagtgctggcaattcagatatgccaaagagaagtcataaagtgcttccttcaagtgaaaaggtgaaagttctcaatgacggaaaaaaaaacatctgctgacgttgttaagttctacagta

SEQ ID NO: 144512 - DNA, 401 bp, Homo sapiens
atttgaagttacttcagccagtgctaatgataccgtagttgcagatttgaaccactgagatgcaattcacttatttaaaaactacttgataagagtttgttgggaggattgctagataaaatatgggacacttagttaaatttgaattttacataaagaatgaagattttttaatgtaagtatgtttcatataatatttgaatatgtaaaagtatccaaatatacttaaaaattattttttctccatttgaaattaaaatttaactatgtgttctttcaaaatctagcattcttacatctatgttagcttcagttagaagctaggctctgtggaagacaaaatggtgaatcagtcatagatccttcactcagtctagaggagcaaatgagagtcaaatatt

SEQ ID NO: 144513 - DNA, 456 bp, Homo sapiens
cctgccttggcctcccaaagtgctgggattacagacatgagccactgcgcccggccactattataaatatttgacctgcattagctcattagtcctcactaccacctaatgaggtaaatcttgttattatccccatcttatgggtgaataaatggaggctctgagaattaaatgacttgtccgaggacttcagattgtcatgattccctcttcagtgacattcacccaggaggctggtgcatgggccatgctcagcagctgcttatcctatccaaggccatccacatccctctgtcccgcgtggatgggccccctccccctggccagatctctaggagggaacgccagtggcctctccgctagatagggctggaaatcccagtgtggctttatcagctgctctcttcttaccaggaagctccaggttggcaagcccgtgtttgttgagatttggca

SEQ ID NO: 144514 - DNA, 353 bp, Homo sapiens
atttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctattttttttt

SEQ ID NO: 144515 - DNA, 522 bp, Homo sapiens
agtctaaaagtaataggtctacttcccctgttgccgagtacactctctgaacacttcataaagtgtacctccatgtagccttttcagatagcagtgatttagacatagaaacaacattatcagtaacaaggaagaaaaaaaccttaattgtctaattgatggctattatgagattccgtataattcatggaattggtaagaatttcacccaaggcaagaatttagcatggtgtatgcgtgtacttttatttagtcttcaggaatcacatggattgattgctgatgagactattttttaactaccaagcatatatattcatatatgctcaatggatacaaattttccaagatgttatttttttcttaatgttgggtccattttttcttctgtaagtactcatttctgaaacaacagtgtaagtaatttggaaacatgatttagtatgcaagtattcactttacactcctgtcttttggaatgcatttgatgcacatatttgttcaaactaaataaggcaaaga

SEQ ID NO: 144516 - DNA, 369 bp, Homo sapiens
cagcattttctaagtagtgggtgtggacactgtctacgttggagtattatgtttcattagatctaaaatgggaggctggatgccatggctcatttgtaaaatggagataataatggtactaatatcttcataaagttattataaggattaaagaagttagtatttgtaaagcctttaacacatttgtgtgtgcttaaaattggtgtatagtaagtgctctgtaaatatttgttaagtaaacattattaaattttaaaaacactcaagatatgtgtcacataagaggtgaacctagtccggggctctcattttcctgttgaggaaaccctgcacaaccttgtacaatctagtaagctgccctgtccatac

SEQ ID NO: 144517 - DNA, 380 bp, Homo sapiens
atctgaagttttctgctgggatgcccctgtggcatttcaaacccattgcctaatcagtacatttgcctggcccaagaccacctccttcctgccactgaaaactgaaatcttgacttcatctggggcttcaccttccacatcattgtcttccacccacttccaattcatcactgagaatgcacactcagcttttcttgtaacctggctcacttcttttcctctcctgccgctgccctaattttaggccatatccccatttttctagactatcacaaaagctttctacaccatatcctgttcccaacatccagttattctataaaataattaatttccaaaatgctgctcctatcctgtcactcctgccctgccttccctga

SEQ ID NO: 144518 - DNA, 751 bp, Homo sapiens
agccatgtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaacgaggggaacagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcaggtaaacaaggccacaggca

SEQ ID NO: 144519 - DNA, 550 bp, Homo sapiens
taaaaattcaacaccctagctctcaccaggggatgtatccctccccttcctgaaaataccctttcctgcagtgatcttaagaagggcaaagttggggtggctagatttgggagctcaccctcaccgggtgattgatcttgtctttttggaagagtttgcattaagctggtgggaaagagacaagcaggaatcacctgacctgtggccatcttaagcgaaattttgggaacatggctgtgaaactgacacgtggggacgtaatacccagagaatgcatctcccctttggcctctgaaaggctgactggcgaccaggacccttcccccagtgaaaagcatcccctgctcccatgcgaaagcatctcctacctgtttgacaggaaaatgtcattgccagacagatgaggaagattaaggtaaggggaatcagattagtttcctctacgtagtgcccactcagacgtgctggctagctgacccacagacatctggcaacactggcaggagaccaggatcccaggggtttgactttgcccttagtagagccagac

SEQ ID NO: 144520 - DNA, 397 bp, Homo sapiens
atttttatggctgcaggtattagagggcagccagtctacagaggtaggggctgcccatcctccagctgtcttttgcaatacgggcatacacttcgagccaacagcagctccagccggccgtgccagctgtcaaatgctttctgggctggcacggctctttgaatccgtggtaatggcttcctctgttgaatgtcgtccaaaagcaattgcttgtcagcttaaaagcgtgtgccatgttgtcatgcccgccgtctgagagggcaggcatccccgcacacttgcagactgggatgctgtagcatcttctcatgagtcagggattgggtgtaacttttgccaaaatttcctgcattttccccaccctctccaacatgtctttgaataccccatatccttt

SEQ ID NO: 144521 - DNA, 724 bp, Homo sapiens
gtctgctttacttagagtgaggctttcagctctgaagttgcatggatcttctacttaaaacttgtgagctaggggaagattaggggcattttacatcaaaccagggtatacagtggtctggtcagtggcctaggaggacatgggttttttactatagaagatgtggaagaggaaaggaaggagtagctcaagaagaaagtaggtaggatggagaaggacgtttctaggagaagaagcagtaaaagaaaggatttggaagggcaagtgctgatgatgtatttgtagaggaaagggtaactgaaggactgtgcaggaccctgaaggccaggctaaggtacctaaattaggcacctgggagtcatcaacagttgtagagcagagcagagtaaatcagaaaatatacatatgtccacacatagaaatatgacttaacgggggttttcagacatgccacattaaagaaaaaagtgtaattgaacccctgtgtacccattacccagctttagtaattttcatgcatttatttcatctattccttcattgccacctccaccctctcttgaattattttggagcaaatcaaaagtatcacttaatctgccaatattgtagtgtgtatttctaaaagataagggcattttgaaaatgtaatcacaatttcatcatatacctagaaagtattagcagcgtttccaaatatcatctgatcagtgttcctatttcc

SEQ ID NO: 144522 - DNA, 156 bp, Homo sapiens
gcctcccagtccccatctgagtttgggggtccttcctggtacggtggggggctcttgctcaggatgccctcccatttctctctctttttttttgagacaaggtctccctctgtttcccaggctggagtgcagtggtgcgatcttggctccctgcta

SEQ ID NO: 144523 - DNA, 431 bp, Homo sapiens
tactgggattacaggcgtgagccaccgtgcccggcctcatatccctaactttcattgcatcccttactgtgcaaaaaatgggctaaatctcagcccactgaggtccttccagctaaagtctggaaacagaattaatgaattctggctgtagaattaatgatcatcactatgtatgtatatgtgtctggcacattctcaaatttgtgattcctcttattttccatcacacgccaggtattttgtcttcccaggttgacacgtagaaagaaaagtactatttattcttttattctttttttttttttcgagacaagatctcactcttgtctccctggctagagtgcagtggtgtgatcatagttcattgcagccttgaactcctggactcaagtgatcctcccacctcagcctccctagtagctgggactaca

SEQ ID NO: 144524 - DNA, 125 bp, Homo sapiens
tatctcgctggctttagcagagaaaaaactaattcctgataaacggatggcaagatccaatttcccttttaataaatagtaattggtagggggaaaggggaaatagggacggaattgttaaaaga

SEQ ID NO: 144525 - DNA, 446 bp, Homo sapiens
agacgtgcactgatccacacagagacgctcgtgcacacacagacgtgcactgacacacacagagacgctcgtgcacacgcacacaggcgtgcactgatccacatagaacgctcgtgcacacgcacacagacgtgcactgatccacagagacgctcgtgcacacgcacacagacgtgcactgatccacacagagacgcttgtgcacacgcacacagacgtgcactgacacacagagacgctcgtgcacacgcacacaggcgtgcactgatccacatagaacgctcgtgcacacgcacacagacgtgcactgatccacacagagacgctcgtgcacacgcacacagacgtgcactgatccacacagagacgctcgggcacacgcacacagacgtgcactgacacacagagacgctcgtgcacacgcacacaggcgtgcactgatccac

SEQ ID NO: 144526 - DNA, 104 bp, Homo sapiens
atcagcactgtgtgagttgtttgacccgtccattcatgttgtgggaagtagccataaagacaacgagagcagcttatctacggatggggctgtagggtgggagg

SEQ ID NO: 144527 - DNA, 252 bp, Homo sapiens
aactaattctataaggttgttataaggaactaatgagccaacttgttgaggtgcttggaaccattctggcacagtgttgggctatgtgtttgttgaatgaatacaatcatgatgagaagtttgaattgttcatctgaaaagtcagaggcaactattaagttcatctcccatggcttcgagaagaagatgctcctgaggtttcagtttgtaactgtgagttttctatgagagtagctgtgtatgtggggggtg

SEQ ID NO: 144528 - DNA, 179 bp, Homo sapiens
actctcagggtaggatgatccacaggaagctttcccattcaccacatgtaaatttcatgatggcctacatacctacccatccagagagaaaagtttccaatgcaaccagcttggtgccaagtacacaaacaaccccaatcgatatttacaagttttgcaagttcccctctcctccctcc

SEQ ID NO: 144529 - DNA, 227 bp, Homo sapiens
tgttaggattaccagcgtgagccaatgtgcctgtccccttctagattattttgaaacaaatcttctgagttattttgcagcaaaccccagaattctgtcattgtacagtgaataattcattgtggatctttaacatacaaggacatttttatgaaaccaaatcaattgtcttattatgtccaacaaaagaaacactaatttttgaatatgtaatgacacagtacatg

SEQ ID NO: 144530 - DNA, 149 bp, Homo sapiens
aaaaggataaggagaaggcaagtttggagggtggaaggggcagattgaagtggggtaccagggatcatggagttgggggagggggttgagacaaagagcacagaagaagtagggttcctcagtgaacaccctacactgacttatgcaca

SEQ ID NO: 144531 - DNA, 728 bp, Homo sapiens
atttagattagtttgtaaagacgtaggtgtgcttgctagtgcagtgttccctataatctgtggatagatatttatatttaaaattttcccaaaggaaaaaaaattccatgaatttttttttttctctgcagttctctctttctagttgggttacacaaaaatgtattacttagacatactagctttgtatttgccacctgtacctataagagattctctaccaaattgctttctgaggtccccggttaccattagtagggttaggctgagttaagcatgtatgtccaaacccagctacttgggaggtgggaggatcccttgagaacagaaatttgaggctagcctggacaacatagcaagacagcagctcttaaaaaaaaagtcgctgggtgcggtggctcatgcctgtaatcccagcactttgggaggctgaggcaggcggatcacctgaggtcaggaatttgagaccagcctgaccaacatggtcaaaccccatctctactaaaaaatacaaaattagccgggcgtggtgacacatgcctgtaatcccagctacttcggaggctgaggcaagagaattgcttgaaccctggaggcgaggcgaaggttgcagtaagccgagattgcaccattgcacactagtctgggcaacaagagcgaaactctgtctcaaaaaaaaaaaaaagtaaatatatccatatatctacattctataaccatgtgttgtt

SEQ ID NO: 144532 - DNA, 1463 bp, Homo sapiens
  misc_feature (1443)..(1444): n is a, c, g, or t
tagaatatatgggagtgaacctgttatagactacaagttgagtaataacgatctaagtaatgagtccccagaaaacacagaataccttataaatggtatgctatgaaagggaaattattctttcatagatccttgaaatgttagcatctgcagaagaaatgaatgagaagtttaggtctcattgaaaaaagtgaagtgggttgggacaagtatatatttaaaagatttggctgggcacagtggcttacgcctataatcccaacactttgggaggctgaggcaagtggatcgcttgaggccaagagttcaagaccatcctgggcaacatggtgaaaaactgtccctactaaaaatagagaaaaaaaagaaaaaaatgagctggacacagtagtatatgcctgtggtcccagctactcaaaaaaaaaaaaaaaaaaattccacaaatgaaaaatgagttagggaaaagttccagtatttgaggtttatcctagaaaatagaagaccagactaaaaaagtaacagctaccttagagcatataatttgtaagcagtgtaatgggcactcataatcccaccagagctcttgtgtggaaacaagtttgggagataatttgctgaatacttctatgtgccaggcattattttacctcctagaaatacaacacctagttctaggtgctaaaagataagaatgcaaaaatgcctgctttcatggagcttacctgctaggaggaaagcttggctaaatacctaggctgatttttacctgtatgttttaaggagtaataaaccacatctctaaataccattttcttgaagtaatagctggttctaggtctgaatcatgaaatgtacaagatatcctggaatatctagtgccagaaagcaaggaagttaatagattactagagtcctgtctaaaggatacacaaaccaacttcaagagactcatactggccaaaagtggaataattttcatcagaaagaacagttacagcagtagattgaaatatatcaaatatatttaatgaggtaatagtgttaaacatatattgatcacctttggagactactaggccatcaacccactattcagaaaattggtaaataaaggaaaagcatttatcctacctttccattacaaccaaatgtcatggtaatcagagagttgataatacaaagttctttgtagaagaattttagctaataaatacaaaagaaatgataaaattagaaaataactgtttttgcaagcctcaacagagaagcagtcaatctagacagcactcattactggctgctaaaagcagtaggtaaaaagtggatcgcttgaggccaagagttcaagaccatcctgggcaacatggtgaaaaactgtccctactaaaaatagagaaaaaaaagaaaaaaatgagctggacacagtagtatatgcctgtggtnncagctactcaaaaaaaaaa

SEQ ID NO: 144533 - DNA, 158 bp, Homo sapiens
tttgagaccagccaggacaacatagcgagaccccttttctagaaaaagtaaaaaattagccaggcattattgtacacacttgtagtcccagttgctggggaggctgaggtgggaggattacatgagcccagtaagtcaaggctgcagtcagctttgat

SEQ ID NO: 144534 - DNA, 299 bp, Homo sapiens
atggcaggggacgggtgggaaatcggtatcaggtcccggcccgctctctgggttcggcctctctgttctccgagcgtcacccctgccctccccgccgcgtcccagcccagggaagggggtgctgcagagcgtcccccggccccagcccatttaacacatggaaagaccgaggcctccagatgggtaggaaggggctcgccttaggtctgtctccagcgatggtgggcaaggtgcatggcgctaactggatgggtggggagggtccatccccccgcccaccccaaccccgccttaggata

SEQ ID NO: 144535 - DNA, 275 bp, Homo sapiens
tttgaagtactaagaaagttaaagaaaaatgaatatgacttatacatgaggggatatccaaaaagcctataaacatttgaaaaggtgttcaacctaattagtcactggggaaatccaaattaaaaccacaataagatactactgcacactcaccagaactgcaaaaaatgaaaaagtcagaaaatactaattgtcagtgaagctgttaagctgtgaaaaccttcatacactgttggcaaggatgtgaatttggaaactattctactaaagtgata

SEQ ID NO: 144536 - DNA, 310 bp, Homo sapiens
ggattatcatgaggagcaaccagaaaactgtgctacactctctaaggggacacaaattgtcataattttccagaaaggaacataataagaacagaagtgcaattccatcaaatcttgccacatatgtgttacatttagtattctgggtaacaaatgccaaacttttaaccacttttcaggggtgagaggagaggaaaggacagagccggcatagaaaacttgttaattagtctgtaaaagagcaagcaaaagacttcaccaaagttaccacttcaggacaagaaatatttttcttatataggagagactg

SEQ ID NO: 144537 - DNA, 212 bp, Homo sapiens
aaagcagttctcttacacaaggcagtccttgccccacccccggtcctccgcatttcttaccaagcagtgagcccagcttgcttgaattttctgggtgtcctgccttttgatgttcatggagcgtgtacttacttatttagggatggggtcttgctctgtcacccaggctggagtgctgtggtgcaatcgtagctcactgcagcctcgaactc

SEQ ID NO: 144538 - DNA, 292 bp, Homo sapiens
tgaccttgtgatccacccgcctcggcctcccaaagtgctgggattacaggtgtgagccaccgtgcccagctatttttattttagagatagggtctttctatgttgcccaagctggtcttgaactactggcctcaaatgatcctcccacatcagccacccgagtagctaggattacaggcataagccactgctcccagcattgtgcttctttctaagtggtggtggcaggctgagctatgataacttgtccttcatttttatttttatgtttttatttttagagacagggttt

SEQ ID NO: 144539 - DNA, 556 bp, Homo sapiens
gaactgtgagaaataaatttctgttgtccataagccacccagtttacagtattctgttatagtagcttaaacagactaagatatactctaataaccctcaagaaaaaaaggatgaaaaatatcaaattcatagaaaatgaaagtacagatatcctaactataaagaggaatttttatgtctttgtttttcactcttagaacagaaaaaaaaaatgcaaaggaaagatgaagtgataaaacactgatcaaaaccaataaatctaaagacagcaaattctctgtcttgtcctcctcagtgctctgttgtttatttgtacctagcacaggtatactatgtatggcaaccttgccttaaggaacagtcatgaatgaccacactctaatccaacaatcaaaatcttaagagtttattttaaacagttctgcatatataacaaacactaaacaaactctgcaagggattaatttaaaaaaaaaatctgtgcagcaaaacttaaatgtaacatgtccccaaactcaaaaatatttaaacaaatgacacactgttaaaatgcta

SEQ ID NO: 144540 - DNA, 455 bp, Homo sapiens
cattattgtttctgccccaatcctaaagtctgttcctcattccttcttgcctgctcaaggactttccagtgtgtccgaactttgaaaacaaccaaacaaaccttccttcaatgctgcatcctccagctataatcttctttctattgcaaaagtcctaagaagcagtgcctatcctcttacctccactttcttacatcttagtctctcctgagtagtctgcactcaggctttcatcccctccggttcactgaagcaattcttgttgaggccaccagcaaccttcatgctgccaaatcctatagtcacttctcagttgctcacttcccttccttttgaaacactatttgcttccaaaataccacacctttcccccctatctctgagcattcttttcctatgttggttttgcttcttctattccagggctcactctgaggacccattgtctttcattt

SEQ ID NO: 144541 - DNA, 455 bp, Homo sapiens
gttaggatacatgaataaacagattaagatgactgttgctctgtaggttatattttgcagagaggagacatacaataaatatgatacatacataaatagtatagaattctagaaggtagtaagtgctatggcaaaaagaaaagagcaatcagacaggatagtagggcactggagaggagaagttgccattttaaatagggtagtcagtataggactcattgagtgacatttttgtgcaaagacttgaagataagtatatggtaatacacacagtgtgtttgtgtacttctgaatgtttaaactgccttgctcttttaagtaaccacatagttttctattggatgtacataatttatttactctttagtgattaagttttatctagtcttatgatactgtaaacagccacagtgatgatcctttcttgtgttatgtgagcacatgcacatcttgta

SEQ ID NO: 144542 - DNA, 442 bp, Homo sapiens
ccccggttcagtagataactgtgagagagacaggcggagagagagagagacagagacagagtagagagaaagagaaagagacagacagagatagacagagagacagagacagagagagacacagacggacagggagggagggacggagacaggcactggagaggagaagttgccattttaaatagggtagtcagtataggactcattgagtgacatttttgtgcaaagacttgaagataagtatatggtaatacacacagtgtgtttgtgtacttctgaatgtttaaactgccttgctcttttaagtaaccacatagttttctattggatgtacataatttatttactctttagtgattaagttttatctagtcttatgatactgtaaacagccacagtgatgatcctttcttgtgttatgtgagcacatgcacatcttgta

SEQ ID NO: 144543 - DNA, 160 bp, Homo sapiens
cttccacccctgcaaactgattcatcatgatctccagtcccttgatcactactttctctctagttttgggctccctcaacctcacttcctacctgatggggcctaaacaatcatattagatcaacctacactcttgcacatacccttttcttgatgacaa

SEQ ID NO: 144544 - DNA, 350 bp, Homo sapiens
tgacctggggggtaatgctggaggataatcagaacacctattaataaattaaaagtgtattattacatcaggattggctacttttgaccacgctgaagcatatttttaaccatccaattcctcttgaaacagtctctctacttactttttttttgttttgagatggagtctcactatgtcacctaggctggaatgcagtggcatgatgtcggctcactgcaaactccgcctcccgagttcaagtggattctcctgcctcagcctcccgagtagctgggattacaggtgcgcaccaccacacctgtattttttttttttttgaatttttagtagagacgggatttcaccat

SEQ ID NO: 144545 - DNA, 485 bp, Homo sapiens
ttctactctggcattctttgacaattaccatgattggattataggtaaggattctttaaaaccttttcttctttattatatctttagagcaaatggccattaatttgcaaatacatttttttcatgaaatcctctaatcaaatgccacacatttaaggagttagctatttgtttaaaaaggccattttgaaagagagaactgttctctttatgcaaacctcctaatgaaattcaacagtgaatctgattttatttgcattgacccacctctgagtttaagttttttatgtttaacatatgggctgtttagccaccttaacttctaattcaaagtcaaccagtaattaaactgcagtttagctagaactgctatttctataattctggatagactgaagagtaatacagatatgtgagaagcttgcagatttgtcaaataagttgaatttgatgtatggatgttaggtcattaccacacttaaaag

SEQ ID NO: 144546 - DNA, 197 bp, Homo sapiens
gtgacagggagaacccagagtcacaatgacagggtttcaacccagggtgtggcacttcctaactctgtgaccttggacaagcagctttacttctctgtgtctcagctgcatcatctgcaaaatggggtttatagtcaggcttatatgaatttactcactgttctaaagcattcagaacagtgcctggcacatagtgg

SEQ ID NO: 144547 - DNA, 723 bp, Homo sapiens
tccttgtatagttccttttacaaataaccacagatagagatctcaattagtcatatttcttatgcctaactactcttcatttttatttacgagactctctcatatctcctgtacctactaacttagtggctatatgcttgcacccagcaaaaacagcagtcatggttaggaaggcagtgcccttaatatgacctctattgcttgtctgggttccactgtccagcagagaacactttgctgatggcctttgagaagtgccttgggtcacagttttatcttacactgtcagaagtgtaatagcttttggctttatcagaactagaaggcttgaaatcaccactcagtcaatttgtattgcagactacaggcagagaactccatcttagtatgactttatttccttccagctctgttaacaaaatgactagtttttacctgagttcatctttctcaaagtactttgctaaagagacaggaagaaggcagtactgtctcactgacccagagattcactcccaaccattttccctgctactacagattcaaagagcaggtagtctgcctgctaaggtactgagttgacaattttatcaaatgtcttgtggcgggggaaaaaaaaaaggaggggcttggtcaccagcttttcacctgtaatacctgtgctgcctgtcagttaattaataccacataatttaggttaatgtcatggtctctacagaaaat

SEQ ID NO: 144548 - DNA, 228 bp, Homo sapiens
ggaaggatggtttggcacaaagtcattgtggctgatgctggaaagtaagggcaagtggaggggccagatgaagctgctgagataaatggggaccagcttgtaggtgacactgagaagtctggtctttattctaaaatggggagccatttgtgttttaagtggagatggggcaacaaaaccagatcagaaaagatcattctccatattgtgtgaagcatggattgggtg

SEQ ID NO: 144549 - DNA, 623 bp, Homo sapiens
agacaatctggtacaaatctgcatagttgctggaaaaattagtgtccacattcttcttacagtgcatccaaaataaggacccaatgtcaaagtgtaggcttaactggatgagagaaaggtagagaaactacagctcctccctcaggtcagatttaaattgagtggttactgatgtcttttttaaaatgtgaaatttagtggagctgcctttggaagtgtggtatttatccccgctttagtctgtctatccatagtggctgggagcttcaggttaggctggcattctatgaggtgttcttggtaaggattagctggcctggagtctcactatgtcaccaggctggagtgcagtggcgcgatctcatctcactgcaacctccacctctcgggtttaagactctcttgcctcagcctcccgagtagctggaattacaggcacacaccaccacacccagctaatctttctgtagaggttattattattcaagggtgtttttcaggaagctggtggacagtggtgggcatttctgctctgggattcaggttgtccttagaggagaaattctaatgatctggtagaacattaaaaaaagttctcgaatatttaattattagctatcaat

SEQ ID NO: 144550 - DNA, 438 bp, Homo sapiens
tcggtacccggcacatcatacgtacccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttccttcctttcttttctgtcggagtcttactctcgctcagactggagtgcaatggtgcaatctcagctcactgcaacctccgtctcccaggtacaagtgattctcctgcctcagcctcctgag

SEQ ID NO: 144551 - DNA, 438 bp, Homo sapiens
gggagagtaaaggaaccataggattgcctaagatctgacttaattggggcaccctgattcagcagttccttcaacttgaggtgtgcgaggctccccataaacttcgaagcgccacgtccccgtacgactcacccgcggggcgcccggccatggaggagcctcctcaggtgaaagatgaggccgggcgcatgccccagggctcggtcactgtgccagatcagatgaatgaaggccgaatttccccagccggacctagtaaggcacatacccagagtggagatatcaattggtatttggacagtgggaggaatctgaaagagcgttcagcacagtcccttcttttgatctatgagatccaatctttgaaataatccatctcgtcatgcacaaggtcacacacttcctagttaccagtgtcgtcctggaacctgggccttg

SEQ ID NO: 144552 - DNA, 351 bp, Homo sapiens
aatttccaagtactttaagctatagaacaacttaataagaatatgaacttaataaaacaagaatgcaaagatgagatgtgaaaacagcagaattaggtaaaaaggaagattgcaaactaaagaacccattaggacaaaacaacattatagaataaattataaatagagtgaaatagaaacatgtggctaaaaattgaattatggacagaggaagggcttcagataattacattgacgggaaatgaaaaagaagaaattaaatgaaataactatatgtacatatatatgtatatacatacacacacacatatatatattcttaagaaagaataaaatgtttagatctaaata

SEQ ID NO: 144553 - DNA, 151 bp, Homo sapiens
gctttagagaaagaatacctcatagtaaaattcaaaggtccgtgaacctatagtgatagtttctgggtgaaggggtagccattggaaacttccagaatccccacagttacactattttgtcagtttttaagtctaattccgatgactcatc

SEQ ID NO: 144554 - DNA, 514 bp, Homo sapiens
cagaagttgaaataaatgaaagcttcattgaagactgacacttcattaccttatcttagaggcaaggaatactatttttctttcatattatagttactcattttaataatcttctcatctacaaagagagcttctttatttcaccatgaagaaaactacttttcattctaagtctcttgtttacttgataatgaacacatcttttgattgtgataaggaagattttcttcttttggctagtatggaaataattataaaataagaattgtatggtaacccaagtataatagcatttcttcctttttaaaaaagatctcagtggaattgtttgtattaatgcagcatatatatgataaaaaccaacactctgctgttgatatacagtagtaatctatagtgtctgactctcttgaaatactctttccaatatgaatccagaatgtgaaagtggtatggatgaacaaaacagaatatgtagggcacaagcaaaatatggtaggaagaaggaaagagc

SEQ ID NO: 144555 - DNA, 161 bp, Homo sapiens
tggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaag

SEQ ID NO: 144556 - DNA, 132 bp, Homo sapiens
tgagggtgcgggcggggcaggctcctgaccctgcccagccgtccctgcggtttgtgtgtctgctggtctggggtctgacccaggcacagaggcagaccggccacaaacacagacacaggcagtcaagcctca

SEQ ID NO: 144557 - DNA, 551 bp, Homo sapiens
gcgcccagcccacaaaagtttcttttaatgaacattcacaaagataaaacatatgcggagggccataaaacaagtctgaaaaaattccaaaggattgaaatgatatagagaatgttatctgaccaaaacataattaaattagaaattgataacaataaagtatctagtagatcttcaaatatttggaaattaagcaacacacttctaaatccctgggtcaaaaaaagagcacatgtatagcatctagcataatgcaaccaagaaatacttgaaaagacccctatgtttgggttgaatattttgactggagaagatatgagagatcaaataggaagttcacctttattcttcactactggagctacttagaaaagccctagccctagagaacatactttcctctactgttaatttaagtaaaaagtatgtttagaaagatgttatggaaataattgtctatgggtgctgcccaacaagtaaagtagcaaggcagatccttcaaaaaatcaaatggcaagcttcagtcagcattaaaaatttttcaaacatag

SEQ ID NO: 144558 - DNA, 330 bp, Homo sapiens
aaagccaggccaaccggggaagccctggataggaccggccaacttctcagatggcccaggcagccattccaggctattccataaggctagagcaaattagttattttcttggggtaggaactgtgatgaaaggtctccaagatgaaatctgaaaaataggccttttcagatagtcttggcttctttcaattgtttgacagtgtatatacccttggagaataagaatttgcatcttgcttaccattacttttcgtaggtcatgaaacaaagtcctatgcttttttttttttttcaggtctgattgtaccctcattttcaaaaccaggaatg

SEQ ID NO: 144559 - DNA, 133 bp, Homo sapiens
atgtacaagtgtccctctgcctccatgtgccccgtgcttcacattcctggatctctcccctccagctccatccctttcctctgcttcatctctccatgctctcctctcctctccaccagcgcccacactcctg

SEQ ID NO: 144560 - DNA, 526 bp, Homo sapiens
taggatatttagcagaaaaaaatctctaagcaaagtgttcaggatactgcatggcttctcttggctgcttatagtaaaatccaaggagagacaatgaggtgaagatgaaatttataatcaaaaaagacatagaatgtaaagatttggaaaattctcaaccaggccaggtaaagaataaaaaagcatgcttaggagaaaaaaaatccaagggcgtggcaaaggtgtgactgtttcgtcaagacagtggaagaatgaccccaaaagctgttgagatctttgagacagccatacccaccacaggtccagaatgctagggccttgagggtagaactgtttcaagggaggggcccagggtacctgtggagcctcagggcttgctgcacagcaccacctcaagtctctgctccctgcattccagtgcagtgctccttgcaccccacctgtagttcaagtgggcccagatgctgctaaggctgccactcccaaaggaacaagcagtaagcagccttcccagtgtccacatgtt

SEQ ID NO: 144561 - DNA, 254 bp, Homo sapiens
ttatactttaaatccattggtcgaccattgtactttggatcttttaccaatgcatgattttgtattgtaattgcattcttattagaaaaggttggttcactgagttatgcaaatctttcaagtgttgacacatttcattatacagtatcaaaaatcatgttcatttaatatcactgctcttataagaacagtcttttgagtattgggaagctgtcaggctcatggtggtgtaatcaaggtttccaaattctaat

SEQ ID NO: 144562 - DNA, 236 bp, Homo sapiens
tgagacagggtctttctctgtcacccaggctgcctatcacagctctctgcagcctcgacttcccaggcttaactgatcctcctgcctcagcctctcgagtaactgggattataggcacacaccaccatgcccagctaatttttttttttagagaaggggtcttgctatgctgcccaggctggtctcgaactcctggattcaagcgatcctcccgtctcagcctcccaaagtgctgg

SEQ ID NO: 144563 - DNA, 383 bp, Homo sapiens
ctgctactagaattcctctttgaaaaggaattgtatttgtttatgatagtaccttaataaatgctagaaggcaggtggagaccccccaggaatctgggtgtgggttggatggttctgtatgagaatggaggaagatgatacttgtgcagaaatgggaagagaaagagagagtctgaacctgctaggtggtgaaagctgcctggttcacaatggaatttgctccctgggacccttcaatcttcagcagagaacttaaacccacaaaattattggtgtaagtttttaaaaaaaagtttttttggtttgtttgtggaaactgattgtattagtccgctctcatcctgccaataaagacatacctgagactgggtgatttataaagg

SEQ ID NO: 144564 - DNA, 385 bp, Homo sapiens
agatggggtcttgctgtgttgcccaggctgttcttgaactcctgggctcaagcagttctctacaaaaaaaatacacccccaccaaaaaaaatagccaggcaattgcttgaacccaggctggtctcaaactcctgggctcaagcattccacctccctaggcttcccggtgtgctgggtttacaggtgtgagccacaccctgccctcatattctttatctccttttgttgttgttgttgttgttggcacatatagtcattcattgcttaatgacaagaatacgttctgaaaaatgcatcgttagacaagtttgttttgtgaacatcacagagtgtactcaaacaaacctaaatggtatagcttattgctgctaggctataagcctgt

SEQ ID NO: 144565 - DNA, 452 bp, Homo sapiens
tctcaagtataacgtgtctactgtgggtctctttgagttcatcttactggagttcaccaggttccctgggtgtttatactcatgggtttcatcagatattctctccacccttttcttactctcttcttcctggactcccacaatccctgtttggtcctcctgatgatgcccacaggtccccaggctctgctcacttcccttcagtcttgttgtttgcttctcaaacttgattattttcactgtcctatcttcaagtttgctatctctttcttccgtctgttcagatctgcctttgatttcctctagtgaatttttcatttcacttattatactttttagctccagaatttcttttggttcctttttacgttttctagctctttattggtatttccattttgatcatacatcattttcttgactctctccataccttcctttaggatctgacc

SEQ ID NO: 144566 - DNA, 293 bp, Homo sapiens
ccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccaga

SEQ ID NO: 144567 - DNA, 169 bp, Homo sapiens
agccagaaggttcccaacacctagaaatggtcaatgagatgacggatgtgccgatcacgagtcacatgcttctcaacatcactgtgcaccccatacacttgcacaattattctgtgtcaattagagaacagtagtgagaggcctggagtgaaaagaaactgggaggccg

SEQ ID NO: 144568 - DNA, 263 bp, Homo sapiens
tgtggctcatgtctgtaatcacaacactttgggaggccaaggcaaaaggatcacttgaagccaagggtttgagactggcttgggcaactagtaagcgctcgtttctaaaaaaatttttttaaataattagctaggcatgctggtgcttgcctacagttctagctacttgggaggcttacacagggggatctcttgaggccaggagtataaggctgcagtgagctgtgattgcctgagtgacagaggcagaccttgtctcttat

SEQ ID NO: 144569 - DNA, 422 bp, Homo sapiens
cacctcccaggttcaagcgattctcctgcctcagcctccctagtagctgggattacaggcatgtgccaccatgcccggctaattttgtatttttagtagagatggggtttctccatgttggtcaggctggtctcgaactcctgacctcaggtgatccgcccgcctcggcctcccaaagtgctgggattacaggcatgaaccaccacacccggcagtcttggggaagttgcttaaactttctgtgcttcagtttcctcatctagaaaatggggataatgatgtctgcctcataggcttgctctgaggttcaaatatgtaaattcatgtaaagtacttacaacaacctccaaattgtataaacagtataattgatagaacacaaattatgaattcagtacatagatttagcactgtataaatgc

SEQ ID NO: 144570 - DNA, 479 bp, Homo sapiens
gcctcagccagcaaccactttgacctggagaccttcgatgggtctccttgcttccttcaactgttgtccccttccactgcatcccccacagagcagaagtgtgctcttcttaaatctgaagaaggatcatgctgcagccctgctaaaacctttcacttttattgaatcatactgcccatcaaataaaaccgccagtccatgcctcagctcaatttcgtcctcgcatacgtctttctccaatctgagacagggtgccctcccctcacttgctgcaatcctgccctgctggtctgacttcagtctctcaaacattccagacatccccctcctacttgcagtctttgcacctgctctttcctccacctagaacgctctgctccctttctgcacatgcggtagcagcctaaatgtcaccacctcttcagaggggcatctcacaaccacacattctaaagtcggtctcagcccttgcttttttc

SEQ ID NO: 144571 - DNA, 227 bp, Homo sapiens
  misc_feature (7)..(8): n is a, c, g, or t
  misc_feature (39)..(39): n is a, c, g, or t
  misc_feature (45)..(45): n is a, c, g, or t
atgaccnnatgactacgagattcgagcgtgcggtacccntcacgnccatgtcacaacagacactattcacaacagtcaaagggtagaaagaacccagctgtccatctacaaatcgataaacaaaatggggtccatccagccagtggaatattattcagccctgaaaaggaaggacaatccgatacattccacaacaacgtggatgtaccttgaggacatgaagctga

SEQ ID NO: 144572 - DNA, 167 bp, Homo sapiens
tccaagattctctgagcttgacaagctaccagtaaggccatttggctgtgaacacgtagtactatgctcctatctgtgattctcattttgacacttaatcacattacatgtggacatgggcagccagtcactgcatctgagtatatattggtcagcctctattaaat

SEQ ID NO: 144573 - DNA, 438 bp, Homo sapiens
  misc_feature (236)..(237): n is a, c, g, or t
  misc_feature (239)..(241): n is a, c, g, or t
atcccagcactttgggaggctgaggcatgtggattgcttgagcccagtagttcaagaccagtcttcgtggacaacatggcaaaaccccatctctacaaaaaatacaaaaattagcagggcttggtggtgggcacctgtgtagtcccagctactcaggatgctgaggtagaaggatcactcgagcctgggaggtctaggctgcagtgagctgtgatcacgccactgtactccagccnntnnnaggtgacagagtgagatcctgtctcagaaaaacccgaaaaacaaaaacaaatttaccaatttaaattcctatgaacagtgtacaaaaatgcctgttatattacattattataatattatatattattatattacgttatcacttgtagctgtcagtatagcctagattgtgctgtagtaacaaacagtcctaaaaat

SEQ ID NO: 144574 - DNA, 240 bp, Homo sapiens
tgaaatgcacctggtaactgcatggagcactcgccctgagtaggccacggtgcactggtacctggtggttccctgaaacaccccagatcatatctagaaaactgctgggccagcctcaagtagagtcccctccagctccgtcaccacggccacctccaccatcagccctctcataccctcgcccacctccagcctcaacccactgccagccacatcgcctctgccatctgtgctgcccgg

SEQ ID NO: 144575 - DNA, 651 bp, Homo sapiens
ttgcacgctccgttgcacgcctgctcacctctctcccctcccgtccccgggctgcaattttgcacaaatttgccctctcgctgtcttgcacattctgcctttgcttctggctggcgaggcccgctcaaatacactctgctctcctcgcacacgctgcatttcctttctcacgctccatgcctccttctctgcttcttgctgcttacacacttttcccctaccagggccctcctttacacactccatttcacatctcctcctccccgctcgctctggacccttgttgcagacacacttgggacacattttccctccccctcacagactccatgcacatcattcattctctggagtgccctgctctttgctcagcccttgcacacttgctatcttatgcacccctcctgacacactcttacctccattttcttacgttgaagcactttcccttcttattcttaaaaaccccagattcttccactccccaactctcccctctcaccatgacactcctagccccccaccccccgccttccctcttgccccttttgcaccgtcacttttggtcacgccttttgcacacttgcctcccagaaactgtttctctcacacatgctcattctcttcttctttgccaggctcccactccct

SEQ ID NO: 144576 - DNA, 748 bp, Homo sapiens
taataattaaagtgagacaacaggcataaatacagacttcccaagtaaatagaggcatatggggtcactctgttataaccatttattttctgactattcccaccaggcaacaggtctgaaattcacaccaagacatctccatcttggaccatcctagattgattgacctaaccgtgttatcggtacataccacattcattttgtctcatgtgtaatgataattgtgttttgataaaatattttttcttcatctccaaggaatggaattgttcatattcattagtgtagtgcttttgtactaaaaagtagactacgtatagggtaggtagacaatcttcttaaactgctttgaaaatactgactctaattgataggttattttccagagaaattggtggaaatagtctcctttggtattgactccccaaacattcacagtttggatggaaacgctgttgtactggctgtgagatgctgacccttggcagacacatttgtttcttaattttctactcaaaaggctactaactttgcgaaattaatatgatgactcagacttggaaatcaattgttccccctttgacacaaaaaatattgtaggatctattttatgtttctgtttttctggaaacttttacagtgcacctacatgtactgactcaaaaattggttcttaaacactgtttcaacacatttttatcatttgtacaataaataaaaataaataaaaaataatataaaaaataaa

SEQ ID NO: 144577 - DNA, 1009 bp, Homo sapiens
cagtctagcatccttaactagtgtggctaagtgttgatggtggcaaaaagagtaacatgagtgaaggaagttggcagggagtggggggcccatggtggcactggcctcagggccatgcagatacaggcataaggcccagctgagcacagggtctgcatttagatggtccaatagatggttaggccctagcatgggacaggtggcctttcaggtcaggtgagagcacacaggtcctttaacccatttaaaagacctagggtgtgggaatgaatgagtgaagccatctgggaacatgtcaggactgaaaatgtggggcaagaacttcagagaaggggccttgggttctgcagactcttgcctcattctaagctgctaagttcttctctattgaaaaaccaaaaatcagatgggtcccacagccacgtggtgggcctgagcctcctggtttggattgcaggcaggggctgaatgcacagggtgttaagtggctcaaggccaagattgaaagaatggacgcaggggtgacagatatgtaacaatgcgtaacatccaggcactatccagtctgataccacagcagggtctggaagcacttgctgttgctagattatgggagggtctggcaggccccagtggggacaaggctgcctacacaggatgggaaacactggcaggggtattgggggatcagctatttatcaaccactgctaaaataaactgctgtgagtcagccctgggagcaggggcagacaggttattcccgccttccagttggcactctgtccacatctgtgtgaaagggatattgcttaagaaaggaaaataaggctgagggtggagccaggaggagcttgtttttgtcaaatttctcgaacatttgctttgctggttagcacaaacaaaagcttgtgcttttgcgattaggaatcgtgtctctttgttgttgtggcatggttgagggaaaagaaagtcctagacttctccgccctgtcaagcacgtttggattt

SEQ ID NO: 144578 - DNA, 201 bp, Homo sapiens
aagaatgtgggcctgatgggtaatgcctaggttgccattccagggcatgagaggaaactatatgctgaagatggcaaagcgagaaggtagtaggaatctaggttcctgctgactctgcagtcaccatgccagcctagaactactttcctttgtgcttaattttcttttcttttatttttctttctttcttttttttttttt

SEQ ID NO: 144579 - DNA, 646 bp, Homo sapiens
cggacgcgtgggtcgacccacgcgtccggacacagcctagggaggaaacaaatttcaagggtgtctgtgttggtcatgggtaggaatgggagagggaatagtggactaatcagtaactgtaaaactttgtgatacatgtaaatggtagaatctttcatgttctatgaaaataaatgattgaacaattaccataatctggaggtgatgtatgttaattaaaacttctaaaaggaagtggcagctcagggtaaattttgatcagtcatttttcagtagattagaggaggggaattttagactgctggaaggtagaaagaggatactaggcatctttctagtaaaaagagaggttttgtttttgtttttgtttgttttgagaggaggtctcactctcacacaagctgcagtgcagtggcatgatcatggctcactgcagtcttgatctcccaggatcaagcgatcctcccactttagcctcctgagtggctgagactacaggcacataccaccctaggtctggctaattttttatagagatgggatctcaccatattgcccagactggtctccactcctgagctccagtgatcttcctgcgtaggcctcccaaagtgctgggattacaggaatgagcaaaagagctagt

SEQ ID NO: 144580 - DNA, 569 bp, Homo sapiens
tctatcttccatgaattcctcacaacagttgatttatgtcatgcttttgtttcagagcattgcttttaatttggtttttaagaaatcttttctgaaattaagaaatttgagatagcaagagagatgggcacatgaattcagtttactatcttgatccaatttccaaagaaatctaagatgttagtttagacatcacatatccaactacatcaatcttctacttaaaatagtccctcagctccagcacaaagtccaagctctctggcctaacatactggatccttaacccaacttttgttcatgctgtccatcagacaggaaagcactgcctttttctctgcctggtatcattacctgatgcttacttaacactatattataaatccttgtttacatgttctgattcatcacaaaaattgtgagaccaagagcagagatcttactagtccttgacttctcagcacccaaagaacttatcatgtggtaactattcattttataaatgagaatcaggcattaaaatgccatggaatcttagagtcagatctcagaccagtgaaccacagata

SEQ ID NO: 144581 - DNA, 400 bp, Homo sapiens
gcctcagtctcctgagtagctaggactacaggcacgtgtcaccacgcctggctaatttttgtatttttagtagagacggtttcaccatattggtcaggctggtctcgaactcctgatctcgtgatccacccgccttggcctcccaaagtgctgggattacaggcgtgagccaccatacccggcctggagttcctttcttgagtgtgtagaggattgagggttgattggtttttggagtttccatcattaatgtaggagcgatacggggaatcacttggcgaagctttcattgtctctgatgttggaggtaactggagggccagtgcctggggcttccatttttttctagtgttgaagggtcaagagcatttatcagatagaggccttactgtgtattgtt

SEQ ID NO: 144582 - DNA, 442 bp, Homo sapiens
ccagaggaatgtcactaagcagctcttctgaagcactggtttgggtggacagatctaagcttgccatggagtgtgggacaggattccacatccagctgctggagtgagactgcaaaggagagcagatggaaggatccgcgggaggccactgactgtctgtctagtctctgagtcagccagaagagctgaattctgctagcctgtcagtgtctgtcttaccatctctaactacagtgaccttctgcgtaattgcagctactgcactttcaccttccaaatcttgggcagatttctttttggctaactctaacccagaaccatacagggaagggcatttggggaaacctacttctagcttaaccaagttgataaagtacaaaactgttagattctaccctttgtcaacttggcatctatacacacctgtttttatcatgttagc

SEQ ID NO: 144583 - DNA, 473 bp, Homo sapiens
gcggcagggacggagcctgtgaagggaccagtcctgcggatgacttggttttaccccctaagattcactgtggacttctgacctccagggctgaaaagaatgaatttctattgttttcagcctctaagtgtgtgttcatttgttacagcagccccaggaaaccaacatagcagctccgagctacagtctgggctcaaggagtccggtttatgggctgagaagggagaacccgatacctttgcccagtcctcatccccggcagccacatcagcagccctggctggctctcggctccagatgccaatttcccacagccggtgacttccaaagcaataagcctgggctgcagcccccaaggcgtcttcggtcatctcaggccaagtgtttttggagactgagcaactttcgcttccctgagagggccagggcctcccacaagcaggacttggtttttgcttttgtttccctctgcc

SEQ ID NO: 144584 - DNA, 270 bp, Homo sapiens
tcttagaggtcacatctcagaacctctgggactatctatagcaagacatggcatcaagtagccagacagtttctgaaaagggctcagcccccactgttagatgttctgtggttcccctggaggacgtttcgggttccctgtgggtggtatcaggacgtcccccagagctcaggtcactcatctctctccataactggcagcagagtcggaaagcctgggaaaaaaagacttctacttggaaaggagcaactttttaagttagaaaacaca

SEQ ID NO: 144585 - DNA, 468 bp, Homo sapiens
ctgccacacagcctcccttacagcctcctgtcttcacttccatattgtaggagagcagaatgggacacagtagatgcctctgacttcaatccccttacaatcatgcccttcctcctaggctaaagcaacacagacttctttaaaagaccttctccaaggagagtgatgaaacaccagatctggaatggttatgtgtcattaagtgtactggttatctaatctcccaaggaatcacctctctgttcctttcttcaggcagaaaaagggaggagtctactcaaggcagaacagagtctaaaagaagagtggcctggcatgggggaaaggacagcgaaaaaagcaaaagcccattacctgggcttctcacttgcactaatgctgcaacattttcctggtatatttccctggtggatctctcccagtatagccacctctcatttagtcagtcaacaaacacttattgagcac

SEQ ID NO: 144586 - DNA, 336 bp, Homo sapiens
tgtaatctctaaagaaggttgtattgtctctacaacaaggaaaaagttgaaggacaaagggcataaaattctttttttccaacataaatctttgtctgttttatagtgttgtctgtaatttcaaggtgaaagtgggccctccctcagccccgtcacactctagatgcatccccagattcccccccgtcaccgtcacactctacatgcatccccaggtttcccagtcaccgtcacactctagatgcatccccaggtttcccagtcaccgtcacactctagatgcatccccaggtttcccagtcaccgtcacactctgcgtgcatccccaggttcccc

SEQ ID NO: 144587 - DNA, 597 bp, Homo sapiens
aatcatataactgtgacagatgttaactggttactcaaaaggccattcccaaatccctactccctccttgcctctcattacagaggccaaaagacgaaaacagctggaggtgaccatatgacccaattttggcccttggaacatcagaagtgacttgctggaatcactaataagaaagcttttccttggcatagtctttttccttcttccttgaatgtaggtggaaggctggacctgcagtagccatcttaagaccatgaaaggccaagcaaatcacaaattcataggccccaacaatgttgaaccattaaagcaacatgagcagctgccaacttcagatttatgtaagctttatagtcaggttttcaactgcttacagcctgattcacccattatatatcaccatatcagaaactccaccacaattttaactgtaagtaacttcctggctaataattaaaaacaaagtcacatactagtcctaaattagtctgacaaaattacaatctcctgatgaggactattctgagtatttgctcaggaagctgtgagaagcctgagctgaggaaagaatgagagacaagaatacagaatcgg

SEQ ID NO: 144588 - DNA, 425 bp, Homo sapiens
ccctctccctaagcctgtgtcaaatagcagcctataattaaatgaagattaaatttaatctattatttcaaaaagcatacgttacttaaatattagtaactcagttttaaaaaggcacactactgagaaaatccagccttaaaggccttttccctaaggtggaaaaaaaaaagaaaaagaaaaaaaaaaaaaggcggcatgctgatacacatgctgtaaaatctaagtgccccaatcatctgtcatttgcttgcttctgcttgcccctaaccagctggctctggcttaaagatatccccttaatgcaattcattgaaaaaatacaaagcaagaaaagtcagttagtcaagaaagcataaaaacaggcagggtgtggtggctcaagcctgtaatcccagcactttcggaagccaaagtgggcaggc

SEQ ID NO: 144589 - DNA, 230 bp, Homo sapiens
ggtattgcctaggttttcttgtaggggttttatggttttaggtcttatgtttaaatctttataatcattatgggtaatttttcaactatttttgctatgttttctaagttctttttaaatatacttgttggttgtgcgtggtggctcatgcctgtaatccaagtactttgggaggccaaggcaggtggatcacctgaggttgggagttcaagaccagcctgaacaacatg

SEQ ID NO: 144590 - DNA, 438 bp, Homo sapiens
ggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctagg

SEQ ID NO: 144591 - DNA, 921 bp, Homo sapiens
  misc_feature (628)..(628): n is a, c, g, or t
  misc_feature (630)..(630): n is a, c, g, or t
  misc_feature (812)..(812): n is a, c, g, or t
  misc_feature (909)..(909): n is a, c, g, or t
gggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatggagaccagcataatgcgcaggcgcgccccaccgggagcgcgcagagcagtcccacgacagtaggaccactatcggccaccgtcgaccgtttcctctctcatccgttcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaatttntnattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggnaacctcgtgctttctgcagaggagaccggagggcagaaggcagagtccaggcttagactgcagttcctcgcttacctgtgcagtctaattttgagcngctctttgtagt

SEQ ID NO: 144592 - DNA, 217 bp, Homo sapiens
tcatcgagctcggcacctatccgtgttcggggttgtatccctgttcggggtgttcgtgttcggggttgtgagcattaaatgagatatagcagaagagcatctagcatggagtattcttacctggtaggtgtgtaataaattgtctctccccagggaaccatgggggtgtgggcagcaactggggatgtggggatgcccacaccccatcctttttagt

SEQ ID NO: 144593 - DNA, 141 bp, Homo sapiens
gatgtacctgcaagctacttacaaagcaatcttttgataaatgcaaaggattgattgaccaataacccttcttcaaacaaattctagagataatccaaattctcggctgggtgaggcatagtggctcatacctgtaatccc

SEQ ID NO: 144594 - DNA, 518 bp, Homo sapiens
gcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgta

SEQ ID NO: 144595 - DNA, 159 bp, Homo sapiens
gctgacacttccacagctgccctaggtatgggcacctgatgccaacgaagaagcccaaagcgcctctccacttcacagatggaagcctgcccccagcactgggctgacagcatctggagctgtctcctggtctcaaatctcttttggagactcagaata

SEQ ID NO: 144596 - DNA, 430 bp, Homo sapiens
tatttcaacctcctcactaatcaaagcatgtgaaagtgcttcttgagtgtctttgatatgttcttcactagcctccgtgcgtgggtgtgtgtacacaagtatcacacacacatacagaaaaataagcttggttcctactctaaaagaatttacaacccggatagagcaaactggcacatgggaaacaatggcaggaatgcataggtagcaaatgctagttgccacggcaggatggaaaaattacaaagttcctgagctatttggaaagctcactatatcacaaaacaaacatagctttttaaagttaaaaataaaatccctgtcagtgaaactgatttatttcaaatagtaagtagaaatgatcattttcctaaatgaaatgctaaacgatgttgggatgttacggaggcaacagttcaataaagatttc

SEQ ID NO: 144597 - DNA, 297 bp, Homo sapiens
gtgggacaactcgaagcaagggccctgcctttcaggtcataggtagataagagacaaacagttgcattccttcaagtctctgatgagcctttcactgaacacacagtttacatgtgacaggagggtagaggagtagtcacttatgccttggtctggcttagtgaaatagggcaaagggagcaatcaggtatgcatttatctcatgagttctgtgtgtcctctgtccaaaaagaattttcttttgggcatattgtgagggaggtacgtggttagtaataaaatgggaaacaggtttgc

SEQ ID NO: 144598 - DNA, 164 bp, Homo sapiens
cacaaatacatggaaattaaacaacatactcctgaacaaccaattggccaataaaattaaaagagaaattaaggacatttcttgagacaaatgaaaatggaaatacaacatactaagacctatgggatacagcaaaagcagctataagaggaagatttatagca

SEQ ID NO: 144599 - DNA, 213 bp, Homo sapiens
cacagtcccagcccataatcccaacttatctgagcattggccaagtccaaatttccctttcaaagatagattcaaatccggtctcgattagggatggtagccagaccctgccgcctgaagatggaatcagctagccagtagacgtgttacataaatgccaccaaaacctgaaggctcagtggggcgtggtggctcatgcctgtaatcccagca

SEQ ID NO: 144600 - DNA, 307 bp, Homo sapiens
tataaacagaatgattaaatagaatagtcaatctagaaaaataaattagagaaaagatgatatacagcaggtgaaaggaaattaaaaatactaataagacaggtttcagatatcagtaatgacactatatataaatatcttttttttagtaattaggtcagatttttaaattatatttatatttttctctttattattaacttttaggttcaggggtacatatgcaggtttgtaatatagataaattgtgtgtcacgagggtctgatgtacagattattttatcacgcaggtaataagcatacccaa

SEQ ID NO: 144601 - DNA, 779 bp, Homo sapiens
acggagctgcagctggagtccagaagttcaggcagtgaaagggaggtgcgagcttgtaggaactagtttattagtccttttgatcaagctattgctcttttgttttttttgttgggggattactttagagggcaaatgtaagtcagatacaccttaaatatctgtcttgtcatttgagtaatgtatttaatggaacctaaggagttatgttggtctgttcctatttgacttttctacttgttaatagcatcaactaataaagagctaattgtcttgtaaagtttgtctttacaaattagctgcaattgaaatgagaacagcagtccagtgatgcttaatatttttctgctttattgctgataagcagtttggaaaatgtttttctatggagagcgtgtgaagcctcttctcagtgtggtaaatgtgatcacaatagatggtttttgtttttagttcttttttcactttggccttggaattaacatgaaaggtaaagatgttgagatttcctacctcaagcaatgctgtctaggtttatgagaagcagagaagcattttgtaaattatatcctgttgctcacaaactgtataattaacctacttaaagttcaaaatcatagatatctgcctgttgcatggggagtctggtaagattgcagtactcttatagatatcaatggcctatgtattgatttttaacaaataaattttattttctagctaaattaatcaaagatttaatgacctatgaatttgagttacatcggtgtgtatctgga

SEQ ID NO: 144602 - DNA, 714 bp, Homo sapiens
gccccatctacggcagcctcacagactgcatgcaaagagcagtcgagtgtgctggtctataaattacatcatgcggtaactgctctttttcacttataaatgtaccgattttatagttactaaatttagcccatttttaactcttcatttgaaatactgaagaaaagtagttccatttgccttggaggattccaggctatggtaccaaaaagcaggccatcagagtcagtactgacaaagactcatggatcagctgtggcatgacaccatggtgccacttgccgaatccatctgagccttagtttatttattcaccaatagagatcaaaatcagtatgaataattgctaacatttattgttcactgcctgtactaggcacagaattttatatgcaattattaacctgtttaatgctcacaacaagcccacgtctgttagtatcctcattttacagatgaaaggagattagatagcagtagagacccaaaccatcccccacaccacactatagactgcttcattgtctgtcatttgttgtattgccttctcatccaaatttgagctcttaataatataaatcagactcatcagaggaaatgtatcccagactttttgtgttcacattaaatatgtttatatgaatatagattattagccatttttattttcaaaccaaaactttttcagatcttacagccatgtgtctggtaagg

SEQ ID NO: 144603 - DNA, 685 bp, Homo sapiens
aaaggctgaacatttgagggtttcacgtcctaaatacataacgggggaattctagaaagacattttctatgaggctttactttgcatttataccccttcctccctcccctgtcgttggaatttaaacttacctaagcatagagaaatgtttcctttctggtttaagattttatttaggtatgggaacttgtgaaagtgttggaaatatagagtggaaagctttttgttttttttcgtggttttttttttggcctttaagactgtttaaaagaagtatttgtggctgacatagaatgattagcagtactgagaggggacaagaatctaggagacaaaaacaggtgcataagtagcttatgtgacaggtaacaggaacactgtcttatcttcctgtttaatgcagaattaagcaaaatgcggccggacactgtggctcacacttataatcccagcatttgggaaggctgaggcaggcagatcacttgagctcaggaattcgggactagcctggccaacatggcaaaactttgtctctactataatacaaaaagtagccaggcgtggtggcacatgcatgtaatcccagctactcaggaagctgaggcacaagaatggcttgagcctgggaggcggaggttgcagtgagccaagatcatgtcactgcactccagtaagactctgtctt

SEQ ID NO: 144604 - DNA, 329 bp, Homo sapiens
  misc_feature (38)..(38): n is a, c, g, or t
  misc_feature (42)..(42): n is a, c, g, or t
agcttgaccgcacgagcatggtggggacttgaggtggnattncccaggtgctcggaggcaaggatggcattcccctgtctccctggctcctaccagcctaaagtggcaggccagctggtggtgccctcaggcgaaggacatcccaatgtccatggcctcgtgtcagccccagttcagtcccaggttcaacttctagctccgtccccaccaaatcataccaggtcaagaatccagtcccgggttcaacttctagctctgtccccaccaaatcataccaggccaagaatccagtcccgggttcaacttctagctctgtccccaccaaatca

SEQ ID NO: 144605 - DNA, 166 bp, Homo sapiens
tagttattaatagaggctggattgtcaaatgccatacttggaacgtgatttgtctttctcttcccaattccgactctgggagttttctctgcccctaaatcctaaagacatactaaacatcaattgttatctccaaattacaataaaattgttatagtcagtataa

SEQ ID NO: 144606 - DNA, 1176 bp, Homo sapiens
tgaatgaagtggtatcaaaaagtgccctggcagtgaaaggcaagatagagttctgtagagtaggggtcgtggtgaccctgttggagcagatactgaagtagtggtgagtgcggagaggcaagtcacattttggccctagtcaactgtagctgaggagtaaacagagggaactgtttactgtttacaggattctgatgctcatctttgaaggctgggctctgctggaggactgattttgaatgatgtcaaatgattttgacaagattaaatggggagatttagttggtggtggcatgcaggactgatttgatgaaagagcagcacagttatgaatggtgaaaccgaaaggaagatttgtggggcttttaacagtctcctcaaggtgttgtggctgtgggagaagaattaacatgaatggagagtgtaaagaagcctatcagattgtctttgatctgcacagtactggggagtcccatgtgggacacgggtaggcagcagtctacaaagctcagagctggaaagacaacttgaaagaacaacacaatgaaaagttaccgtgcctctagttgagattttctaaacatcggaaccaatgtgaggtgtctgatttcataaacaagtggaatttaatctatactctctaagtggaaacaactctgtttgcaactctgacttgctagttccctggttttgcttttgttttacgtttggcattttttatttcttgcctgtttatggtagagactagaattctgcacagcagatgacaacagtttatcccctgctgcagacctggtccagttctgactgagtccaggggtgatagttaaggccagggcttgggtggtttgatgtccatcctaggagtttcacctctgcttcggtaattctcgggctgagggatactgatgagaccctctagaatgtttcttggtccatgttgaagttagagatttcttgctctgtcaagaagactgtcagcctgggcaaggtaacgcgacattatctctactggaaaaaaaaaagccaggtgtagtggcacacgcctgtagtcccagctacttgggaggctgaggcaggaggatctcttgagtcctggagatcaaggctgcagtgagctatgattgcaccactgcactccagcctgggtaacagagagagaaaccctgtctcaga

SEQ ID NO: 144607 - DNA, 201 bp, Homo sapiens
agagaccttttccccatgagtggagctaaaattcctgaatggaaaacattactttgaactattcccagttacgagagaattgttgaaagtatttccagccctcctcaccttcttcctgcatataagattttaattatttttttattcaaaggatgttaagtcacactcctttgtcttaagtacggctgtttttatttggta

SEQ ID NO: 144608 - DNA, 155 bp, Homo sapiens
cataaacaaagttagaagacagctgacaaactaggagaaaatattcacaacatataccacagtgagaaggcctaatatccctgctagtaaagaactcttaaaaatggagggacatgggaccaaaaatttgatagcaaaatgggagaagcatacga

SEQ ID NO: 144609 - DNA, 427 bp, Homo sapiens
gtaggagagagtttggatgggaagcaaagatgggtggcagaggaccaattggggggccactgttagtcgacaagaaaagctgaagacctggattggccagtggcactgggacccaaatgagtgggatagagaaaactatttacaggttaagaaaaacagggaagagcaacaaaaacatgtctaacaggaagtcagtgtggtcaacagtagaaccattgcttaaggcccagtgctctcctctggcagaagaatggatttacagtttgtcaacagtcacatagtttttgaatggactgtctcctgtcctagtgggtctttaatttgtggggaacaaaaaaccgtccttttaaaaactgaagagatttgactgaaggtttgaccaaacaggatcttaccgttgcatccataaggttaaacactattagca

SEQ ID NO: 144610 - DNA, 375 bp, Homo sapiens
ctgacctagaggatccccaggaccagtcttaaactctgacctcatagttttaaaaaaagtaaataaattttcaggaatattgttctttaaaaaaaaatagtctgttttatctcatgaggggaaggaaaattaattggaaaaggaaatatgtgttcagaaattggggtcaaccattcattaccgacagcagggtgttctggtcaaactcatatgcagaactggtagaaatatgctcagcttttctccgatgtttctgtgtgcttgagtgaagggaggggaaatactcacttttattacggcacacatgatttctaaagattatgtgggtagggaaacactagcctgcaagaatcaaagagattccttaagactggt

SEQ ID NO: 144611 - DNA, 343 bp, Homo sapiens
aacaaaggaatggcaactgacttctctgcagcaagcccagaagctaggtgccaatagagcagtggcttcagcatttccaggggaaatcacttccatgctagaaccctacacccagcctggctatcaatcatgttttaggtaaaataaatacgctttcagatgggcaagatccccctagaaatatttcctttgcaatatttttttcagaaacaattggaagatttgctctgcccaaagagtaaagcaaagaggaataaagatgcaggagcaggaaacggggcacccaatcgacaggggtgaaagaaccccttgggtcgacagtgaagaaagacgccaagatggg

SEQ ID NO: 144612 - DNA, 193 bp, Homo sapiens
ccgagatcgcgccaccgcattccagcctgggcgacagagcaagactccatctctaaaataaaataaaaaacaaaaagggggcaagatgtgctccctgtgggtcaagagtgtcccagacagcttttgggaagggtgacaggtgtgttgctctatttggccctggtcagactcatctggattgttgtattcagta

SEQ ID NO: 144613 - DNA, 190 bp, Homo sapiens
agacggggtttcactgttagccaggatgatctcgatctcctgacctcatgatccaactgcctctgcctccccaagtcctgggattacaggtgtgagccaccgcacctggccacaatttcttaaatcatgaaagtagaattttaggaaaagagtagatgtctggataataatctggatggattatatatac

SEQ ID NO: 144614 - DNA, 322 bp, Homo sapiens
ccttttgaatcattgaagagtagttttgactttttacctgcagatcttatttttcactattgtatccctagaatatccccacatcaagaactgtagtttctagttagtctagcaacatatatttagcagtcctcaattagacagtatttttgtaattaatatctagccttgcatctgtgatggaaggaaatcagctcactaagccagagcacagaagagtagaggagcctactctgttatagataatagaaccattgaaacgttatttgtcagttagggctggttaatagaaataaaagctcattttgttggtacatatgta

SEQ ID NO: 144615 - DNA, 382 bp, Homo sapiens
cggggagggatagcattaggagatatacctaatgtaaatgacgagttaatgggtgcagcacaccaacatggcgcatgtatacatatgtaacaaacctgcacattgtgcacatgtaccctagaacttaaagtataataaaaaatatacattatatatatatttttgctattaaaattaagtatttctcaataatttttattaaagtttaattaaaaaatgaaattattgatccacagaggactgattccatagatatggaactcaaggattcagagggctgactgtatgccattatggaatattttcctctgaagacaacaatatatttacacattttattttcagccataaataacaaatattaaataggaaatttaaaaaa

SEQ ID NO: 144616 - DNA, 373 bp, Homo sapiens
aagccaaatgtacacgagcccatctaaggggtatgaggcaactaaatcccatagagaatggaccctctgaagtcctgctccactactaaagctcaccacctggccaagctccagaaaaacatctggggaggagacgcaggaagctactgacaatgagttgggctctgacaccaaaccgaactagaagatggggtccatcagagggagtcttactgagtggggaggaggggtggtctggatttggagtccttaggagatgggagttgggagaaactgagggcctacatgctcctagaacagccactttatggggcaccacatgggggtctttcaaagcctgaaagggcagagtgccattgttgtttccccttga

SEQ ID NO: 144617 - DNA, 689 bp, Homo sapiens
gcacacagtaggtattcaggaaatgttaacaattcgagtaaccaatctttagaagttaggcaactccataatttaaaatattttgaatgggcattaaatgtaaattcagtgtttgaggcgtgtctagaagccttgattactatgataagtatttttcattacatatgaagaagtgtataaaagggtacattggtattccatccctttacctccaaaggagcaatgtctatgtttcgctctttactagatattctgtcatatctgcctgccagaccactccttctgcttctctgatgcaagttacacctgcatcttgcataccaagtgaggctgtccatcacctaactccacctcaccaggcacacaggttcggcatgtgatttggcctcatagtgcttgacccggcaccaatcagagagctttgtcagagatggatataggtgcagggactctttctaagattatggatgcttatagcctcacataactccagaactgtcagggccatcttggctttaattcgagaagagcttgactgagacaagagaaaggtgaaacaaatgattgcaaccaagggaaacaaaatgtcctggtgatatactttgaactgtgaatcaccccaatctgaaacattgctttggacatcatgagtaaataaatcctgacttaatgtatacaagtaagtttgt

SEQ ID NO: 144618 - DNA, 296 bp, Homo sapiens
ggaaaggcagcccggaaatcaagccgccatggggaaatccccagaactctgagaggctgaaggcaggcaaccccaacaaggctgctctgtccctgcaagaaataccaagtaccaaagacctagcacccaatgagaacgagaggaattttggtcttagttcctggcaggagtgtttagagcttgctttcttaaaatcccttggttaggcatggaatgaatcagcagtgtcaagaatgagctgtgttcgagtcaggaaagagcacatagggagtataccgtgtctaaagagaactaag

SEQ ID NO: 144619 - DNA, 243 bp, Homo sapiens
ctgggtctcttcttctcacttttggaataatttctgtcagacatcttctgtatggcttctcatttaggctcattccattctgtttctctgcccatttaactaatgagtataacaaaggcacaatattgagtcatatagatatccctttaaaagagctgaaagtggcagaaacaagtctgtgaatacttaccctggtctctttttgtcctatcaacttctgtttttttgttttgttttgttttg

SEQ ID NO: 144620 - DNA, 352 bp, Homo sapiens
taatactaattataatgtttcctgctatgttatcagtttgaatttatatgaatctttagacttgaggcttctttttcctagcatagtgatggtctgggctttttctcaatttttgccagagctcagctctcactaattagtttctttctgcatgagaaaaagattttgcttcatctttttccttataatagcagaacaaaaagaagaatcagctgcatccatgctaatttcccctgtgacatttccaaacaggatttgatttctctatgcatgcctctttccttctcttcatggtttttgaacatatacaaaagctcatttaaaccaattaaataaaattgtttttaatctc

SEQ ID NO: 144621 - DNA, 404 bp, Homo sapiens
actcaaatgggtggggtgagaatgctgggttggtttcatccccccatctctcaacctggtggctggacatcttacttggctcccagagccagtgtcccaagagaggccagtagaagctgtgtggcctttcctgacctagccaaagggatcacgcagcatcacttctatggtggtagccaccaaaggctgcccgggttcaaggggaaggtacggagataccccctccagatgggaagagtgtcaaagaatttgtggatgtttttcaggactgccacatacctgctaggggtgttggagttgacagttgattcgtgtgaagtgtgcttacagcatagggagaacttagtgaatgttagcacatctctgagctgggacctgagacatcgtctgcatcgaaagctaca

SEQ ID NO: 144622 - DNA, 147 bp, Homo sapiens
atggtagaatactgcttcctttttgcataaataattagtgaattacaagctgaagtaagtagcctttttctaatggttgcatcctcctgaaaaccttttttcccctgttacctaacagggctttttggcttttcatcacctttctaa

SEQ ID NO: 144623 - DNA, 256 bp, Homo sapiens
ggggcatgtgcagtgtggactgtgtgtgcgtgtgcatacgcacatacatttgtacgtttgtgggatactggtgggtgcacacgctttgtatgtgtggacgtacacgtgtctgtgtgtggggtgagtatgcacgtgtgtttacacatattccatacaaacacattccatacacacgcacacagacatattccataatcacacagacactccatacacatacacattccatacacacatcacacagacacattccgta

SEQ ID NO: 144624 - DNA, 811 bp, Homo sapiens
ggcacgcaccaccacgcccagctaatttttgtatttttagtagagatgggttttcaccatgttgatctcgatctctggacctcatgatccacccgccttggcctcccaaagtgctggaattgcaggtgtgagccactgcgcccggccccccatcatcctttttgactgttgactttggttttcccttccctcctctctaaatttctgtccttctgcttccttcctttttttgctttttgaattctatctttacctgtcttttgttcactttttaatgctgtatatgggcaggggtgagagacattagtgagcaacttggtgagcaagcctggctttaaagacttgagaagaacttctagcaccagagctctgtcttcctccagttctcaacacggtgttgctctttagtcataccaggatctgaatcaaaaaagtatttttaaatatccctgacttctccctgtattgaggctggccctgatcatgctttttagtgcccctcaccaggtctcccaagtgcacttatccagctcaactctcagatgtgttttaacgagaccctatattcagggaagttgtgtggacactgcagtggagagaattgataataggcctatcagtctcacaatatcacccctctacctttaacattccatctagctgtagagtccatctgtttgtccatctgctgaaatgagaaaagaaaacctcatgcactgatttaaaacaaaccaaaaaaagaaaaaaaacaaaaatccctcctttctaactgaacaaaaatgtgcagttaatagttggcccttgaaaatgc

SEQ ID NO: 144625 - DNA, 445 bp, Homo sapiens
actgcaaaggtgaacttttcctagtttttagcacacattcccatcccctgaagactgtctcactggcaaaaaacctaaatcttcagtagctttatggccaatttagtgtgactcagttataagttccaattctatcattgtacgagaccttgtggggaggggtgctgtgagtgctggctttccacagctggactgatacatgacttcaggtctgattattccataaagcagcatgtaagctttatcttttttatttaacggaaatctttattcagataatgacagatttgcataatagtaaaaatagcaaagcaatcccagtgtctttatttccacagtttcctccaatggcaacggtttgcgaaactacacaacagtgtctcagctggggtactgacatggcagcgcacccgtctttttcacatggcccagtttactcgtaact

SEQ ID NO: 144626 - DNA, 318 bp, Homo sapiens
gatggggtttcaccatgttggccaggctggtctcgaactcctgacctcaagtgatccacccacctcagcctcccaaagtgctgagattacaggagtgagccaccatgcccagccccactaagcattaaacttctttgagtttcttaaggcagtagaggaagagacagtatttaaagatgggggaggatggcaggtcggattgccgagccccttcctcctccctggtcctaagtgacagcggggagagctgtaagccgaggaagaagggccgtccatcctgcggcactcagcagagcgtgtactgaatttgatgggaaa

SEQ ID NO: 144627 - DNA, 333 bp, Homo sapiens
gatggggtttcaccatgttggccaggctggtctcgaactcctgacctcaagtgatccacccacctcagcctcccaaagtgctgagattacaggagtgagccaccatgcccagccccactaagcattaaacttctttgagtttcttaaggcagtagaggaagagacagtatttaaagatgggggaggatggcaggtcggattgccgagccccttcctcctccctggtcctaagtgacagcggggagagctgtaagccgaggaagaagggccgtccatcctgcggcactcagcagaggtaagcgggcactccccatcctttcccttagtcactgc

SEQ ID NO: 144628 - DNA, 390 bp, Homo sapiens
gtgatgattcctccccctcagggctacttagggaacaaatgtgacagcatatggaagtggctggcccctagcagttacttaaagatttatgtactccactctccagatccaccctctgtgtgtcatcattattccttgtaaatttgtttggacttgaatgttcatacaacaactttttataaaaatggatggatcataggtcatctacttgtgcagttatttggatatttgtctccttcactagattataaactcacaaggacaggagttctttctgttttgcctgctagcataaatagtgaggagcactagccataatatgtgctccattgatactggttacaggaaaaaaataaggcttttttttttttttcttgagatggagtctcg

SEQ ID NO: 144629 - DNA, 341 bp, Homo sapiens
tgagacaagagtcttgctcggtcgcccaggctggagtgcagtggcgcgatctcggctcactgcaacctctccctcccgggttcaagagattctcctgtctcggcctcccgaggagctgggactacaggcgcccgccaccaagcccggccaatttttgtatttttagtagagacggggtttcaccgtattggtcgggctggtctcgaactcctgacctcacgtgatccgcccacctcggcctcccaaagtgctggggtaacaggcgtgagccaccgcgcccggcctgaattctgatttataatgccaaactgccctctagaaaaacagattatccccagcac

SEQ ID NO: 144630 - DNA, 321 bp, Homo sapiens
ccagaggcaccaaggaggccagaggcaccaaggaggccagaggcaccccagaggcaccaaggaggccgaggcaggcggatctcctgagctcaggagttcgagaccaccctgggcaacatggtgaaaccccgtctctactgaaaaaaaaattagctgggtgggtggtccccactattgtcgagaccctggacacaagcaggatgaggtggtgggtgagggtgtagatgaggtcaccgtggaacactgttgtgcctgagctggacacggctcataaagggggagccagccatccctcccagagctcacctcccgggaagttag

SEQ ID NO: 144631 - DNA, 401 bp, Homo sapiens
aatcctttttccataggtaagctatctttctcaatgatacattgtaagatgtagggtgaatgatagaagtccatggtatttactcttttgttatattttgatgcctatttttcttaaaatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgt

SEQ ID NO: 144632 - DNA, 424 bp, Homo sapiens
cttgtgaatactgtgtggacatgtgtgtacgtgttagggcaggggtgacagcagtgacgtgaaaggagccgtgttcttctaaaagttggctaaattaagagtctaggttggaaacaagttgagcatgaactgagttcaagcttcatggggtatttggggagggagatgtacccagacatccccctacgtgggttctgcagggtatcatgtacctggggttctgatcctgccttttcttttaaggtagcatcccagcccacagagagctgcacactgctgggctgtgcagtacaaaaacaccatggagaatgaggaattgaattatgcctggggccactgttccccgcttcttttctaagaatgcacctgggagagagctctttataatgccaggcagacttcactgcacagctgtccctggtca

SEQ ID NO: 144633 - DNA, 324 bp, Homo sapiens
atacagtgcccaactagaagaggctgagcacttccctcctgtcatttgtagactgatagtccagtcccatcattaccaggtctcacccactgccagaaggatggctcgtcctcagtcccatgaactcagctgtgctcatgagttaccaatgaggaagggatgaaaggagaaaataaaaattaatcttgtatccacaaaacataaaaactcacattaagtatcccatcatgattataaaatatcaccactcatcacctataggaggataaactaaggctagttaagggtaaatgatattgtgactgtcaggactagggcatttgt

SEQ ID NO: 144634 - DNA, 785 bp, Homo sapiens
ctttcctctcccttcctccctccctcccttttttctttctttctttcttgcttgcctgcctgccttccttccttccttccttccttttctttctctctctttctttccatccctccctcctctctctctctttctttctttccttttcttttcctttcttttcttttctttttccttccttccttcccttttctccttccttccttctcttctcttctcttttctttctctttctttttttgaaggagcaagagccaagaatatagagattcttttgtaaaacagtgatccttcctggtgcatttgctgtttaattatgataaacaacatgagatataagtttatagaaaaatatgagcaagtcactcaggtggtgccattctctattccctggctattaaataggactacaaaaaagctctatctccaatgcaagttttctcacaattggtagcagatgaggaggtcaaagaggagaaatcaacggctggttaggtcatgcacatttggtagcacagaccattgttaaaagcaaaaagcaacattatagtatctggtgcctgcttgggaaaatgaagagcaggacaaggtcatgtgtgttatcttgctgtcatcaagactactactccctcttttctctctttccctcccatcttaatgcttctctactttactcagctttcatggttaaactcaaattccacttcttccttgaaagctgccctcctgtctccatgtgaaagcatcctccctacaatatgactgtatgtttcttctggtactca

SEQ ID NO: 144635 - DNA, 417 bp, Homo sapiens
tggattaagccccacattttttttttactcatttgctgctttgtccaagtcaccaggttgctctagtctttatttcccttctttcataaaattagggagttgagctcgttcaagtcatttcacaaaccctttagtctgggctcagattttctatcctttgtcatcccctttctccgtttttttagcacctttagacatgtggtagtgaaagtcttcagaatcaaaatggagttactaatgttaaggaaacccagggaagctgtgtacagagccagggaaggctgtgaagagagtgttctcacacttgtatgcctgataatgaaagagactacaaagaccatatccttacacaaaggccatcaccaccttacacaaaatagtacttctgcaaggacatctgcccagcaactgcctgtt

SEQ ID NO: 144636 - DNA, 461 bp, Homo sapiens
gagcctggtatctgcagctcagtggcttgggttttaatcctgggtttgacacttaataaactgcatgatcttggaaaagacatgtaacctctctttcaatttccttatgtgtaagatgcttataatagtattcactttgtagatactattattgcaaggactaaaattatgaatatgtgctggcaaataccaaactttatattaatacaagtgtcatcagaatatgtacatatattaatagtaattgttaccaaaacaccaggggttcaatctgggtcctgctgctcactgcacagaaagccaatgcctgagacaacaagtgttgccaaggaagaaggctttaattgggtgctgcagccgaggagatgggagctcagtctcaaatccatctctctgactgaccaaaactggctatatagcagggaagaaatgtaatcatgtgtgggaaaacaggaactcag

SEQ ID NO: 144637 - DNA, 557 bp, Homo sapiens
actcactttggatggtgtgcaaaggaggcggcttcctgagccccaggtttggagactcagagccaggtagggttagtcggagacagcaccccctgttggctcaagggtaggacacagccaggccgatgcctcctcttctaatcttgaccacaggcagctctaggaagtctgatgggtctcctgccatgcccggaatgcatttaaggtggtttgtaccatgcatgaacttacaagcaatgctggcccactgccttgaggtctctgcaggactcttccagggcagtgaaagggaggggacctaggaaccgtgggagtcagatttgggattcgggcaagaagggaagtttcataatctgatggacccacagaagacctggctgttctgggagagatgcaggcccagatgatgacctttggaggtgccatgcctgaaaaactgatatgaagatgctctcccccaaataagtgactcagaatacaaataatacctaaactgtaaaacataaaacttgcatgtatgctgaaattaaaatagctcttaggttcttgttttgtgc

SEQ ID NO: 144638 - DNA, 614 bp, Homo sapiens
cttgtctgcatctttatggcttctcttccctccctggagctttatctctgaggcagccttgtctcttggtggggttcattttgcatgcatggaacttaacaggctccacaaaatctggagagaaactctggcttagttgagcccagagagtcacaaactacctgtagtctaatgggctgtgatggggaaaaaaggaacacagtacaaaattaggtaccaggactgttagtagaagccaggttctcttcgaaggggatgtaggtggggaggtcagtgacttgcatttttatacagatggtgattaatgaacatcagaaattgcataggaagagggccaggtgcagtggctcatgcctataatcccagcactttgggaggccaaggcaggtgggtgacttgaggtcaggagttcgagaccagcctggccaacgtgatgaaaccctgtttctgctaacagtacaaaaattagctgggtgtggtcccaggcgcctgtaatcccagctcctgggaaggctgaggcatgagaatcgcttgagcccaggagacagaggttgcagtgacccgagatcgcagtactgcactccagcctgggcgacagagcgagacgccatctc

SEQ ID NO: 144639 - DNA, 126 bp, Homo sapiens
ctttaagtttggcctaaaggtttctccttacacactgcactgtaacctaactagatgtgtaaacagactgtaacctactcttgtaccaatcatagagttttagcctgtcacaggctgtcaactgtt

SEQ ID NO: 144640 - DNA, 324 bp, Homo sapiens
ggtgggaggatcgcttgagcctgggagtttgaagctatagtgacccatgatagtgccactgcactcagcctgggtgacagagtgaaaccctgtctcaaaaaaacaaacaaaacaaaacaaaacaaaaacaacttccaaaacagaaagcagcaggcccaaatagattcacaggtgaattctaccaacatgtaaggaagaaattataccaattctctacaatcttttctagaatgtaaaagaagagagaataatttctaactcatcctacgaagccagtattactctaatataaaaaccaaaaacattacaagaaaggaaaactat

SEQ ID NO: 144641 - DNA, 1218 bp, Homo sapiens
gatctacatggaacatagttttgtaggataaattgaaacatcagcaaaagaaaatgtgaactttgatgaagcctccaggtgcctggatgccaaatagacaaatacagaatataagaaaacacaataagagtcattggccccgtgcctatttggcatcattgcaagaaacctggggtagtaatagtggacgtatttagagagtgaggcataagctcacctaaacagcctagaaaatgtttactatgagagtaagaaggaagaacacaagtggatatacgaggagtccttgcaatctggcccatcacgcaccctttgcatatctctacctacttgtgcataattcagcatccagcagaggaagacaaaatgttgcggacagttcctctaccagcagcatgcctcccccaggacaagcgcaaagtgaagactggtcgtcgcttcagtgaagaaagagatcctgaactttcaactgtttgccggaagtttggtacattaatattatatccaggggctaatataagaagctgctaatctggaagaatttatattagattctcctgtttatccttctacaatcatcgtcattgatggtacacggagccaggctaaggacattttctgtaagaattccttgttctgacacccccaaacaggtgcagttaaaaacgagcatttctagtcagtatgtaattcggatacagccaattaatagatgtctttctacactggagtgtgcacctgttgctctttccatcttggagaaaaataattacatacaagagactttgcttcgccctcttgaagctttatgctctttccagatttagcatggtgcccaaattggccccagcaagcaacgccttctgaaaaaatggattatatcctaaaccaatgccaaagaacaaacacaaactcaggaaaatggaactattaaagaatagtgttaaaatttagtacagttgttcttttggtgttagcttacctgtcttcatctaacaataccaacttaagttttcatatagtttaggtctgtaggtttttgacttgctaatgagaattgcatactaatcttgcccagaagaaggaagtaaaccaaatattcatagaaacaaacaaacgaatgaaaattcactggctcactgaaaaggaagatttcatactgtacttgtttttaaacatgtgcctctaataatacatgttttcaaacccaaatttaaa

SEQ ID NO: 144642 - DNA, 953 bp, Homo sapiens
gatctacatggaacatagttttgtaggataaattgaaacatcagcaaaagaaaatgtgaactttgatgaagcctccaggtgcctggatgccaaatagacaaatacagaatataagaaaacacaataagagtcattggccccgtgcctatttggcatcattgcaagaaacctggggtagtaatagtggacgtatttagagagtgaggcataagctcacctaaacagcctagaaaatgtttactatgagagtaagaaggaagaacacaagtggatatacgaggagtccttgcaatctggcccatcacgcaccctttgcatatctctacctacttgtgcataattcagcatccagcagaggaagacaaaatgttgcggacagttcctctaccagcagcatgcctcccccaggacaagcgcaaagtgaagactggtcgtcgcttcagtgaagaaagagatcctgaactttcaactgtttgccggaagtttggtacattaatattatatccaggggctaatataagaagctgctaatctggaagaatttatattagattctcctgtttatccttctacaatcatcgtcattgatggtacacggagccaggctaaggacattttctgtaagaattccttgttctgacacccccaaacaggtgcagttaaaaacgagcatttctagtcagtatgtaattcggatacagccaattaatagatgtctttctacactggagtgtgcacctgttgctctttccatcttggagaaaaataattacatacaagagactttgcttcgccctcttgaagctttatgctctttccagatttagcatggtgcccaaattggccccagcaagcaacgccttctgaaaaaatggattatatcctaaaccaatgccaaagaacaaacacaaactcaggaaaatggaactattaaagaatagtgttaaaattta

SEQ ID NO: 144643 - DNA, 200 bp, Homo sapiens
ccgcatgcactgcagatagggggcaggatgtccttgtcaccgtctcgaggtagctgggaaactgcccctgggagttgatggtgtcgtggctctagcagcagttggactatgatgtgcttcagtctcattttcttcttatttatccttcttcatgttcattgagcttccatggactatgaatttaccttttcagcaaattt

SEQ ID NO: 144644 - DNA, 1175 bp, Homo sapiens
  misc_feature (911)..(911): n is a, c, g, or t
agtggtggctcatgcctgtaatcctagcactttgggaggcctaggtgggaggatcacttgaggtcaggagttcaagaccagcctgatcaacatggtgaaaccccatctctactaaaaatacaaaaacgtagtggagtgtggtgatgggagcctgtaatcccagctacttgggacgctgaagcaggagaatcatttgaacccagaaggtgggggttgcagtgagctgagatagtgccactgcactccagcctgggcaacaaagcaagactctgcttccaaaaaaaaaaaaaaatccagttatgttcaatctatttttttatactattatagatagcaatgagaaaatttcttaaaataaagctaacatctacctctctcctccatttagatgtgcttctaggctaattccagctaattatctgaatacattaaaccagtaataatcagtattttcagtatttgtcagatttgatacaatcaacagagatctgcatttctttctcttatatgtcacctcctcatttacaaagagcacagagcgggccacagtttcaacggtatggtttttggcatctgagctatttaccttttatttatttatttttggtgcaaaagcaggctgagatagatcaccatgcagaaggacaagacacatagaaaagaggctcgtttccaagaccagtcaggtgctggctcccatttaaactccaagatgtaagaccagtcagaagctggttcccatttaaactccaagactcaaggagggtacaaaggctcaaaggaaaacagaaatgactttagcggcgtggagccagggaggacaatgggcacaaagaccaagcctggaaggtctgttttacaccatgggaactgggggcctttgccggtaaagggtttgcacccgtgaatcnaaatttctccggccggatttcccacttagaaagccgggttacacacttttagaggccctttcaacatccggtaaggtccctcggcgctttaaacacagtcgggaatctccgcgacacctcggtcacaaaacccactagggcttttcgtcacccgtgcgagagcctcctctcaagagctcgggtgggccacaatcaatttttatctagtgacccttttctccagcggtctgctaacaagggtttctacgctctgttctcccgtct

SEQ ID NO: 144645 - DNA, 1415 bp, Homo sapiens
agtggtggctcatgcctgtaatcctagcactttgggaggcctaggtgggaggatcacttgaggtcaggagttcaagaccagcctgatcaacatggtgaaaccccatctctactaaaaatacaaaaacgtagtggagtgtggtgatgggagcctgtaatcccagctacttgggacgctgaagcaggagaatcatttgaacccagaaggtgggggttgcagtgagctgagatagtgccactgcactccagcctgggcaacaaagcaagactctgcttccaaaaaaaaaaaaaaatccagttatgttcaatctatttttttatactattatagatagcaatgagaaaatttcttaaaataaagctaacatctacctctctcctccatttagatgtgcttctaggctaattccagctaattatctgaatacattaaaccagtaataatcagtattttcagtatttgtcagatttgatacaatcaacagagatctgcatttctttctcttatatgtcacctcctcatttacaaagagcacagagcgggccacagtttcaacggtatggtttttggcatctgagctatttaccttttatttatttatttttggtgcaaaagcaggctgagatagatcaccatgcagaaggacaagacacatagaaaagaggctcgtttccaagaccagtcaggtgctggctcccatttaaactccaagatgtaagaccagtcagaagctggttcccatttaaactccaagactcaaggagggtacaaaggctcaaaggaaaacagaaatgactttagggagctaaaaaaaaacctgtgtgcattgcaaggttagtgggtgatggagagtagggacaacaaaaaatgaagcaagggaggacaaatgggacagaagacacaggcctgggaggctttgttctcagagcaatgggaaatgagaggactatagcaggatagtggctctgccacctgggacatcacagctcttccagggcagtatttcctacttatagaagccaggctaccacactcttagcagtcacccattcacaaataccgagtaagggcccaccgtgccctctacacacacagtcagggaagatatccatgcagacgcctcgagatccacagaagccacagcaatggactctgccaggacggggtgggagaggacctggcctaggaaaggcatctaagatgtgctgggctccatagctaactcttttcactaagctgacaaccttttacttcacatccagcagaacttaaaaataatgtgttcttcagaaagagggagtcctggctggtccaaagggagtgaattatctcacctgactgttcacagccagttacagaccaaattccttgttctactctttctactttctcactatggcacccgactagtctta

SEQ ID NO: 144646 - DNA, 1170 bp, Homo sapiens
  misc_feature (1084)..(1084): n is a, c, g, or t
  misc_feature (1121)..(1121): n is a, c, g, or t
agtggtggctcatgcctgtaatcctagcactttgggaggcctaggtgggaggatcacttgaggtcaggagttcaagaccagcctgatcaacatggtgaaaccccatctctactaaaaatacaaaaacgtagtggagtgtggtgatgggagcctgtaatcccagctacttgggacgctgaagcaggagaatcatttgaacccagaaggtgggggttgcagtgagctgagatagtgccactgcactccagcctgggcaacaaagcaagactctgcttccaaaaaaaaaaaaaaatccagttatgttcaatctatttttttatactattatagatagcaatgagaaaatttcttaaaataaagctaacatctacctctctcctccatttagatgtgcttctaggctaattccagctaattatctgaatacattaaaccagtaataatcagtattttcagtatttgtcagatttgatacaatcaacagagatctgcatttctttctcttatatgtcacctcctcatttacaaagagcacagagcgggccacagtttcaacggtatggtttttggcatctgagctatttaccttttatttatttatttttggtgcaaaagcaggctgagatagatcaccatgcagaaggacaagacacatagaaaagaggctcgtttccaagaccagtcaggtgctggctcccatttaaactccaagatgtaagaccagtcagaagctggttcccatttaaactccaagactcaaggagggtacaaaggctcaaaggaaaacagaaatgactttagggagctaaaaaaaaacctgtgtgcattgcaaggttagtgggtgatggagagtagggacaacaaaaaatgaagcaagggaggacaaatgggacagaagacacaggcctgggaggctttgttctcagagcaatgggaaatgagaggactatagcaggatagtggctctgccacctgggacatcacagctcttccagggcagtatttcctacttatagaagccaggctaccacactcttagcagtcacccattcacaggaaggcatccaaacgctgatggggaggntggaagaagtagtgtcttactgaagaaggagaagtantaccccaaaatgtctccccctatctctcaaatcatttgtatcactgaca

SEQ ID NO: 144647 - DNA, 509 bp, Homo sapiens
tcggtcccgtgttcgggttgtatcgtgttgggggtgggggctctaaccaggaccaggtgcagcatgatagcttctggggaaaggagctgactctccttgtgtggcagaattaacacttacggaagagttaggaggcaggtgtcagcctaatagaaatgagaactgtgtactatgtagcattatctggttgccattgatagctggccttcattgagcacaacccagctttaggcattgtggaacgtgctctgtgcattctcatttatcctcacacccaccccataggcttcagtgctgtggtcctcactggacaaatgaagcagagattcaagtttggtaacttggtgcagcgtgtcatatgtggtgaatggcagagctaaaactagaactagaactggaactaacccagagcccctcttaacaactatctgctactctcagaagtgttgaacaagggcagactaccaccttccacagccactgcagaaagatgcctgctttaggggagt

SEQ ID NO: 144648 - DNA, 470 bp, Homo sapiens
caagtttccctgtctatataaaagcataaaacacaagcaaacattcctgaaatatggaaacatgcagacattatatgttctcacttgatgcagatatgagacctctctctggaaaaaggctcacaaaactttagcatatcttgcttaagaaaaatagtccgcagtcacaggctgcaaaggaaaagcctatatacagcaatgtcagaggaatctcagacctcaggtaggggagtttcttagtgtcagattcacctgaatcatccctcttacaaacaagtattactgtgcaatttcttgactgtttttccacttatgatccaagtggtaccaacaatgcactgtgttaggctaatgagagaaccttttaagccaagtgaagctaaaagatataacatgctcttcaaatgaagagagaaaaatgtaatgaaaggactgcaaaaagtagcatatgcatgccaaactcaaaagaa

SEQ ID NO: 144649 - DNA, 413 bp, Homo sapiens
ttgagagccgctactctaggctaggatgagaaactccaccaggggcctctctgcctacaccctccttgggaccagtccataggcacagcaagaatgacaggcatgtggcctggccctcctggggaatccagggtagaccctctgggtgacagcttctccatacaggatcctaacccataagcatgtgctagaattccgcgtgcctggaagggctgtcagtccccacggctgggttcttgcacatgcctccctcattctgcagaaaactggagccccacctgcgtgtccctgcccccaagggccctgccggtttcctgtgacccagcagtgacagtggccctaagggcgagtgcccaggtcccctgcataccaggaggtcactttgcagcatgaggaggtctgcagactccagt

SEQ ID NO: 144650 - DNA, 164 bp, Homo sapiens
aatatgagtcagattatctcactccccacagtcctccagcggcttcccgtttctctcagggtaaaggcaaagtgcaaagtgcaggcagtccctgtagggcccccatcatctctgctcttagctgcttaccacacatctctccaacaccctcctcactcactcca

SEQ ID NO: 144651 - DNA, 624 bp, Homo sapiens
attggttatgtgtgatttctatgtgtgctctaggtatttgccctatagctgctcctaaatgtggggtcttagaaaacatcttggcccttcaaagcatactctgctggttggctaaattgcagcaggaaaaaatatcagcagccctattgctatgtcacttgcctgcagagcaaaagttgtttcaggaacagtaatttgatttagtctatattaaaaatcataaatagtctacaaatacaaaaaataaagagtttgcagctatgttgagtgcattataggtgttttcaaatttctcctatgataaattaaaaatgtaacgttgggcattaatttcctaaacccaatgctcagcaatttcctcaaattgttgccagtttttccaagagacttcagaaccattccctggagtgaattatttccaatggtgaagagtaaggggtggatgggatgagattctaaaaaaaaaaaaaatcttgcttctatttcagaagtgtcactcttcagccccgtgaaggacacgaaaagctggctgagtagtgtggtctatggaggtgcaggggcttcagagttagggaagcatcaatcctgagtccaagccagctgcttggtagctgtgggatagtt

SEQ ID NO: 144652 - DNA, 525 bp, Homo sapiens
catactccagatgaaaacaacaagcctccgagagcttcctccattcagacatccagtagatattcacccagaatgtctattttttattcagggggcacagcttgaaaactgcttactgaatacaactaactatagccagggaaaatgtactaaaagcaacacaaagctaataaaaagtggcattgtttgccggtacatctgaacacaatcacaattcaaataatccccagaagaacatttcccattctaggaggcaggatgtttatggagatgtgatctcatagcagtacaaaagaaaggaggaaacacacaaacactatttttcagtattaaaaagaatatacaaagcactcactgggaaactaggttttctgacactctggtggctcctgggttttgtcaaagcaaattgaacagtttttctttgattgggtttgtctctgagtcccatctgccatcccttcctcctcccccccgtaaaaccacttagttttggctgcatttgactagatggggatggaagag

SEQ ID NO: 144653 - DNA, 443 bp, Homo sapiens
tgggctaggttgtacgtcaacaccttactggtagagaaactacaatgtttaggacactgctagataacctcacattattaaaatcctacatattctatctgaggtttaattatgttttattctaatgtccaaaataaaatgcatttaagcaaatattttaattaataggtaacatattgcctagaaaaactagtagcacataataaggtagtcataaaggttgaacaagtttgtaaaacagtgttttctaaactataagcagtgagtgggcttggtggctctataatctcagctcttcgggaggctgaggcagaagcatcacttcaggccaggagttcgagaactgcctgggcaacatagcgagaacccctctctacaaaaacaaattaaaaagctagccaagatggtggcatgaacctgtagtctcagttactcaggaggct

SEQ ID NO: 144654 - DNA, 362 bp, Homo sapiens
agctacctcaggctcaggatgggggacacttccccttaagcaatgagaaggagagaggctgacttggagagaacagggagtcagggagcttgggctggattgttattccccaagaagagttgcaactggactttcgcttcagtaatgtttaaaagaaaaatgctaatctagatagggactgccattcattcattcattcattcatttatattcctcttaacaacttgtgactttgggcatgtggcttaacttctcggttcctcagtttcctgtttacaaaataatgatggtaataatagtacctatctcacaagatgtggagaggattaatggagatgataggtgcaaagtgcttagaatac

SEQ ID NO: 144655 - DNA, 486 bp, Homo sapiens
  misc_feature (410)..(410): n is a, c, g, or t
gaagtcttccctgtgtgtatcaatggttggttcagaaattctcatcttgcatgcatctttgtgtgtttgttgatgagaaaatcttgttaaaataaaaatgtggccgggcggggtggctcatgtctgtcatcccagcactttgggattacaggcatgagtcaccatgcccagccttaagatagttttgatgattgtcaagattttcaagcaaggctaggcccaaaactacggagaaaccctcaatccatctggtctccatttgcatgtaggactgagagatctcagtaaccagcacctttcctctcctggatcaggcaaagaatcgcacgtgccagccacatcctccatatggctttctcaggctctgttctgcaattagaagataatcacatgcaaatacctcttgcagngtgtcacgagaaaggaaaccgttcctcctctggagaacgtgcccatcttgcgtcacacgcaaaaaagatgtctttg

SEQ ID NO: 144656 - DNA, 164 bp, Homo sapiens
tgaagaggcttggaagatgcaaaatcatcacctccaaacagctgagacacacatgacttggctttaaccgtgactgcccaatgccagagcactggactcaggtttaacatgggcagcccccatgtcaccctccacatcagctctcctcctacattgatggtcgg

SEQ ID NO: 144657 - DNA, 710 bp, Homo sapiens
ctggttactttgtgtgaacatccaagccacccttgttgggaagctagatgagtctaaaactgagacactggtgttctaggatccatctttcttttctgctctcggcctggaaattggtcttttataatgtagcaccttgtcaaatttactttcagttctgtatttcctttttacttctgtctaaatggaaacagatggcaacataatgtttaaatgcagtctttttccttatctctttttttttgtggtagtggtgataaaaatacatgtaaaatttaccattttaaccatttataaatgtacagttcaccttatctgtttttaataactctctcctaattgtccctgatatttttctctttttaatttttttctagtctaaaaaacttaagaggctgggtgcggtggctcacacctgtaatcccagccctttgggaggcctaggcgggtggatctgaggtccacctgtggatctgatgaaaccccatctctactaaaaatacaaaaaattagctgggcatggtggcgcatgcctgtaatcccagctacttgggaggctgaggcacaagaattgcttcaaccctggaggcggaggtggcagtgaaccaggattggatcatgccactgtactccagcctgggcgagtatcggcactgggggagtgaggggtcaactgcgggagtgtaaggtcagcacactacctctgcctc

SEQ ID NO: 144658 - DNA, 138 bp, Homo sapiens
taccgaggccgtaagtgccaaataggtcttcgctgtagggggtgtggttttaagttcctgaatccagttttggttccttgctagagtgattaatcggtgtttgagggagtgcaattgtctggtgtgtatgattcccag

SEQ ID NO: 144659 - DNA, 435 bp, Homo sapiens
gtaatacatattttcaacatttttatctaaaatatgaaggtatcttgaataatgtcttttgcagacttgtatgtttgcccactgcttgaataccagcatttcaagttagtgataacataattttaataataacttcatgtttttagtcaaattttaagatgtgtcatatctataatatagtgggtgatttaaaaatagatttatgtatttatgtttatcttaaagtttaaaatgttaccatctacctctgtatctttgatagagttagcagatagcttatgtggttttttgcagtttaaaaaatgttttttgtattaagttttaccttgatgaaggtatgctgttatgcatggtagcatgaactaagatgaatttgacttgggtctgtcctgatgaaatgtgcagtctaataggaaaggtaagcatttgcataag

SEQ ID NO: 144660 - DNA, 120 bp, Homo sapiens
taagctgcttaactctcctttggggaggagtgcagagatacagtgtcaacccgagacagaaatatcacaggaggtgtcactccatagttaggtacaagacagaatgggggacacgggaga

SEQ ID NO: 144661 - DNA, 202 bp, Homo sapiens
aacaccagagttaaaaataacagcagaaaacccgaatacccagaagtcgcttttcccaactctatcccatagcaccaacccaacctgcatgcccccatcatcataaagccacaatgtgactcggtttctcttgtctgtgaaatggggagatcttcccccatcaagtaaggcagtggtctgtgtgtttgtgtaggaagggagt

SEQ ID NO: 144662 - DNA, 331 bp, Homo sapiens
tggtgtggggaggttctattgcaaattcaatggtttttttcatagctggataataaagttcagttgttaaacacatgaggcagattaactttataggtcttgggttacaaggatcataatggaagacactcaaattacagctgatggagatgaatcatttattaatctgggggtgcgggttgtcatggctctgcttactataaggcctatttttaaggatacgagccttgagattacctacatttctaaaacaggttcctgctctgagtctactacctaaagaggaaagaatgtttacaaaacaattcaaaatacttctttaaaaacttca

SEQ ID NO: 144663 - DNA, 382 bp, Homo sapiens
tggtctcaaactcctgccctcaagtgatctgcccactttggcctcccagagtgctgggattataggcatgagccaccatgcccagccttaaagacatttctttgccttccaaatttgattggcctctcttcattggcttgaccggtgtccctcgctcccggcttcttccgttagccagccacctttggggatccccctgggtctgagagtggacagctgagctttctttgtcatgtggtcatcacgggagcttgaggaacctgcttctgcatcagagactgatggggccaagtgcttcccccacactgccttgaacgtggcatgcagttgggctgcatttgaccccctcctccatcttctttctccacttgggattctagag

SEQ ID NO: 144664 - DNA, 536 bp, Homo sapiens
tgaagatctgatctgaattagctgccaacattccttattaacagccaggtttctaggtctgcctgaggctgctctagcccacaggagacaccctacatggcatcaggcagtggcgcaacagggctggggcacatgctgacagccacactgtccctgctgccctggcacggtggcagagtgccagggacatgattatgctttcatttgtcctgcagcaaacccaagggggaaaccatgggcacattcacgtttctactaaaaacagacaccaaggatacaaatctttcaaggaaaatgggtgaaaacatttaggtaaagaacgctcctaagtatctgtcatcaggctgccctgtgaggactgtgatgaagtaagcacagtttccctcacatggccacacacttcaccctgaccagcccatcaggggctctcagctccacgtcagtttagcggagaccaagagctggggagaattgaagagcccagcaaggtcactgacctgctgataaagctgctcaactccaaccgtgggggtttg

SEQ ID NO: 144665 - DNA, 226 bp, Homo sapiens
ggatttgctggtgcagtacaactaggcttaatagggactcgaattcgaggctcgaattcgagtatcatgaagcctgttacaattccaacaccaacctctttcccaattcatactttgaggaataatgtgaattcaaaggggtccacaacaaaaacaaaaacttcccaactcttcaataaaacctactacatatacaaaaaaaatggaaggggccagagaagtcatc

SEQ ID NO: 144666 - DNA, 352 bp, Homo sapiens
ctgcaacgtccgcctcccaggttcgagcgattctcctgtctcagcctcctgagtagctggtattacaagcgcacgccaccacacccgactaatttttgtatttgtagtagggatggggtttcaccatgttggccaggttggtctcgaactcctgacctcagacctcaggtgatctgcccgcctcggcctcccaaagtgctggtattacaggtgtgagccactgtgcccggcgtgacattttttaataaaaggcagtgcttgcacagccctttgtatgagcttggtagtctgctaagggctttacctggatatattaccttgtgtgcccccaggaacctttcgtggtgggttc

SEQ ID NO: 144667 - DNA, 648 bp, Homo sapiens
tggcttccttgaaggcactattgagggaaccaggggaggccagagtgcctgggatgtcttcagcatggtgagcagctcacggtgggcactccaataagatggaagatcaccgttagcagccccagcaggggccatagtggcaatgagagttttttttttctttcttttttttttttgagatgaagtctgtctctgttgcccaggctggagtgcagtggcgcaatctcggctcattgcaacctccgcctcccaggttcaagcgattctcctgcctcagcttccctagtagctgggattacaggtgtgtgccaccacgcccagctaatttttttgtatttttagtagtgacagggtttcaccgtgttggccaggctggtcttgaactcctgacctctggtgatccacccgcctcggcctcccaaagtgctgggattgcaggcgtgagccaccacgcccggccaataatagtaattttaagattagtggtcagtgctgtatcccattcagagccccatcgtccagctggcatttcagtgcctctctcgagttgttgacctcagatgcaaatttgagccaggaggtgggccagggttctgtttgaggcaggcttctcccacagtggggactgctgctgggaaggactggaac

SEQ ID NO: 144668 - DNA, 220 bp, Homo sapiens
taaactatttactcatgcctcagatgctgaagtaccttcctagagatacactcctccagttgataatccctgctgcagccagccacattattcacagaggaaccacgccaatggtaatgttcctcaggtatggagagcaaaaaaagaggttaactacggttagaacccccaaattttaaacctgaccttactttttaaaaaacacaagtatagagatctg

SEQ ID NO: 144669 - DNA, 272 bp, Homo sapiens
cagctcccgtgtggcctgcacgttcccctgagttccctttgcggccttggcagtttaagagcagcctcagctcctgggctggcctcagccgcccgccccgtgttccctcagggccaggctgagctgtgctctggtggcggtgaggtcttggagaccatgcggtggggctctctgctgggccgcatagcatccacttgtccctctgtctcagccaccacctggtccacaaagtcaccaccacccctctgcagttgacaagcatcttacgggtg

SEQ ID NO: 144670 - DNA, 1070 bp, Homo sapiens
atgagggggagaggaagaagcaagggtgggcagcgggtgggacacacatcagtttggtgtgggtcttaccaggcccagtctgatttgccacaaccaccaccctcctcctaagtggccatgaactgtcgcctgagctctttctccactcctgctggcacttggggcaggttggggctcctcaccaggatcctggagggagaacgggaatatctgtggcagcaccattggcagtcacctgcagttcattgggacagttctccccactccccacctttcagaaacaggcttcatggctccagacgagagagcttgcagatacaaggatgccaccaactcacagtcagagcccatctggggacaccaggaccgacctctgaagcagccccatacagtggacagcgttctggagtctgccaggcctccttctgaatcccggcactgcgcctcctaactgtgatcatgagcaagttgcccaacctctctgagcttcagtttcctcatctatggaatgggtctaacactcacctaacaagacaactgtgatatttacatcaaaggagctgataggtgttaaacaccaagtgcttgccagacacagcggtgtgcatttcctcccatggccttcgccacgctcattaggccctcagacatggctaccatgttctagtgggcaaaggcacttcgctctgggccctcaatccccagactctcagggaaaagaccaggcctggtcctctatggtcccttcctctttcctctacaagctcagacatgcaaagcggagcatgtggctacttggagaggaacttctcagctcgacttctgaagaaaatgccaacatgccattcaatgactaatctcaacagcaccagcaacattgcctcccctttctcgacatttccctccctgaccaaagtggtcacaactgaaggagcaccaatcccacttctctctttgattacctcaaatcctgtctttgtacaaaaatgtaaaacaacatggttcttcccaaaagcagaagtctcccagtctctgaggaacagagaaaagcagtgcctaggcatagggtg

SEQ ID NO: 144671 - DNA, 213 bp, Homo sapiens
tcctgctcagccttcccttcatccctcttggtgcctgctctccctgttccctttcccttcctttcacccttctgacttctcccctcccatgccctcttgcaatcaggtctcccaaagcacccctgcccttcaaaaaagagcttcatggcagatggttcacagtaaggatggtaaggccattctagcctatggcaaagggcaatctttccagag

SEQ ID NO: 144672 - DNA, 1058 bp, Homo sapiens
cagaaagggggaggccccacatctgagtgaaaactgcccaaattcctggttgactattaaactctaaatgtatagtgaaatcccagggagcccagcaagacaaaaacaaaaataaaaaccagccaaccaatgaaacaaagcaagcaggcagaggctagagaggaatctacccttaaaagacagacctatactagatgagatctgtgaggttcatgctttttaaaacagtatatccctaaactgtgagcagcgaacagtggaaagctgaagccttactggcttggggttcagaggaaagaccctaatattgcccaagcagctgaaaacttaggaggaaatcacaagaacacaaaagtcacagagtgtgagcccctaaatctgagtatgatcagcctaaatccctggctgtctgccagattacacagaagcatgggagaccccagggagctaggctagacgttgtaagagctgagcagagatagcagctgcttcatacgacaggagagacagttcgcagtttgaatccaggcaagttaactgcctactagaatataaaaagagaaagttctcagaagaacacagtagaatccagagttgctataacatcttatctacaatgccaagttttcaatctacaattactagacatgtaaataaaatggaaagtctaactcatactcaggaagaaaagcagtcagtagagactgactctgagcatctaagtgggtacagtgttggattttgcaggcagactgcaaagccactgtgctatgatcaaagaattaaaggaaaaataagtgaacagatagagaaattgtaacaaagaaatggaaagtgaaaaaatggaagttgtagagctcaaataagtaatagctgaaataaaaactcactggaggccgggtgcagtggcttacacctataatcccacaactttgggaggtcaaggcagcaggatcacttgagctcaggagtttgagaccagcccgggcaacatagtgagaccccacctctacaaagcaattttaaaatgagccaggcatgatggtatgtgcctgtag

SEQ ID NO: 144673 - DNA, 670 bp, Homo sapiens
aagggtgagggggtgagaggaggggtagaaacgcaggagcgacagcacttgtcctgagtgggggagaggtggggacagacagggcttcacagagcactggcattaatcacgttgatgactgattatgtgatgtggacacatggaaattcacattctgacgaatctctaactgtacaagttgtagagacaggatgcacatttcacaaaataaaataaaagcactatcaattaaaagatcaatgtaaaagatctttggcgtagccactgctgtgcgggttccacctggacaattcttagcactgaaactagcctgaattaacagctgggaggcagtgcaagaggggcggactggaaagacatgagaccaaacgaaatggcaaagaaaggagatgaatggtagggtgaggaagaggagggactgaagtgacagcaaataaaatttaacctccagtcctcccacgctcgctctggcctgctccggccacccgcaggaccctgaagcccaatgagacagctcagatacttctgtgtgacaaccgcaccagccaggtcatctactaaacacaaagtaacagagagcatcttaaacatgacctgtcatatccaggggactgtatgacaaaggtaagatagttgatttctgctcttggaagcttaccatttattcaag

SEQ ID NO: 144674 - DNA, 376 bp, Homo sapiens
cagtggcgcactccagcctgggtgatagagcgagtctctgtctcgaaatgaaatgacatggcatgacatgacatgacatgacatgatgaaatgaaataatgaaatgaataatgaaatgctgggtgtggtggtgcactccagcttgcgcggtagagtgagtcttcatctctaaatgaaataaaatgaaatgatgaaatgaataatgaaatgccaggtgcggtggcgcactccagcttgggcaatagagcaagtctcttgtctcgaaatgaaatgaagtaaatgaataatgaaatgccgggaggcggagcttgcagtgagccgagatcgcgccactgcactccagtctgggcgacagagcgagactccgtctcaaaaa

SEQ ID NO: 144675 - DNA, 601 bp, Homo sapiens
atgcaaaggtctacttgacatctccatggggtgttaagatgtgccttcacacatagcaggtctaaaatcacgttctgccgttcctctacctaccttagggtattaacctacccaaatcccctgatcccaccacgttctgtactcaccgtcgtgaaatacaactctcttgcactagttgttcaggccccaaatcttttttttctcatcataccttacatccaatcgttgagcaaactcactggataggttctttaacataaatcctgagttgaaccatctcacaccaccacaactacaattatcctggcccaagctctcaccatctctcattttgtctattgctacagtttctaactcttcccagccctcagaccatgagcctcttcccttgcttcatggggcaatgcctagaaggatcctcctaaccccaaaacccttcatgtctctcctctactcagattctcactcagaatgaaaactcacatccttttcacagctaataaagccccaggtgatctggttcctcagtccagctacagcttctcctcacctctgccttgctgagctcacctcctgccattttccccttcctcattctact

SEQ ID NO: 144676 - DNA, 386 bp, Homo sapiens
aggcataagatcttaatcaacacgttctagtccctgctcacacaactagtaccagaactgcaacttccattccctgagtttgccatgtctctctggctaattttataaaggtttatcaaactcttaggatgcggagtctaaactatttgacaatatcactttttagaccagacacatttgttactctgtggccatctcatattacatactttctaaaataaaagatttttttttctttgaagcatgatataattgttacatgaatgaaatagctgacaagtgggcagatgtaatgcctactctgagagtccccagagaggagtgaagggagagtgttgcaataaatcaccagctcagtggtgggtgcctatctaagtgtgctgaga

SEQ ID NO: 144677 - DNA, 267 bp, Homo sapiens
cccaaatgtacacaaaagaaataattccactatcataaaacaacgtctggtaacatgttttaaaatatttcctgtttgcttttttctaggcatgtacacatacatacatattttatagaaattggggccaggcacggtggctcacgcctataatcccagcactttgggaggctgacgtggacagatcacttgaggtcaggagttcgagaccagcctggccaacatggtgaaaccctgtctcttctaaaaatacaaaaattaaccagg

SEQ ID NO: 144678 - DNA, 454 bp, Homo sapiens
gagcagacatgccgcgcgctccgaggaagcgccggaaccaccagaagcacagggacgcgggtgccgagagtccccagcactgaaaacggggatctcctcttctgtaagggattttcttcccttgtcttaacccacttctgtagactcgagggacgccaggatggatatgggtctgggcgaggaggaggtggttgtgtatttcgggaagccccgttgtcaggcacgcgcaccccagtcctaggccaggctggtgcccttacctccggtgcgctcctttggcagcaagaaccgcgtggaggccaaggttgtagaaccaggcacgctccctgctgtctgtctgtgactctgtgcttgccctcagctgccctgtgtggttatgggtgatccctagggacgctgggtggtgtcagtgagtttctttgggggcttaaaacaaacaaacaagaagtacttt

SEQ ID NO: 144679 - DNA, 354 bp, Homo sapiens
agacataggaaaaggacagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagactggtcctg

SEQ ID NO: 144680 - DNA, 270 bp, Homo sapiens
catgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgt

SEQ ID NO: 144681 - DNA, 525 bp, Homo sapiens
tgtcatgtatattacatgcatgtagtatgacatctacaaaaccaaatttgctaagagaaacttatgctccatttaccttgattccttactagagaattttcaaatgtcaagtcaagcatggctggacatcaaagattgtaaacctttgggggactcactttaacatggaagagtggaagccattcatattattttagcattccagaacactcaactgactgaaagatttttttttaattgttgttctttgaaaggaaagatgaatgagcatatatcatttggggcagaattctccagaaactataatctacaaccactgcatttatctgaaattctgtcttttattttaaaggtcgtggctgtataattctgattttagcaagcagaaatatttttcaaaaatgcagcctaattttattgttcacctttaaatattcatttcacatttgatgggctaaaaatttgaaattcaaattacttccttttcctttattcttagcaaaatcatctaaaagtaagagttgc

SEQ ID NO: 144682 - DNA, 261 bp, Homo sapiens
aataaccgagctctctcgcccctcaggcaggatatctctgaggcatgtattctacgagactcctagagttgcccagcaagattcagctccagttacgtgcagaggtaactggctcgacaacacaccctttactggcctgcttccctttcctgtcttccttccctactcacatactattgtttcctcccaaatacaacaactacaccagaatcctcgtttcaggttctgcttttgacaaaacccatactgaggtacaagcca

SEQ ID NO: 144683 - DNA, 359 bp, Homo sapiens
aaaaaaccactgacaaacaaaatcacctcacacccattaggaggaccactacaaatatttttaaaaacatcaaatctgttgacgatgcaataaaagtgaaacccatgttaattgttggtggaaaacaaagatgcagccattattttagaaagttacaaatgctcctcatttataagtctatatccaaaatatgtaacaaaggccaggtgcagtggctcaagcctgtaatcctagcaatttgggagtccaaggggggcagatcaactgagatcaggagtttgagaccaacctgatcccttctctactaaaaatacaaaaaattagctgggcatcatggtgggaacttgtaaccccagcta

SEQ ID NO: 144684 - DNA, 174 bp, Homo sapiens
cacacaagacaagttctcctattactttttctccctctctcctgctccacccctcaccgccttacacacacacacacacacacacacacacacacgcgtgtgcgtgcaacaaacatcttaatgctatttttaacaaattgtctaaaaggaaaaggggctccagctctgtgatcc

SEQ ID NO: 144685 - DNA, 140 bp, Homo sapiens
ttcccagtgccaaaaaggttggggactgctgctctaaaatatgtaatttttgcttgtaagtagagtaagccattgactaaccaaaacattaagtgaattttttgctttttcctttgaataccaacttgttttgtttcaac

SEQ ID NO: 144686 - DNA, 212 bp, Homo sapiens
gggaattagctaatattctttaagtattatttctattcaattgtcttctttccttatgggactacaattacgtgtatgttaggtcatgtcactgtttccattcttttttccccttctcgtaagcctagagattttctagcaacctatcttcatgttcacttgtattttcactgtccagtatccagttatttctaattattgagtttttaatt

SEQ ID NO: 144687 - DNA, 353 bp, Homo sapiens
taagaatgggtttgcctttcagtagagctttatgttaaatgttgatgttgctcagtccttcccttggctctcttctcttctcactccatttgttttcatctgtacttaggcttgaaattagcacagttctcttctctgtgtcccttagcgcagatcctcactgtttctcagactctaaaatagtttgttaacatctgttcatttttttccccttccaaactgtctaccatttcatcagcagaatggatatccgagcctatcactgtctctgcagtgacccccagtgcctccaggactggaggaatgtgtcttgtggcatgtagcgtcctccagcttcattaagtccttgctgc

SEQ ID NO: 144688 - DNA, 215 bp, Homo sapiens
ttgaaattaatatgctgaaaagatatccacacccccatatttactgcagcattattctcaatagctcaatattgttcatcattagatgaatatttttaaaatgtgatgtatatatgcaataaaatattattcagctttaaaaacacaggaaattctgtcatttgcaacaacatggctgaacctagaggatattatgttaagttaaattcaccagg

SEQ ID NO: 144689 - DNA, 289 bp, Homo sapiens
aagccacatccagtgagatttgcgagaacaagaggaaatggccaagtttccgggaagcagggctgcggtgtgcagctgtgcattctgtggccctaaacaggcactttgtttttcatttgaaggtcatcatctccctttggcacatgtgcttcctctctttgtaaatgtgtaatattttaggctcaaattcctatcgaattttagtcttaatctaagtcggattatagaggtacatattgtcttactgttacattttactgatattcagtgtttgatatccccaaagtct

SEQ ID NO: 144690 - DNA, 364 bp, Homo sapiens
gcctggagtggaccctaactccctcccattcttctgcattccctctctgtattaggacctttttcgaggctcttctgtagtttccttcccagcctttcctgctccctaagacctgatggtttaatttgcccatactcttgtactacttaactgtgtccattagtcatacaagtacttctccttctacctttgcaagctcttaaagagccaagactgcatctcagtctagctcttggccttgcatctagcaggttgtttggaatggaggatacagaaaactagagatgcagtaacccagctcttctgattgtcctttgtagattgttacttcagtcatctttttcttctgagttttatgaattag

SEQ ID NO: 144691 - DNA, 143 bp, Homo sapiens
catatcatgtttacggtctatatcccaaagcagaatgtaaaccccgagagcaagaatactatttattttctttactgttgaatctccattgtctagaacagacctgacatgtagtaggtgctccacaaatatttaatacattt

SEQ ID NO: 144692 - DNA, 374 bp, Homo sapiens
agtaagtgatagaatcattctatacgtaactgaataaaaccaaatcaggggaagatagaatgggtgaaattatgtaaacttttcatttcattatgtaaattacgtaaagtttttgaactatgtataatcacatgcatgaggagacagaaaacaaccttgaaaaacatgtttcaagggtgactagactgacaccaggctatgttttaacattagcactaattgatttgatggattcaacaggctttttcttgttggatgtttctttatattctaattggtttatactttaatacataaaaaaatcttgtgaaaaggtgcaaagagagaatgacctttaagtagtaaatatctggattggaaataaaacaaatgaa

SEQ ID NO: 144693 - DNA, 174 bp, Homo sapiens
tatgtcagctacctgatttgctagctgtgtgtcttaggacatcagtctctgtgtgtctcagttttctcatctgtaaaataggaacaatagtacctagctcatgaaggattttttttttttaagtgggagaatagttagtgtttgtgaggggggcactgaagtgactgctgtaat

SEQ ID NO: 144694 - DNA, 391 bp, Homo sapiens
aaaggagtgaatggtgttcctgggccatttacaccaggggttaactctttattttcaggactgactttgtatacaggtaggctttgttttatagaaaaacttgtgtgcaggggtaatttctggataccaaactttatagaaaaacttgtgtgtaagggtaatttctggataccagcacctacagcactagaaaaaaatgtgctcacaggtaccctgccctttgcattgctttacaaagccaagaacatttgtatttggagatgcccctgacccctccttctgcaacttcagatttatgaatatcggatcttgtccaaggaaaaccacagcagtgtcagaggaggaggagaaggaacccttgctcagtttgtggcagttcttctgaggaaat

SEQ ID NO: 144695 - DNA, 1579 bp, Homo sapiens
  misc_feature (75)..(75): n is a, c, g, or t
  misc_feature (115)..(115): n is a, c, g, or t
  misc_feature (267)..(267): n is a, c, g, or t
  misc_feature (347)..(347): n is a, c, g, or t
  misc_feature (1398)..(1398): n is a, c, g, or t
gtctgcataagtatgtgtctatctgggagtgcatatatgtgtgcatgtgtgtgtgtgagattgtgcatgagctanagacaacgacaggcacttcctgggcaggaaggctgtatcncagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgntacaaaagtccccaggacggctttggcttcactctgcgccacttcatcgtgtacccacccgagtcggccgtgcactgcangcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccaggccactatggtgcctgagcccacctcagcactgcccagtgacccccggagtcctgctgcctggagtgacccggggctccgtgtgccacctgctgcccgtgcccacctggacaactcttccttggggatgagccagccccggcgcaggacccatgggcgacggtagcacagaccacacacatccgcgcagacaccacaaaaaggcccaaaaaagacccgccacaaaaccgcctgccacacacgaggaccacaccaaagaaaggaaaggaagcagacaaaagacgacaaaggaaagaaaagaaagacaaaaacaagaaccaccaccgaaaccgggcacaagaacacaggacaaaaacacgggaccaacaggagcccgacaaaaaccaagaaagaacggaaacaaccacaagggacagcaaacacccgacacgaagccagcgcaccaaccgacaacgactcacaagaagacgaaccaagcaacacaacgacaggaaccgaacaagaccacaagacaaaccaaaccgaaacaagacaccacaccagacacaaaccaaagcaacacggaaccaggacaaggaaccgggcagagcgacacaaggcgacgagggagacgcagacacgcgggcgcgccacagccggcgacagcgagccgcgagcngagaccagccagagaccaaggacgaggacggacgcagaccggcagagacgagagcacacgagaggaccagcgcagcacgagccacgccgacaggagacgacagaagaccgagaaggagagggaaaaagacgaggcagacgcgaagaccaaggggcgccaccgcaagagaccaggcggagct

SEQ ID NO: 144696 - DNA, 229 bp, Homo sapiens
aacttttatctcttgctattcttacgtaccttctgaaattgctgcataggtttgacaccaaagaaaaatggtggaaaaatattcacttttaagggtaagagaatacaaggggggagaaatggttaagaaagcccctaagtaaagcttatctggcttcctaaaacactttggagacaaagaccctgtaaactaataatatgtttacctataatatgtaagagagaaaagg

SEQ ID NO: 144697 - DNA, 114 bp, Homo sapiens
aaatgcattttaaaggggccagaaagagatttaaaacaataagtaaataagttgcattttgattacatccccaaagtcctgctctttcagtttccctttgagcagttaactact

SEQ ID NO: 144698 - DNA, 198 bp, Homo sapiens
ggctctgtcgcccaggctggagtacagtggtacaatctccactcgctgcagcttcaatttcctgagctcaggcagtccacccaactcagcgtcccgagtagctgggactaaaggtgtgcaccaccacacccggctattttttttttttttggtttttttttccctttggttgggtgggtggggttttgtggtttggtc

SEQ ID NO: 144699 - DNA, 357 bp, Homo sapiens
tagagtgcttaggagcctggtgacctgctgctgtgacttcctctccagagctggagctccaggggctgaggttccccttccctgggcagccccttcctcctaatccggctttccctgtgaggaagagcctcctggccttaagccacatccttagcagcttctgccgtggcccttcctccagccggggaccctggcagaatgcatgggcaggaggaggtgccttggccccaggacagccaggtgggcagtgaatggacgaaatcagtctgtgcaggagggaaacactaacactaaccctaaccctaaccctaaccctaacacattctcaaaacatttgattctaacttaaaacacaca

SEQ ID NO: 144700 - DNA, 352 bp, Homo sapiens
tgttcagaaagggttatcatgttcccagcagtcctcagcactgatttaccctgggccatactagggatcaactgttaacacccttaaatcattcttcgtcctgctgtttctcggccgaaccacgtccatgctgcagagagtaaagcgcctccaaagaatccccatcctacttgatcttccctgataaactcatgacaagccaccaccccatgaagaggccctctctcaccagtgccagccttcaatacactcactgcaaacaccatcccacgaggaggccctctctcaccagtgccagctttcaatacattcattgcaaccaccaccccatgaggaggtcctctctcaccag

SEQ ID NO: 144701 - DNA, 156 bp, Homo sapiens
tctcaaacctagtgtggtcaaaagtgagctaattaaaaaaaaaaaagtgagctaattattttctccaaaatctgattctctgtcagcttattctaatttagtatctaagaccaccttctctgctgggtgtggcagcttgctcctgtaattccagca

SEQ ID NO: 144702 - DNA, 292 bp, Homo sapiens
ccaccaggcccctcttccaacacttggggattacaatttgacatgagatttggtcatgattcaaattatatcagcattgtttgacagttttgttgttgtgaaacatcatagagtatacttacacaaacctagatggtatggcctactacacctactacagtgtgcctttacagtgtaaatggtttttttactacatttacagtgtaaatggttttttaaaatactacacctgtatagagcagctccattataatcttcttatgtgcagcccattgttgaccacaatgcctgt

SEQ ID NO: 144703 - DNA, 164 bp, Homo sapiens
tgctgggattacaggcatgagccactgcgcccagctgtagctttttatctgtgaaatgaaacatttccgttagcttctgggaaatagagaaactcagattcagcaggagccttaaaagcctaagctttcacattagtggatcatagttcacgtgttccttagtt

SEQ ID NO: 144704 - DNA, 285 bp, Homo sapiens
atgggagatggcaataggaattgaggggtgtcaacaaaattttgggagatgaaaatcagctggctgagtggtaaacgacttagcagcttagagaaagctgaatctaatcctgcagtagaagaagccaaaaatcaagcaagatgattcaagctaaacaacgctgtgaagacttaggaaccagaggcacctctgaatgccagggtagatgggagtgcaaaaaggaaaactggctgcaatcctgtataattaagaatcggaccagataccctccctcagacaagaaga

SEQ ID NO: 144705 - DNA, 697 bp, Homo sapiens
actggatatgagtcaccaatcatgttgttatccattatttggtgctgtagcattgaccgaacacgtttatatttttgtgtcatcaggaagggggagagtgttggtatcagaattatttaggtgtggtaacagtaatctgggtaattatttctaacttaatcacgagttctttctcttttcatatccctacttactgtgtgtatgattgggggtggggtgaaggtggggaaggtctggtgtaaggatctgaggatagatagaaattattgagccaggacaataatttagagagcataccctaggtagtttaggttaccactccttgttcagatattactgggatatgaatgttagtgatttatcttctattgttcttaaaattttttcctcatcttaaaatttaaaggactggaacttctccagagtttgaagtctagttcagtatgccgcatttactcagctcttacctttctaaactcttacattaatgtcatctcaagtactgattgctcatggtagccgacagttatggatcacttcagtgccaaactcttggattgttgatgaaaacccacacggcactttttacaagggaagaaactgatccttacagggattttaaggacttaccctagatcacttaaatccctatggtactctgaaagttttctcctatcatactcatcttaagacttaa

SEQ ID NO: 144706 - DNA, 242 bp, Homo sapiens
cccgggactcatttcagactttgacttctcagggagcatcctcggagcccccagccaattaatgcctccttctgtactactgctaccagccattgaacagctacactgttccagacattacctcttgttttattctcatggcaacccacataccaaagcctgtgtggccttcacagttggtgtggaaggtggccccacactcagaggctcaccttctctgagcttaaggtctgagctacact

SEQ ID NO: 144707 - DNA, 275 bp, Homo sapiens
atgtaacctaattccagatgattaaaagattcagctgggcatggtgcctcattcctgtaatcccagcactttgggaggctgaagtgggtggattgcttgaacccaggagtttgagactagcctgggcaacatggcaaaacctcatctctattaaaaatacaaaaaaattagccaggtatggtggtgcacacctgtagtcccagctacttgagatattgaggcaagaagatgtcttgagcaggggagtgagcatggcaccactgcactccagcctg

SEQ ID NO: 144708 - DNA, 342 bp, Homo sapiens
cctcagattttcgtctcttattattagacacgcgtcaaagtaactggaagaacagcaatgcttcaaggagaaaagcataggcgggtttcaaattatgaacgggaagtacatctgaaagcatatgccaagtagaaacaaatttcttcccttccttacccttcagatatatatgtcataagctttacaattccatgtcttttcttatagtttcatttttgataccattctttagaactctgctctagaagcatctgttccaaaacagataaatgctgagctttacaccgaatttcagaatttgtagctgaaatttacaaggtatattcttggttactttatttt

SEQ ID NO: 144709 - DNA, 439 bp, Homo sapiens
ggcctggcagcctgctccgggttggggggcgggggggcaggatgcgcggcgtcttttatgctctgagatcctttgttttctttctgctacactttcgaaatccatccagcagagcctgcctctggtgccactgagaccctcacctgccaggcaacctaagccagggtagggaactgcctccttcccactgccagcatcctttgcttggtccagcctcctggtcacagcatgttccagggcccagccatgaccccttacccaggtgctcgcttctcaaggccaaatccctgctctgccctcgctctggattctgacctcgactgcattctcagaaatgcccagcttgcatctcttggaaacttctttctcattaagtaaaacatttccattgtgaaaaaatcagaaaacaggtaagaaaaaaagcttataacccccaaac

SEQ ID NO: 144710 - DNA, 236 bp, Homo sapiens
tagatatgaatgtgtaggctccatgaggaccacaccaggcaggatacaaaaacactggagtgtatcaggagaagtgatttgccctcctcctacctgccaaaggtggtgatttagaagtgatttaggagtaagactggggagacttcttgaagacatcttgggatattagagtcattctattcacaccctcgctccttgagaaaggggatcatttgccatggtccctcatagagagg

SEQ ID NO: 144711 - DNA, 139 bp, Homo sapiens
tgctgggattgcaggcatgagccaccgcgcctggccatcgaatgtatttctaacctgtgattcctgccaaaagctgtaagttcaaggagggcacctctcagggactgtgacccctctggctgcttctgacaggttggac

SEQ ID NO: 144712 - DNA, 183 bp, Homo sapiens
ttgcatattagaaaaaaagcactctttcactcttttcctcattctcaacacaattctgtgctgttatagaacgttattttcaatgttaaactatttctgtcatcccagtagcatattctatgtatagtgagcatgggatagttttgggggcagccattttgactgaattttattactctgtgt

SEQ ID NO: 144713 - DNA, 444 bp, Homo sapiens
gctctcgtaggtcaccattataactccacagttaatgcagcaactgcccagctgagtcttcccatcatcggacgtccccaatccattccagccatggtgagctttcaataatgcaaatcaagtcttcaaggtcattcctgtgtagaaagcccattgccttcttcatatacttacggctttcaagttccttcatatctagtctctgttcccctttctagcctacctcccagtactctcactccaatatagctcatgtcaaacagatactacttttggtttcctgaaatgcctttccttgacagtgaaccttgcttctgcctgaaacactctctctttccctatttctatcaagctccctgattttcaaggttcatttcgggcagcatgccctctaggaagcatttcttggcagcctgatcctctgcccagcctctcatctgattt

SEQ ID NO: 144714 - DNA, 760 bp, Homo sapiens
gtcaaaagttgatattttttgaagtgaagcagttatatcttctttctctacctatagtacctaactcaacttttatgtaagaatctttttactttcatttaaacctttagttcattgctatctagtgtttagaaacattattagcagcaggatgcaaattaggaatttttttttttagagtactccaggttttcatctgagtgaaatttaattaattgccagtaatagcttatctaactgtattttgtttggtctctgattgctttagcagtaaacattttccttatgcaccatctgagtgtttgagacaaggtacacttacgatgtttactgagttgaacccagaaggaattagaagcaatgaattatttgtaaacactttttccttttctttttttttcatgctccctttctccctccttccttctttccttctttcttccttccttcctcttctctcaccttatctccttcccttcctcctcttttctcttcttccttcctttcaatgaaagaatactcattggccaggtgcggtggctcatgcctataatcccagcactttgtgaggccgaggcttgcggatcacctgaggtcaggagttcgagaccaacctgaccaatatggtgaaaccccgtttctactaataatatgcacctgtaatcccagctgctcaggaggctgagataggagaattgcttgaacccgggaggcagaggttgcagtgagccaagatcttgccgttgcaccccagcctggg

SEQ ID NO: 144715 - DNA, 305 bp, Homo sapiens
ggggaaagtctgtgaagtgactgtgaattagagagtaaagaccataactcttatgtgaatacaatggaatttcttggcaagtcaccaaaggttagggtttggctatgtgggagttttctttatgaaaatctggcctagatgtagagatgatatgaccaagcaaggaagtgtagcaagaaaagccaaagaagcaacattcaaaacctaactgcagtaaggaatcaggaaggaccagagaaggttatgacgaagaacattctgagagtggaacagacagccagtgcagagaggagacagccaggagc

SEQ ID NO: 144716 - DNA, 239 bp, Homo sapiens
gcacatccccagccaaggccggtgaatgaaggtgtcatggtctgtgagaggttcagccatagcacctggtgctagagtaactcaacatccatatgcaagtgcagggcaaaattgtgaactaaaatggcctaaatttagcaaatgttttaaaaattggaaaatatctttatagacactcatttataatggaggtctgagttggtgttttggactgaatttgtgttcctcactgattcatg

SEQ ID NO: 144717 - DNA, 145 bp, Homo sapiens
tccacgcccaggcagtctgttagagggccagcactcctgagccactcaacgatgacagaaggaggacggtgcaggaagaggggcatacggcacagcatacctgctccactttattgctccacatcttaacaggcgttgccttccc

SEQ ID NO: 144718 - DNA, 386 bp, Homo sapiens
gaacatagaacaaagagaatgataaaataacaggaggctttccatgactgaatctttaatatcagaagaacatgcaagaagcattttaggtttaaaaccagtgactttttatgctcatctaaagtcacagggaaggaatagaagttgtatatatgttggctctgatattatctgtcttccttcataagactgtgtgaaggatcctatgctcgcttttgttcatctcgttctttgcacagggtctggcatattctcaatagaagtttattaaacaagtgaatgaatgtatatatgaattaatatccatcttaaatttaatggccttatattgacttgtgaaattttatgttgtagctttacttttttttaactacgggaaaaattag

SEQ ID NO: 144719 - DNA, 383 bp, Homo sapiens
tcaagtaacatgttagatcattcagtcaggatgatttagagaaatagattagaactccttttatccagtctaatataattcattgtaaaagtacagttggtcctctgcatctgtgggttccatattcatggattcagccaaccttggatcaaaaatatttgttaaaaaggccaggcacagtgacccacctctgcctcccaaagtgctgggattacaggcatgagccactgcgcccggcccatatgacctgtttttcttttatagatgggggagaaatatgggaagtgacttggtgtcagtcatctgtgttggttaaatcaagaatataatccgtgttttgcttctgaatagctctttataacagtgattggttactttgggag

SEQ ID NO: 144720 - DNA, 305 bp, Homo sapiens
acgtttctctgcaaaaacgcaagagattattctcaagatgttctggcttggaacaagccgttcccagctatctaggaggctgaggtgggatcgccccagtactggaggtcaaggctgcagtcagccatgatcatgccattacactccagcctgggtgacagagtgagaccctgtctcaaaaaacctcaacaaaacaaacaaacaataaattggtgcacaagatgaaaatattttttctctgtacaaaagagccactgtattaaaacttgaaatataagttgcctctgatgacacgtggtgtataa

SEQ ID NO: 144721 - DNA, 203 bp, Homo sapiens
agtagtacccagctttgcagttaattactatctagctggcctttttttaaacccttgtatacacttgtaaagaagaactatttcctgaacctggtacagcactttactaatgataaaactttactcctgaattacattaactcaattgctaagctgttacccctcttaatcaggtagtagtttggtagtctcacagtgaaatg

SEQ ID NO: 144722 - DNA, 399 bp, Homo sapiens
aaatagctttccccgcatcatctgggttgtgactgttgccagacacgagacagtcaatatcattacggtcgatgacatgacctggattagaactggaggtcaactgagacaaccgtatctaagagctagtttttttaaaacaaaaaagataattagacaaggactgtggttttatagataggctagttggaggattactggatagaatgaggagttaacatttgtatacagttttatttagcaaaaatattggattacatatttatttgttctgtcctttcaggacttctggttgatcttgccttttttcccagtattttacacttataaggactctggtttggaagtcttaaactaccaaggtagtatatctaggtaatgattatcaaatcataccta

SEQ ID NO: 144723 - DNA, 478 bp, Homo sapiens
ctcgaactccgaaatccgggcatgggatctcgctctgttgcccaggatggtcttgaactcctgagctcaagcgatcctcctgcttcggcctcccaaagtgctgggattacaggtgtgagccactgcgcacagccaattagacattcttatccccattgaacagataagaaaactgaggccatctcaagctggccctaatctagcacactggcctcctctcccctctcccaccgtgcagcaccccctgtggacaccacctctgtgtcccctgccttgctcagtgttttctccacttggaatgtcactccactgccgaggctgtgttactttgcagagagccaccctccctctctcttcagtggctgccctgccctgggttcccccagcaggcagtaagctttaggggcacggggccccactggattcctccgtggacacttcccagtgtcagagcacatggggtgaattgtgaccaaac

SEQ ID NO: 144724 - DNA, 247 bp, Homo sapiens
cttgtggtattgcttggtgaatcttctcctggtagttagggttgcttgggatagttcttaggatgttgtagaaatctagatgtcccagtgaaaatgaagagagtagctagtgaaagacgtagaagtaaaatggttaggatttgatggctggatttcaggggatagtagagaggcaggaagagaggagggtctgtggtctgagttacttggggcaatggcgataccattacctgaggcggggagtcag

SEQ ID NO: 144725 - DNA, 470 bp, Homo sapiens
cctaacactcaggagtcaccgctttccttagtaaaaaaaagtcaagaatacactagggtttatgtaaaacaagaaatctccagtccaaaatcagtgaaataagaatacagcatcaaattatattattgaagttgaagaacagtgcacagggagaaaacaaagtgataacttaattcaatgctatagaaaagtgatttgtgagtcactttaacatttcagatttgtttaaaccataaaagtgataaattagccaaagagctaacaattgatattatcttaagttcacataaattttgatttaactgaagcaaatgaaatcaatgtagttactcccttccgattgcttcatctttgtacagtttataaagctaagaataagtagctctaatgaacagttttttttttaagcttttttgttgaggtttctctaatatgtgtcttttagtaatctcttcatttttttcctccca

SEQ ID NO: 144726 - DNA, 442 bp, Homo sapiens
gtcgacggaccctcttccctgaacactcgggtaaatgggaggtaattttttgtattttagtagagatggggtttcaccatgttggccaggctggtcttgaactcctgacctcaagtaatccgcctgcctcggcctcccaaagtgctgggattacaggtgtgagccaccgcacccggccctgacaggttgttttgagaacaaactatgagagttgaagtgtgttggattgattggtgtggcattttgtagatgagggaaaggagaacttggtcttccattttcttggtgagtgagaccatgggatgtccaggcagctgtggggaagtggaagggtagggcggggtgttgctggctgggaacagcacctaatgaggcatgcttaggaagttctcaaggccaagaccaaagccacttagacaggtgtgcatggcagctttggagg

SEQ ID NO: 144727 - DNA, 382 bp, Homo sapiens
gtaaactgggaagtgctcctcacctcacactctccctaaatctaaattggtatattataaagtatcctcagtctgtttttcttgtttaagtaccgaggcatcttcccccgctttcaaatacaattttaggtgaactcttaaattgatgaagggtcggggggccagacctctggctgcccagctttcaccttgtccctcaggcatcatcttccctctgtttgtatacatatcttaaactcttagaggagttcagcctgaaaacaactggttctactggtgtactggaaattctggtggtcactgctagaattcttgcctgaaatctgaatacggaaagtatcaggataagcagcaacacagtagcagttttccagttgtgggc

SEQ ID NO: 144728 - DNA, 489 bp, Homo sapiens
ttttcaccattccattccccctcacccttcaaagtgtctgcgtgccaaacttctcctggttgtgtgacaagaacctggtttttttctacaacatcaccaattatgaaatgattttaaaacttttataagcatacagaactttgtcacacaaaaccagttgactacaaaagctgcgaaccagatcttgaacaaacacatcagaatgctagagtccagtttaactcacctctattattagcaaatttgggaaatttggagaaaagtgaatcagaaaaaagaaaagggcttattcggaaatgatacattgtgtctcacaagaacatttaagtacctggaattaaaacatcccctaaattaacaatatacactgttgaaagttagcaggttcaactttgagataccgaggctgtcaatcacttgaggtcaggagttcgagaccagcctggtcaacatggtgaaacccccgtctccactaaaaatacaaaaatt

SEQ ID NO: 144729 - DNA, 210 bp, Homo sapiens
aaagttgcttaactctgtaaatatattcaaaactattgaattgtacacattaaatgtgttaactttatggcatataaaatatatctccataaagctgtttttaaaaagttagcgtgtgtaacagtcacaggggagggtggggagacgccttttaaaagtgcagattcggccaggcacggtggctcacacctgtaatcccagcactctggg

SEQ ID NO: 144730 - DNA, 365 bp, Homo sapiens
aaagtgttttgcagctatgcagaggactttttttttttaaaaaaacaaatcagagatttcacataaaaccccattattttgggcttttcttaaacaagggagcaactgtatatcctggaacacagcccccatcttaggcatggtcacctccttcccttcctttactggatttatcttcatgtagactgctgtggccatacaataaattggactaatattgaacccagccaagaaaataatattaattgcccatatttttacctgcccataacacttaccattaccgtaagtatatttctgatgactctcagttatctacttgatacatgtatatctaaatccaagatcattcctataaatgtgta

SEQ ID NO: 144731 - DNA, 395 bp, Homo sapiens
ccgtcagatctcatgacatgtattaactatcacaagaacagcatgggaaagacctgcccccatgattcagttacctcctgcaacatgggaattcaagatgagatttgggtgaggacacagccaaaccatatcaaattctaaaatgcatatgaaagtataaaaaaaccaaatagccaaagtaatcatgagcaaaaggaaaaaaactggaggtatcacaccacctgatatcaaactatactacaaagctatagtaattaaaacagcatggtactggcataaaaatagacacattgaccaatgaaatagaatagagttcataaatgaatccatgcatgtatatacctaatgctagatgacgagttagtgggtgcagcgcaccagcatggtgcatgtat

SEQ ID NO: 144732 - DNA, 212 bp, Homo sapiens
cctgccctcaccacgacataaacacaatctcttgttctgctgaagagagggatggaatagagagctgaagatgagcaaaaggagggaggagtcaggaaaaggcagctcctatatgttgaatttatttttcattagtactgagtatttaaagaagagggcacccaggctggagccctgggaagtcccatatgtggtggtctggtggagtgggt

SEQ ID NO: 144733 - DNA, 435 bp, Homo sapiens
aaagaaaaaaaaccttgggaaaaaactttaaaaaaaaaagaccaatagagtacacaagtttttagtttttccgaatcaccatgttaactttctttatcggcttacatacttggttattgagggcaccaaagcttttactttgggattaatttggtttttaatcctatgcaacagtataaaatagttatttatgatttataatcagtgcatacttagaagatgcttagagtggaaactgcttggtagatacttttaatcaagctttagtgaactgttttccctgcaaagcaggcaacactttatgtgtaaaacctttattgcaactattatatctgcacagtcacaaagtacctcatgttgtatgattccatttatataaaatatccagaataggcaagtctatagacacaaaaagtagattagtcatgcggaagg

SEQ ID NO: 144734 - DNA, 439 bp, Homo sapiens
catcctacatttcatctcccaaagctggcttcatcagtgatctgtgaagtgtgatgcagaaccattgaggcatggaaaacaaatggggacctttgatcaacatggggattaggggaacaacaattattaaaaaaatatcaggacttaacatatctgtattttattatctcacattgtaaaatttcctattccttgtatatgtttaataatgtttgtattagtggaattgagcatttaaatgatcattaaataaaagtcctatacagctgcatgctcagaaagattttcctaacagggctatgttatcaagaaagtttggaggcactggacctgctttctggtcactttttctgcatcttttcttgggcagtcttttgatccattctccagtttagtcaagtgatcgtttagtaattcacatctctcttccttctacctc

SEQ ID NO: 144735 - DNA, 194 bp, Homo sapiens
caatgcacagcctcattcctccactgaaactgctcggtccaaggtcatcaacaaggtcctatttgtcaagtcctgtgccctttccccagcctccgtgcctttgcatcattagatatggttgacctttccctagaaattcgcccccacacccatggaatcctgagacactccatgctcctgtagccccgcgcctt

SEQ ID NO: 144736 - DNA, 279 bp, Homo sapiens
cctttctatagtttaaaatatttgaggcacgttagggaaggtctcatcttgtttttcagaaagcaaaactgtttttattcattattcctataacatttggtgaatatgtatcactacacacctcagaatggctaaattccaaaatataacaccaaatgcttccaaagatgcaaacaaaggaacattcatttctgtggtaattcaaatggcagaggttgcagtgagccgagattgcgccactgcactccagcctgggtaacagagcaagacgctgtctca

SEQ ID NO: 144737 - DNA, 168 bp, Homo sapiens
gtcagatctggctcaatgagaatggggacgacatatgcaaaattaaaaaggggggactaccaggtgtaccttcacatggcatcagtgtaaacattctaacagaaccgaccaccaattaaccaatcaccaaccaacacattccatgcagacagcaagtgcttaatttaa

SEQ ID NO: 144738 - DNA, 313 bp, Homo sapiens
tgatctcagaggctcttccacaatactatggaaggacaatactatctttgtaggttaagaataaagaagcaaaagacagggtatcttcatggctccaatgaaatggcctctctagacagtatgaaccatttataactcaggctttagaagggattgtgaaattctgatctgcttgcaagaaagctcttggtggacactgacatgaagcaatccctacatttccctcttagaaaaaggtggcactaaattgtcaggcctctccatttagaataaaatagtacaacttttacatgtcttggtctaaggtccaaga

SEQ ID NO: 144739 - DNA, 633 bp, Homo sapiens
aggctcagtttctgagcaaagacaggcgatgtgatcagtcctgtgccttaggcaggtggtgataaaaggacactttagaagggtcagaaatgggagagctggaagccaataccatggcaatcatttgtgcaagagatgatgaagacctgtgtagatggaagggaaggaagggacagctgggagctgaccaggatgagccaataattagatgcagaagtgaaggagtcagaatgacattggaacagggtgggtaggaggagggaggggaccatcactaagacagagaacacagaaagggatctgattttgcgtggaaatctgcgttgtgttttggacatgctgatttgggagatacttgaggtggtgatgcctcctgggagctggaaatataaggctggtgcttaggagagaaggcagcatgagacgtgttgacccgggcatcatctacagagaaacagcctgaagcccttgcctggtgggagtttataaaagacttacgggataactgacagctatcagggggagagaaaatggtgattaattaggctgagacacagaatcttatcattggcaaggcttttggacatgaggtggcttaaatattagagatatttaataaatgtttgtcaaatc

SEQ ID NO: 144740 - DNA, 346 bp, Homo sapiens
ttagtgactgtgaagatgtgaaaggtgacggagaggaatgttataaagagggtttcaagcctgggacagaagttctccaaactgttgtttcctgcctctgtccttcctgcattcctaccctcctaactcaacaggtgagtaggtgagcgtctctgtccacgactcctttcagttgctactctcagccaagtctggcctgcagctcccctcaaacatcctcctgccctagaatgttctcagcgattccctcctgtttttactttctgttaagtgtgtatttccaatttagtattgtgatttcctcctttttccctttcccttttttcctttttcttccactcccaac

SEQ ID NO: 144741 - DNA, 229 bp, Homo sapiens
tgtagagacagggtttcactaacagttactctttataactacttgttaagttaacctacaaataaaaaatggcatgaagcttttactgttggggggaagttttcagatgttactacaacattaagcccaataccttgggagagaaaccaacataaattgcacacagatcttatttgcaaagtgcatatggtctagaggcgataggatatgcaaaataaccataatgtag

SEQ ID NO: 144742 - DNA, 113 bp, Homo sapiens
tgctgggattacaggcgtgagccaccgcacccggcatgttactatctgatttgtgtattttatttttttaaaaactgccaactgctttgtggagaagttactggaaagggtca

SEQ ID NO: 144743 - DNA, 130 bp, Homo sapiens
agttctctgtgcttggaaaacccttgcggataaacaggaaatacacagaagtgacaaaaattcaaatgatgacctgcagtatctccactgggaaacactagctcaatgattaagaactcaggctggctag

SEQ ID NO: 144744 - DNA, 344 bp, Homo sapiens
caagtagtatatcactatactttcagttaaaacaaatgtaaaaattttggaaaaagcagtgcactgcaagaaccaacgggatggttcagtaagggagcttatttctaggtggcatctccttttgctgttacaaatgggctcttgtccctccatctcccctggcatcctatctgttctaactgatttatgctggagcacaggctgattttggtacatttaatttaaaggcagtcacctaagaggcaagcaggcagtgcgtgaagacagctgcagagctccaggctgagtggcggaagcaaatcagtcagaattctcagaaacagactcagtaatggaagaactta

SEQ ID NO: 144745 - DNA, 183 bp, Homo sapiens
gatggatttgctggtgcagtacaactaggcttaatagggacatgactacgtatgttaggactgagaaaagaacaggctaaaatggtgccaacttgagtcattattatccagctttaattggtacccaacttgagactttccagatagaagatcactgagtgtttccaggtggggaggaaaaaa

SEQ ID NO: 144746 - DNA, 545 bp, Homo sapiens
ggtggcgtgcacgtgcagtcccagctactcgggaggctgaggcaggggaattgcttgaacctgagaggcagaggttgcagtgagccaagattacgccactgcactccatcctgggcaacagagcgagactccgtctcaaaaaaaaaattagcctggtgtcatggcatgtgcatatggtcacagctacttgggaggctgaggctggaggatcacttgagcctgggaagtcgaggctacagtcagctatgagctatgatggcactactgcactccagtctgggctacagagtgaaactttgtctctaaagtgtgtgtgtgtgtgtgtgtgtgtgtgtgtgtgtgtgtgtgtcacatactttttcataaattcagtattgagtactatgtgtatggtgctgtaccaggccaaaagacataggtcctgttattaaggtatgtatgatgtaaagagtgaaatgaacagaggcaagcataaagtgctaggtgagcacagaagagaagtacaaaccagggaggggcaaaggaagggacaaagaaggactaga

SEQ ID NO: 144747 - DNA, 329 bp, Homo sapiens
agtttattccagtctctctctgctcatctccagaactgccctcacacagatgtttgtatgggtgtttttatttgacttcaaagataaagaaagaaacagcaagcaataatacccaggctgacgtgaaaaaactcctccacgccaagaagcccttaatgtgctcaattaggccctcgggcacctccacttgccaccttcaagagctcctccagttgtgctgcaaataatatatttgatcatggactagaaacaggaagtgctcatacacaaagacactacttgctcataccagtttctggctgaaggtcttcttatttgaaaacataggg

SEQ ID NO: 144748 - DNA, 327 bp, Homo sapiens
aagaggcccagctcatccagaagctggcctgagaggacaggggcttgggggagaggggttagtcagaatgtgtgatgattatggccaggtgcggtgactcactcctgtaattccagcactttgagaggctgaggtaggcagatacccgaggtcaggagtttgagaccagcctggccaacatagcaaaactctgtctctactaaaaatacaaaaaattagccgggcttggtggctcatgcctgtagtcccagctactcaggagggtgatgcaggagagtcacttgcacccggaaggtggaggttgcagtgaggcgagatcatgccact

SEQ ID NO: 144749 - DNA, 769 bp, Homo sapiens
aaattatgtttattattttcctgaaagtctgttagaagctaagtaagaattttacttcagaatcttgcaatgtcttgtatcagtatagcccaacctgttatatttttttgttcacctggtaacttccaggactctgatagctttccccaatgcctttatacctagttgattattcttgtacttgatttttgtagaacttgtttttcttctttgtagtctattgatctccatgttgtatgcttttttctgttaccatttcacttaaaatttgttgaggttgttttgaattctgatcttatcatccaagacaatagccttctcagccagtttggtaatggtctgtttagtcacccagatgaaatccctgaatctcacacacagacttgcagagttcatcagtttttgaacacctgtcaaggtgctcaacatcttgcagggtactctgcaataagaaaatgtgcctatcctcaaagaacttaaaaacatgattgagaacactatagctaactcttaagtatgtgccgaactgaactgaactgaaacagtgccagacaatgacttgcccaattgtgtgagtaccgtatgggtttgtcagagtgggagatgagggagggctgacggtaaggcttcttgagggcactggcaaatacagcctcttgaaggatgggctaaaattggataggagggaattaaaagtaaaggcacagagtggtgaacaacagtgtgctgtgttctgaagggaagagtctgacaggaatgggtatggtag

SEQ ID NO: 144750 - DNA, 289 bp, Homo sapiens
ggactaatggcagccaatcttgatataaagggaaacagtttcattaaaagctttagtactaaacctgaagaggggtataagtactaaacctgaagaggtatactagattgaacaacttagttttgaaataagccaaactaagatatgtgaaaggggaaaaaataatccttttggacgtaaaggatgaagtgatagtttacatatctgcagtctggagttgtggttctgatcacaggcactgtctctaaaatacttgcttatgacttctcagtcctgaatttctaaaagc

SEQ ID NO: 144751 - DNA, 325 bp, Homo sapiens
tggtattttagtttatccattcacatgggttgttgttttaatttccttcatctgattttgacatgattctgagaaagatctataaagtaaccagcaccatagaatcatggtatgaaaactaatgagaagaatattatgttaattatgttctcttagtctctactccacagaaaggttttaacaatgaaaaggaattgctaaactataagtgacattttaatttaaaaaaatgaaaatgtgtagttagaatctttcagtgcttctcttattttcttctgtgtgctagatacttttggctgtggtgggggtatcatttcttttgaaa

SEQ ID NO: 144752 - DNA, 501 bp, Homo sapiens
gactaatgatgttgagaatttttccatgaccatttgatatacaaatggtcaatatatacaatatatgtgatataaaaatggtcatgatgatgaccatttttatatcgtattcaaattctttttaaattgggcaatttgttttttaattgttgacttgtaagagttcttcagatagtctggattttagatccttatcagatatatgatttgcaaatattttaacctattctatgggtcttttcactttttgacagtatccttgatgcaaaaggttttaaattttgatgaggtccaaatttatccatttttttcttgttgttgcttgtgcttttggtataatatctaagaatctaagaaagaactgcttaatccaaagtcaagaagatttatgcctttgtttccttctaagagttttatggttttagctcttacagttaggtctttgatccactttgaactgatttttgtatatgaacaattcaaattatattagttttccaa

SEQ ID NO: 144753 - DNA, 324 bp, Homo sapiens
aatatattttttatagagatgggggtctcaccatattgcccaggctggtcttgaactcctgggttcaagtgattctcctgcctcagcctccgagtagctgggattacaggcgcacgccaccacgccagctagtttttgtatttttagtagacatggggttttaccatgttggtcaggctggtctcgaactcctgacctcaggtcatctgcccacctcggcctcccaaagtgctgggattagaggcatgagccactgtgcctggcctatattttatttttcatagtgtccccagccaaggcagaaaactagccaaaaaggccact

SEQ ID NO: 144754 - DNA, 621 bp, Homo sapiens
cagagaaaggtatttcaacaacatatgacatgtcaagccaacgtagcccagagtggaactactcacaatgtagattttaaaaaacatggctaaaggaccattcctcaggagaacactcctaatgatggagagcctattcaagcctgttctatcttttcttaactgtcccaagaggcatcatctctggcctgttccttcttagcccatggtcattagggtctctggctaaataagtttggaaaaaacagcatactttatccaattcttagaaatttacaatgcacagggctgtattaatggctctgaaaactcatgcagtaaagaaactgatttatctttaacactctgccaaatttatttgagaatagaacactcctgccccagaacatctagcatttctgatttcacttgaggagagcataccttaggaattttagatccagcttgttgccctctatcctgctaataaggtgccacaaactgtgaataaaccctcttggccttatggtgaactgacctcaacctgtcaatggaggcagcagatacttgggcttcagaaggaatggcactttccgcaccacggagaaaacagaatgcaggacccctttgttcctcttgcct

SEQ ID NO: 144755 - DNA, 163 bp, Homo sapiens
caggagcctgtgcataccagagccagggcactggctttccaagaatgggaactgagcctggagctgctcaggattgaagctctctgtgcagagggcaagtcctcagcaaccttagtgccctggttattatgtccaaaagacaaagaggtcagccagcctgggc

SEQ ID NO: 144756 - DNA, 446 bp, Homo sapiens
gacctaatccccaccatggagttgtcattagttatgtgctgtagaactgtgggcccaagtataggacattctccaaatccgtgggtgccagccactagggaacttaaggtttggttgctgcataagcttggagtgctatatctcctcttgtagcagctctcaagttcagggattgtgtcttgtgaatccccccagtgtatagtaaggtgctgaggttctgcgcactttagaaccctaatttgttggcacatgttgggggatgggtaggagggttaattttgtgagtcgcatggaggtggggtccaggtctgccttcggacatgcaggccacaggcatgcgcttgaaacacaggctgcctgatttcagaatcgagccatgatggggagcactgtggtttgtgaggggggttgatctgaaccggtcactctgtgcctaagcaggtgac

SEQ ID NO: 144757 - DNA, 318 bp, Homo sapiens
gacctaatccccaccatggagttgtcattagttatgtgctgtagaactgtgggcccaagtataggacattctccaaatccgtgggtgccagccactagggaacttaaggtttggttgctgcataagcttggagtgctatatctcctcttgtagcagctctcaagttcagggattgtgtcttgtgaatccccccagtgtatagtaaggcactgtttgtttttatgtggttgatggataaattccatatggggatataagcacctgtatatcacccattttaggccaggcatgtggaagcacagtggggttcaggtctgg

SEQ ID NO: 144758 - DNA, 450 bp, Homo sapiens
tatcttaccttttatattcctatatgacttagtagataggtattttaaaaataacactattagagaaattcgaggggaaaatggagaatttgaagagagaattagaatctgtaaaaagaatcatgaatattttagaactgaaaagtatacttgaaattatttgataggtttaataacgactgcatacagcagaagacaggttagtgaactcagagacaaattagtagatatattgaaactaaagtaccaagagaaaaaattggattgaggtagggaggggccaggacaaagagaggagagtggaacagatatgtgagatagagttcaggctggacacggtggctcacacctgtaatttcagcactttgggaggccaaggcaggaggatcactggagccccagagtttgagaccagcctggacaacatagcaagactgtgtctctattatt

SEQ ID NO: 144759 - DNA, 288 bp, Homo sapiens
taccaatttcagtggagaagcagagtacagaagctgagtggaggagagattaagactaaataagaaaaataacgtttggaagtataactttaggtttatttgatgggaaacagctcaggtttaagaacaaccccatgaagattgtatataatggtctatcttcatcgagcctttccattttttccttctgactttgaatagaaacagacaaagagacaatactcaagcgaagagtcattttccagagaaggatcctagttagcttggatatttgagtacattctttat

SEQ ID NO: 144760 - DNA, 414 bp, Homo sapiens
  misc_feature (19)..(19): n is a, c, g, or t
ccacagaggacagtaccanagtaggagaggagcgagctgggggaaagtggctcccttcaccctttccactctctgcatccgcatcacccatgcggaccgaagggagggcagcctggcctctgagccacccccatctgatcttctccacttccttgacccaaaaaccaaaggcgcccccacataaggaatgtggagggagtcaaggaacatgaacgaagtttcttcctggtcatctcccgggtttgccctgatggtaggaagctaaccagaagggatagctggtattgactggagagtgggcagagggtgcatggattggccatgggctctcacaagcctgggcagccccaagtctcttgctctgagcagatacctaatctgggaggagagaggtgacctactatgggtacagtg

SEQ ID NO: 144761 - DNA, 714 bp, Homo sapiens
gacgggttggggggagagtaaaaggggagaggaaagaaatgtatttttcatcagccagtgtataatttataaacagcattaaacagtttttgttttccttttcctctctcccgtgtacgggcttggacggtagtcaagcctgcattaatttctgctttgggtacagtgtgttcttggaggcgcatctgcaagcgatcataaactctctggaatgctggcagaacatccagacctgccggcaggccagtgacgacaccactctgggaaaaagttcgggaagcaagccaaattcagagtagggagagagagagaaagagaagtgtgttcaagagcgagctgggggaaagtggctcccttcaccctttccactctctgcatccgcatcacccatgcggaccgaagggagggcagcctggcctctgagccacccccatctgatcttctccacttccttgacccaaaaaccaaaggcgcccccacataaggaatgtggagggagtcaaggaacatgaacgaagtttcttcctggtcatctcccgggtttgccctgatggtaggaagctaaccagaagggatagctggtattgactggagagtgggcagagggtgcatggattggccatgggctctcacaagcctgggcagccccaagtctcttgctctgagcagatacctaatctgggaggagagaggtgacctactatgggtacagtg

SEQ ID NO: 144762 - DNA, 350 bp, Homo sapiens
ttgaaacatagagaaaggaagttagccaaatgcagtaagcaacaaccaatcaatttgctgggtaagggagcacttaaaggagatcaatctggtagaattttgcagaggggaatagacagaggctgccgtgctcaacccaactggtgaacgactgcctgcgcaggctgaggtgatgaagggtatgctggcagtgaggatggagaaggaacacacctgagcaaccctgtgcgggggagaaactcagttttgcattggatgtgcaggtgaaagagagaggggtcaaagatgttttctatcttcaaaaggaggaatctagttgaggtagtgatattagaggtaagatttgggag

SEQ ID NO: 144763 - DNA, 432 bp, Homo sapiens
cccatattatttcaaattatttttggaatctttatgctattccttctccaaaaacttacagttttaattactatagcttcatattttaatctgtgaagggttacacagacagtaataaatcattactagtattttccagagttatcctgaacattttcacatgcttttgctccatataaacatcagagtcattttataaaaacaaacaaaaacaaaacaccaccaccagcacctgttgtcattttatgagtgcactgatttagtatattgcagaaactaaaacattcactaaaatctcattcaatttttttttttgagagtggtgatacttgtttttgtggggttttttgagatgggggtctcactctgttgctcaggctggagtgcagctgtgcagtcaccacccactgcagcctcaaacacccaggctta

SEQ ID NO: 144764 - DNA, 120 bp, Homo sapiens
caagactccgtttcaaaaaaaaaaaataaataaagaagaatgtgagggaaactgtttaagaatcagttagatccctggatcctttccttgaatccaccctgctaggcagcagcctttatc

SEQ ID NO: 144765 - DNA, 139 bp, Homo sapiens
tatacaaaaattagctgggtgtggtggctcatgcctgtagtccccagctactctggaggttgaggtgggagcatcgcgtgaacctgggaggtggaggctgcaggtagcccagattgcaccactgcacattccagcctgg

SEQ ID NO: 144766 - DNA, 241 bp, Homo sapiens
aaggtttccttacagtttagtagcagcattgtttaatgcagggattttcaacattctattgccaaaaattccattaaatcatgtttttgaagctcttgcatacaaaataggtgatatttattcaacaaattattgtttcacttcttattaatctaaggtataaaaaattttcccatagaggttttgaatgaacaccattcattcatcagtaaatgtctatgcagtactactgaggtgtaag

SEQ ID NO: 144767 - DNA, 671 bp, Homo sapiens
tgtctcagcctcctgagtatctggaattacaggcatgcaccaccacacctggctgatttttgtatttttagtaaagacggggtttcaccatgttgggcaggctggtctcaaacttctgacctcagatgatccacccacctcagcctcccaaaatgctaggattacaggcatgagccaccatgcctggctgtgaggaagtattgttgatggtggttctcttgactttgaagaggttgaacagtggagagttcatcctgtcggtgaaaggcctctgcctgtgttttgtgcgcgtctgagctctgcaagaggaacgtcctgttcagacgtgtcgggggcaggaaacttcagtcaaggctcagatttcttctaactagggcagtggttcccaaaccttgctgcataatagaattaacctgggagcccaggatgtaccccatactgctgacagcagtgtctgtgtgggagctgggcgacaggatattttcaagttttacaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcag

SEQ ID NO: 144768 - DNA, 208 bp, Homo sapiens
tagaaggaagattatatacttcatccaagaactcttccatctcacagattagtgacatcaggccaattgcaattaagtgatccttttagttttggtcagctccatttcccatttttatctattattctcaaacacactacttgtccccaccctccatcagcctaccaatgacttcacctttatcaagcatgcatcctctcttgacacc

SEQ ID NO: 144769 - DNA, 410 bp, Homo sapiens
tcctgtagtagccactcccttcaggaatttgctcctctacataacaatgggcagctggtacccagagcacctgccgcatggcctggcctgccagatgcagataaggagagatgatgactccttgtcttgagtcaccttctgtgaagagaaagcatgagaggaaaagattgataagatctcatccaggatcagctagggtccgaaaggaagccagcctgggagaccgaggggagcggatccatagtccatctccacccactgccatgcagcaggggctgaggaccctgctcatgcagagatgcagtagatctgcagacagctgctgtgagcaaaggtagctggaagtccaggtgccccatttgttcttttcaaatgtggtacgcagctgagaaggggaaagaaggaataat

SEQ ID NO: 144770 - DNA, 316 bp, Homo sapiens
gcctcagcaaaaagcttggctggattgtatttgtgccctagagatctatggaagtttgaacttcagagtgatgatttagggtacctggcagaagaaatttctaagtagcaaagcattcaagacatggaccagctgcttctaacaacctatgcccagatgtggaagcaagaaaatgactgaaaatttgaatttatatttaaacaggaagcagagcataaaagtttgaaaaatgtgcagcctggccaggtgagagagaaagaaaaagcttcttcagaagaggactttaagcaggctgtacagcaaccacttgctaaag

SEQ ID NO: 144771 - DNA, 319 bp, Homo sapiens
ctgggtgtggtcggctgggtgatgtggctcaggggccctcatgagggcacaagtcaagatgtctgctggggctgcagtcatctgaaggtacagctagggctggggacccactttctagctcactcatgtggctgttagaagaagccttccattcctcatcacgtgggcttctggctttccccagagtgaataacaggagagactatgagagcgagagcgagagagagccaggagagacctcggtgtcttttatagttgctgagggttgaatgtgtcccccagagctcaggtgttgaaaacatgatccccaaggtggccg

SEQ ID NO: 144772 - DNA, 180 bp, Homo sapiens
atttaatcctcaggaaaacctgcgcaatggttctgtgctatcacccccgtgtcacagatggggaaactgaggctcagaggctttgtaactgccctgcccgtctcctgccttatctgcttccacccccggccccctccttccggccaggctgtgtcctgtccccgctggtccctccagcct

SEQ ID NO: 144773 - DNA, 378 bp, Homo sapiens
ctccagactatgtgcagcagtgagatgtattattattacaggaaaagtgtgggcacaggaaattttatcaaacgtggcatagtgcacattttactaaagcaagaaaagatatgaattttttaaatatttcctttttgcaggctgtgtttgtatttgatttgattctcaagattttccaagagcttggcatgttgatggacttgtctaccaagaatacattttataaaactctaaagtatttttccggaacttcatcagaaacggaggttaaactactcacttttgttttactgtttatgcacccattaggcagcaagtacacacttgaggctcctcgctagcagtattgcttactactgagaatctgcatgttcagct

SEQ ID NO: 144774 - DNA, 393 bp, Homo sapiens
gctcaaactgcaggttggggccggggggggcggggcgtgaaattcagtcttggagcaggctaaggggttgattgaagggatcaggctccgttctctgactccgtctgtgtggcttttttggggagaagggtggggacgatgtgagttcgaaaaaggatacgagatctggatatctggatggagctggatatattgtgatcagtcagagatctgcctgggaggagagtagtgtgtagtcacttttcagtgccttggctatcaaacaaagaatactcttacagccaaacttaggtccctgtatccatggtgaagaaagatagttggagtcttcccgggctagatggaatagatagtggaatctaaccacgtggattatacaacctaattcctatt

SEQ ID NO: 144775 - DNA, 283 bp, Homo sapiens
ctggccacagggtttgcccacagtgcctttgctcttgggcagctgtcaagtggtccccaggttggatctagatggggtcggtgtgcctggctggcagaggtgggagtgctatagggtacgtcggggttgaggaagagattctagactgcaagctgctgggagctgtgttctatgagaggtgcagggcgacagctctgaacacagcccttggcctagggagtggcacccttgggctgtgttagaaggcaaggaacagctctgtgctggtggccacaggggagct

SEQ ID NO: 144776 - DNA, 128 bp, Homo sapiens
ggatttgctggtgcagtacaactaggcttaatagggacatgcacgtgcacacacacacacacacaatttaaccataagggaaggtggtagagattgtaaatgagaaatagaaatgatagttaaaaaaa

SEQ ID NO: 144777 - DNA, 836 bp, Homo sapiens
ctggtcaacatggcaaaaccctgtttctactaaaaaatacaaaaattagctgggcatcgtggcgcgtacctgtagtcccagctactcaggaggctgaggtaggaggatctcttaggcccgggaagttgagactgcagtgagctttgattgcgccattgcactctagcatgggcgacagagaccgtgtcttaaaaaaaaaatgtaaggggaaacagcaggaagggacagaggaacaggtaattcaggtaattatgcacgatgtctctcagcaaatctgcattttccatagggtagagaacacacacattttccatagggtagggtgtgtacacacggtggaggaaggagacacatgcctagatgtgtgggtggatggctcatttcttgtctctttgtccggcacctgtgaagatgagctgtgagtttacattgtcagggtgagggaggccgcctggggagatacgtggcctgtatctcacaactctctgctgaagaacagaaagcaggccggttttgtgcgtgtgtgtgactcacttcccaagcttaactttttccttctgcatagtgagtttggggtcctgagattttattttcccttcacacggctgaggtggcgtgaccaggatttggggaggaacaatgacacacatcccaaaggtgtggggacctgacaccagctggcctggatccatcccgcatccaccaccagtaactgtgattgcaggcaggtgcccccacctctctgggcagtctcctcatctagaaaatgcaggtgaggctgatgcctggctcttctcagttgtctgaggattaaatgagttaaaactcacgaagcc

SEQ ID NO: 144778 - DNA, 381 bp, Homo sapiens
atttccaacactagaagactaatgaaaataaattatattatacagcaatccaaaattataattgacataattaaagacattggaaaatgttgaaaatatattaagtggccaggtgtggtgactcacgcctgtaatcccagcactttgggaggccaaggcagggagatcacctgaggttgggagttcaagaccagcctgactaacatggagaaaccctgtctctaccaaaaatacaaaattagccggatgttgtggcacatgcctgtaatcccagctattcgggaggctgaggcaggagaattgcttcaatccaggaggtggaggttgtggtgggccaagatggcgctattgcactcttagcctgggtaacaagagcaaaac

SEQ ID NO: 144779 - DNA, 748 bp, Homo sapiens
caccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcactggcactccagcctgggtgtagacagagcagagactccgttctcaaaaaaaaacaaaacaaaaacagaaaattgggagcaccctttcctaaaccctgtgtgttcacaaatattccaccacaactaatgggttccaaacgcctgtgccacgtgtgttacaccctacaatctcttatctaaaacacccctgtgcacagaaacacacccataggagaaactaccactatctctctgtcggaccccacgcggtacctgtgcacaagggcgttctacccagtagcacaacacaaccaccaaacgccactgtgcgcacaccaaaagcacaaaatcatttgcgcccacaccgtgggcaacccccatgattagacaacctcttaacaagaagccctctcaatattaagcagcaacaagacgaagcaaaatcttcatatgcaaaaacgagaacgtaaaaccaacatgtacagtatttcttaaaaacacgcagctagtggggggacaacagacacacttattct

SEQ ID NO: 144780 - DNA, 491 bp, Homo sapiens
gcctgttgttctctggtaatttgaatttttaaaacttattcctgaaataaaaactccaattttacattaaaacaatttaataaagctacctgaccaaatacaaagtcatacagccatacaatagtaaacataatttttgcttagaaatagtatgattttaaaagtgtattaaactttcaaagcatctgaatatataaataatatgaggtttttaattaatgccattaaaccttgaatgtcatttgacctggagatgaaatagtaccataagtatttcaaagagttgatggggagttaaactataaaatcagtaagaaaggttatgtgccatgtggcacaaaaaacgtatattaaagactaaatgggtaggaaaaaaaaacctctcttaagaacctctctgaaaagtgtcctgttttattttaacatgcgtttgagcaataggaacagcaagtgcaaaggttctgatattccagaaacatacttagagcagt

SEQ ID NO: 144781 - DNA, 677 bp, Homo sapiens
ctaggcagcagctcctgaggacaggaactaaacctctttaaaatgccttcaaaaaccctgccatgcaccctgatacagccctagttagtgtacatattattatcaggtttctgaagataatccaggaacacctattgtatcagtcagctactgctgcataacaaattataccaaactcagtggcctaaaacaacacatgtctttgtgatatgactggtgaaataaattaagcaaaaacaaattattattttttttaataaaaaagaagaggctgggagccatggctcatgcctgtaatcccagcactttgggaggctgaggcaggcagatcacctgaggtcaggggtttgagaccagcttggccaatatggtgaaacccaatctctactaaaaatacacaaaaattagctgggtgtggtggcgggcgcctgtagtcctggctacttgggcggctgaggcagggaaatctcttgaacctgggaagcagaggttgcagtgaaccgagatcgcaccactacactccagcctgggcaaagagcaagactccatctcaaataaataaataaataaataaataaataaaacaaaaataaaattaataaataaaacaacagacatcttatcaagtttctggggctcagaagactggaaatgactcaactggggggccaggcatg

SEQ ID NO: 144782 - DNA, 632 bp, Homo sapiens
tttcctcccagaagtggcagaaacaattccttcccaccttcatcacaaataacactgcaggatggcctcaactcatatgcacactctcacacatacatgcacattcacacatacactcacgctcacacctgctcactcatgcacactcacacccactcacactcacaccctcacatatcctcacatgctcacactcatgcacactcacacatgccctcacatacccatatgtgctcacacttatgcacactcactcccactcacacacctcaatcacacgcactcacgtgctccatctcctgagggatgggtgccagaggtcataggtatcagagccagggaaagaaaagaggcacacgagtaaagaaacctcgcagaccgagcaggcatctgcctaactccctgcagagctgggctggaagagctatggaattcactttccactgctccatagaaggcgagtggtgtgacactgggtgggagcttggtcaccctcatccgtacaagctgtccccactgtcttctccctgtggcagcttgtcttctgggttggttctgtccctgtaagaaattccttagtagcacagtggtggctgcagacgccatccctatagtcaagtagattctccaga

SEQ ID NO: 144783 - DNA, 422 bp, Homo sapiens
acaggcatgagccaccgtgcctggcctgtttttttgtttttgtctttttaaataatttttaccagttatattgttgcacttgagtgggcgttagcagggttcctcacacactgcaaacctcctttccactgtgaggcattttggaaagatcggctttgccattacaaaagtgaatctctcctacttatctctgattaccaaataaatgtatactggaattaacattcctgcagggtaacttgcttaagcagtgttttgatgcagtattatttctgtccataggatggcatatttctggtcatgaggacaaaatcacttacaattacttctcaagactattctttcttaccacagtttaccttagtcttttatgctcttctctccaagaagctcattcattttttttatgtcctcttctggat

SEQ ID NO: 144784 - DNA, 491 bp, Homo sapiens
ctgtgcttgtcttccacaactagcttgcgggcaaatcaacaggttctccctctcgaccatccctcactcccacccctcctctgcacaccgtggctgatgctgatgaactgggaatagctgccccacgctctgtgctggcctccctgattccacagccaagctcacatgaggccacagcaagttgttcagaacacttgacacaggctctatctcagtgaaaagctcaaatggtcccacctccagccactgatgggccacagctcacagctgccgtggctgagcggctctttaggacgcatttccaggctgctctccttcttcagctgtgccctgagattcaggctaagcctcccccacaactgtgaagagcaccccctaccgctttcccatgcatgccacaaaaagccacctctgccagcctctatcttccccttccctcatcccattgtcctggaatcagctgtgcaacccactagaccaggtatgtttag

SEQ ID NO: 144785 - DNA, 316 bp, Homo sapiens
ccggcctaatctggctaaaatttaatgtcacagaattagggttagggttagagagaactctaatctttcaaaggatggatacactgaaaaccatggtttttgttttgatatgttgaggaactatatgcttctgtcagatttattcagttttattacattttggaaagatttagattaatgattaggataaatgatagttatcgaagaatcacagattattagcacaggaagggtgttatccctgtcaactgtcagctgggttcatgaatcattgtaataaatccctggtgcatatttgttcacatttgctttatca

SEQ ID NO: 144786 - DNA, 716 bp, Homo sapiens
cagggtaaatgcaaatgctaagaaatgtgttccacacttaaatattattgaagtgtctgctatctaccagttcgtatgcttgaatttggagtactaaagaaatgaacaagactagtttcaccttaagggagtttactgtcttctttaggagtataatctgagaagtcaggatgaggaaatattggagggctcctggagtgacttcggtacatggcacttgatacagaaagctcagggaggggtgaatcttaacagctctgcaaaaagaaagggaagcagctgaattagtaggccaaagggctaggacaagggctggtaaatttttctgtaaaggtcaagatagtaaatactttaggttttgtacaccacacagtcaacaatttctcagttctaccatggtagcatgaaagcagccattgattggccgggtgtggtggctcacacctgtaatcccagcactatgggatgccaaggcgggcagatcacgaggtcaggagattgagaccatcctggctaacatggtgaaaccccgtctctacaaaaaatacaaaaaaattagctgggcatggtggtgggcacctgtagtcccagctacttgggaggctgaggcaggagaatggcgggaacccgggaggcggagcttgcagtgagccgagatcatgccactgtattccagcctgggtgacaaagcgagactctgtctcaaaaaaaaaaaa

SEQ ID NO: 144787 - DNA, 429 bp, Homo sapiens
gtaaatgggaaatagcagcacctgtgggagatgcctggcaagaggggcaggagaggccggagggtgagaggctgcctgtgcaggccaaggacacaacctatgcaaaggccctgtggtgaatgagcttggtgcattcccaaaactagaagatactcaaagcaacagcagctgaatagctgcagagtccaggaggttacagcattaaccaaaacttagacataataaagctagtgtgacaagccgaccaggcgctgtggctcacgcctgtaacccctgctactggggaggctgaggcaggagaatcacttgaacctgggaaatggaggttgcagtgagccaagattgagccactgcactccagcctgggcaacaagagtgaaactctgtctcagaataaataaataaataataaaggtattgtgacaaatg

SEQ ID NO: 144788 - DNA, 805 bp, Homo sapiens
tgagttttcagaactctttcagccacggcttgtcttcaatctgtccttccaccaagactccctttcttggctctctatccatctcagcccagaaaacccaggcctgttttttagctcccttatagagagctaaaaaacaggcctgttttttagctctctataagggaggcagttggtttcaaaaaatgtacattctgcatctctcatgtaccatctaatgtttgtcttcctttggggttgttccagcagctgcttggtgttccgcaactttagttaactataatttttctaatatttttatttcattttttgtattttggcctgttatccatatggaactcattatcatgaatagtatacattgggaatcttttttcccccagaaaatatccacttgttccaatacgatttaataactagaagactcttttctcactgatttgaaatgccacttctatctcgatatttaaattctcacatctatatgagtgtcctcgtgttacatctctaatcccttgcctatgagaggacagcaggagggggtatgcttagggggaggtcaaccctggagatgtagacaggagcaatcctgagataaacagaaaggccctttgtagttggcctgcctagtaccgaaatcactgactaggaaacctccagaagccccactttacttctcttcatttctctaccacctcccccacaaacaagaaaaccaggtgtgtagctgattacccaagcccattgcatcacatctctcccaggagttgttcctttagcagctctactctggttgtctgatgaa

SEQ ID NO: 144789 - DNA, 809 bp, Homo sapiens
cacactgtgcttaaacgtaagataaatgaaacactcgaactgtatggctgcatttacccctctttgcacctaatgtccatgaatatctaagttcaagagagatgagctcagttcctaggtcatgccccagtctgtagtgacatgctcctgtatgtaacggaaatggccatgtctacaggaggtaaaatcacaccaacctgggaagaggaaaagccagtgaggggcagtacagcaggggcagccctctccactgaaggcaggttgtttgcctgactccatggcatttgtgtccattagagtctagaagaggtgttggcaaactttctacaaagggccagatagtaaatatttttggctttggaagctagatggtctctgtcataaccactcaactccgccattgtagtgcaaaagcaaccatagacaatatgtatacaaatggatatggccctgttccaataaaactttatttacaaaagcaggcagtgggccagatttggatgctggctagggggttgccaacctctattgcagaggacacacactccatcaacagactctttattaatggatgcaaaataccagcgttcttcttttttgctttttaacagaagacatgtgttcctggaaaaaaaaattgtttaagtcaaaatttgtaatttgaattctactttatatgtgttaggagggttggctacttaagtgagccctatagaaacaatctcttttctgcccaactgttaagggctaaattatatttctccaaacttcctatgttgaagccccaacttccagtacctgagaatatg

SEQ ID NO: 144790 - DNA, 393 bp, Homo sapiens
actcgggaggctgaggcagaagaatctcttgaaccccggtggcggagattgcagtgagtcaagattgtgccactgcattccagcctgggcaacagagtgagacgctgtcacaaatttaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactcagccagcccagcttgtgaatggctgccagactgctcttctctgagtacataccagctcaaccactttcagcagctcccctctgcatttaggatgaagcccaggctcagccttggattcca

SEQ ID NO: 144791 - DNA, 443 bp, Homo sapiens
agctccagctcctggatgcacacgacacagatgcatctcacagacatcatgctgagtgaaagaaggcagacacgaaatacatgcaaatgttcaaaaaaaaaggcagaactactctgtgatgatataagtcagagcagtggttccccaggagagggagaaggacaccctggagagagtcatgagggaaattttctggggtgggaggtaggaagggctgggggacctgtaaaagttctatgttgatctgcatggtggttaaatgaatgtctaaaattgtaaaaattcgtcttatggacacttaagatttatatacttacgcattttatttaggttactatcaatttaaaaagttcactaaccttaacatgtctctgtccccacagtggccaccccatgtccctctactcctgccctctttccccagccattcttgatcctgcagc

SEQ ID NO: 144792 - DNA, 396 bp, Homo sapiens
gagccaaggggaagaggctgctgtttctaaagaggatgtgatcgacagttattgaaggtgcttagctgggggctccactctagtcttaatctgagccgccctcaaggaaatcataaccagctcttaaaaacatgttgagaccaaagctggtgtgtgtgtttgagcggagcttcagacagctacttaacactgggggcctctgggcttttgattcctccacttctagcctgccatctccccccagctggctggtgcttatcagccaagacgttgtttaaatcacactcatttcctataaccatttcatttgaaatgccatcctctgctccagaaattcatctatcaccagcctaggggtatagttgaggagccttggggtgatcactccccatctct

SEQ ID NO: 144793 - DNA, 165 bp, Homo sapiens
ccccttgctcactctcttgctcctgctcttgccttctcaccatgtgatacactgactccccctgtgccttccaccatgactgtaagcttctgaggcctcaccagaagccaataggatgcacagcaccatgcttcctgagccaattaaacttttctttataaatta

SEQ ID NO: 144794 - DNA, 137 bp, Homo sapiens
accctggtctccttcttcctacataagattgattaaggctctcactcagaattaacctgcccacaccttcctgatggaatctcatccagagcagagggctaagtctatgaactcccccggccccaatcccctaacac

SEQ ID NO: 144795 - DNA, 594 bp, Homo sapiens
atagctgaacacatggaagttcctgaaggactctgctcagcccctcttctcccacaccttgctctgtgtatctttttatttggttgttcatctgtatcttttgtaatatcctttataataaataagtaaacgtatgtaaagtgtttccctgagttccgtgagccactcttgcaaattagtctaaccaaggaggggtttgtggaaatcccagtttattgccaatcaatcagaaatggcatctgaagtctgggacagtcatgtgggcctgagccctggacttgtggaatctgacactatctctaggtaggtggaattagaattgagttaaattgtaagacacccaggctgggcccggtggctcacgcctgtaatcccagcactttgggaggccgaggtgggcagatcacctgaggtcaggagttcgagaccagcctcaacatggagaaaccccgtctctactaaaaatacaaaattagcccgtcatggtggtgcatgcctgtaattccagctactcaggaggctgaggcaaagatattttgtttcccccctggaaggggtgtggtttgccatgagaccaaaaaccaccccctttgc

SEQ ID NO: 144796 - DNA, 240 bp, Homo sapiens
tggaagaaaactgtcatataagtagaccagcacagttcacacccgtgttgttaaacgatcaactgtattttattaagctgtctttgaatagcaccaagtatcttagtgtatgagaaggcctctgagaagttccacagttaggagaatcgcttgaacccaggaggcggaggttgcagtgagccgagatcatgccattgcactccagcctgggcgacagagcgagacgcaagactccgtctc

SEQ ID NO: 144797 - DNA, 255 bp, Homo sapiens
caataaaacctagttattgaaattatatcattatggaagtaactagtatgtttcatacaatcagaaaccattaaaggtcgacaaagttataataaaccatatgttagacagttatagctacaagtaataatatacacaacttgtcactagcagacaccaaaatttgaaagtgacctccatcagtggacactgagaaagtgaagaatctggcagttcaaatagggccacattcttatttgtgggtctttattttcc

SEQ ID NO: 144798 - DNA, 356 bp, Homo sapiens
aggagacgagtgtgcctgggagtttgtctggcatcccgggggctttgataggagttgtccgggaccccagggagatgagggttcagagggtggtgagggcacataggaggggagtggaagcctggctctcaggcctaggcccctatcctgccccagggcaggtccaggccctggaccccgcctagcgtaggctagtgtgtatccctggaaccagaagagagtaggtgggctctggaggcctcaaaggacccccgctagactctgtgatccccacgccccagaacatgcgtgggcgctatgaggcaagccaggacctgctgggcaccctgcggaagcagcttagcgacagcgagagt

SEQ ID NO: 144799 - DNA, 322 bp, Homo sapiens
aagcaattcttatgcctcagtcagccgagtagttgggattacaggcatgtgccgccatgccaggctaatttttgtattttagtagagatgggattttgccatgttgtccaggctggtctcaaactcctggcctcaggggatccacccgcctcagcctcccgaagtgttgagattacaggtgtgagccactgtgcctggctgccttgcgggcttttaggcacctcaatgtctagttttgtcagaatagcatcctagaggtcttagaaatcttacctgttggagaaagttttaaagtgccccaaacatcccagcagttgtacat

SEQ ID NO: 144800 - DNA, 216 bp, Homo sapiens
gcaactccaacaaggggctaatactccacatacggcttgcagggccagcaacaaatctatagagactagcagctccaacaatgggctgataccccacatacggcagagcacagggccagcatcacactgggtggtcttgctggtcctttctgcccatttcacattccctgttgcttgaagaggctgtcatagtgactgaagccaaggccagattgt

SEQ ID NO: 144801 - DNA, 579 bp, Homo sapiens
tcttaatgtagtttttagaaaatattcagtgagtgtgtgtggtaagagggatatatatacattgatcctagtcacctctaaggcttctttcaactcaaagattctgcagctccattgtgaaaggaattgaaaagagagcttactgaaaatactgttctcataagcctggtgtgaaagttagcagctaagcatgtggttaggagcggcagttttggggtgaagcaaaaagtgaagaactccagtgcaagaatataatgcatttttggatcattgtgttggtggtagattatctaatgaaaatgataagactgaagggtttgctgtcaaagttacttagatttcataatggaatgtcttctcaggaggatggaaactagagtccatgttggccttacaagtcttctctgaatattccagaaactaatagttaagattctttcaaaaaggtaagttgatagatgcccacacagtttctcctctagactgtgtcacagatgacaacctcataacctctacctgttgtcctggttctaccatttatttcaacacagaatacacacacacaccacacacacacac

SEQ ID NO: 144802 - DNA, 421 bp, Homo sapiens
gatgctgagcatgaagacaaaagcctatcgaatggggtgtcagaaaagaaacatcaaaatatcgaggatggaaactagagtccatgttggccttacaagtcttctctgaatattccagaaactaatagttaagattctttcaaaaaggagtaaagcagagacattcaaagatgaacagcaattctgaatggaaagaggccagctgtaaaacgtcatagaagacctgcagtagagatacaatcctgagaagaatatttagcaagaatggggtttcagatttctggtatttccatatgggtggagattgaagaaaaaaaagaaaagagcaaaagttttctcataatgttttgcaacttctgcttccgggcccagtcagagcccaaaagcagcaagagaagtaaaatgaaaacactgaacattt

SEQ ID NO: 144803 - DNA, 508 bp, Homo sapiens
gtaggatggctgaaatgtatatgtgctccacatctctcccctggaaaggtgaaaaacctgtactgttgcacagagcttgggcacagtttagtttaacacacattcatcgagtattgaatcataattatactatttttgtctgtggaagagatgccacaaatgcattttttatgggctataaagaaagccaatgtcaacaagaaacctaaaaaaaatgtgtttgtgttcattcaggagtaaagcagagacattcaaagatgaacagcaattctgaatggaaagaggccagctgtaaaacgtcatagaagacctgcagtagagatacaatcctgagaagaatatttagcaagaatggggtttcagatttctggtatttccatatgggtggagattgaagaaaaaaaagaaaagagcaaaagttttctcataatgttttgcaacttctgcttccgggcccagtcagagcccaaaagcagcaagagaagtaaaatgaaaacactgaacattt

SEQ ID NO: 144804 - DNA, 206 bp, Homo sapiens
attaaatgttttatgtaatttattatgttttgatttgcatgtatctggtatgttcatggtgagagagtggggagacagagtctcgctctgtcatccagctgggagtgcactgacaccatcttggcatcttggcacactgcaaccccttccccccgactataacagataattagctctatatcgtctacaaaaacattttttttcta

SEQ ID NO: 144805 - DNA, 545 bp, Homo sapiens
ctgactttgtagaactcaccttcatcagcgtggctccacacaagctgagctcgcacagcacgtaacctacggttagctcccgatcgatttctgagctctctgtgctgtggagaaccccttgtggaagtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgccta

SEQ ID NO: 144806 - DNA, 579 bp, Homo sapiens
atcaaggcttccagccccagttcagcataaaatccaggattggctacacaaccaacacaactcaaagttgattggagcagaaccttccttctccccaacaggtcctagggttagctcccgaagagttctgagccgtggctggctggagtgcacatgagaggtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgccta

SEQ ID NO: 144807 - DNA, 719 bp, Homo sapiens
ctctgccctgctccttgctgccaccgtaagaaggatgtgatatcttcaccttctgccatgattgtaatttcctgaggcttccccagacctgctgacctgaccctctctgcagtgcctggcatacagcagaaactcgctaaatgaagtctgcgtgtttcatatacgaataactgattgtcatgaccggaggtaaactgaacatctgaaaaggacctaattaacattgtgcgcaagtgaaagaataaatgaataaatgaataaaagaatgaatgagtacggatgctgagaactgagatgtggcatttccatactggcagaagctccgaaagaaacagtcatcacttcctgtcctactgcacgcaatgtgttaggcagtgctttgctgaaatccagaatataaagttaaactttatgagttaaaagtttgaacttttgagcgagatgtaattaagcacaaattagtttgtagaatcctaaatgtcagtgcatctaaacaaagtacatctatgtttatttgaaagcaaaaaacgatgacacatttttagagaattaaaataaactgatcattgaaattgaattaatttttaatggtaaaattaatttgagtgaagtagaaagaatgcggctcataatgttttattgatgatgcataaaaatgatcacaagtcattactcattcacttgaaagccagcgttcttccaggagaataaatttctgt

SEQ ID NO: 144808 - DNA, 241 bp, Homo sapiens
gaaatgattcctccaaggcctcctcttacccgtcggacaggaggagctcagaaggcaagtgccaaagccaagttgaaatgataagtaataagatattgagtgcatgcacttgttaattgcatggactctttaatatgtcttccagaaggggtgaaaacttgtttgaagctttacgtattttcattgctggttccatttgtgatcaatggcatatagcatacagtgtttaatctttggctgg

SEQ ID NO: 144809 - DNA, 251 bp, Homo sapiens
tctccttgcctgtctctgggtggtgtgtaccatgcctccagtatggccttgggtgcatccgcttcctgccgtctctgcccaaaggggcctgtgaggaccacctgctctgtgcccagaagggcacggtgacctctgcttgggctgctattccagctactctttcagaagcaaacctaagctgtggtagagttgggcctgaggggatcactctagaagtcagaccatgcaggcgatgcagagcttgcgcactg

SEQ ID NO: 144810 - DNA, 189 bp, Homo sapiens
tgattagcacagtcggccagggacaatataaagtgtatgcatctatgtgtttaccatccctgatgaaggcattaaggagttatcaaaggttttggaggaagggaatggcatgatccaacatgtattttacttgtatcattctggcagtagtgtaaagggtcgagtagtagatagagtaaaggatagagt

SEQ ID NO: 144811 - DNA, 102 bp, Homo sapiens
gaactgcctgttgatagaaacattgtctgtcggctccatggtccttgaccacatgacagccttcaaggacagatgtgggataaggaaataaataacagctgt

SEQ ID NO: 144812 - DNA, 199 bp, Homo sapiens
cctacggcttctaaaaccatcccgtgcagactggctccctagactccacgatccccgggatgtccacccctgccctacacagcaattaggggaaggggtctcaagcacatccaagtccttcgaaggctccgcacagtgacgaagagcctgtcaagcccctcctcagccacgcttccgcacgagacacagtctctagccc

SEQ ID NO: 144813 - DNA, 340 bp, Homo sapiens
ttgtattcctgacagctcagcctcctctaacttctgagaagttctcgctacctctggataacagagcgaccgtgtctggacagattactagctgcgaatctgcccaacactgaaactgacttcatgctgcaagatcactggtgtctttttgctctcattcttgcgctgggtcctgggccgtgacttccaagctccacaggaccaattctgctttgttgaggaaagcaccttctactgcctaagagatgtggattccactgtttacttaagcccttttctactggaaacagaaaggagatctgcttagaaagatcagtaatactgaaactaggaggccatg

SEQ ID NO: 144814 - DNA, 898 bp, Homo sapiens
aatgattctcctgccccagcctcctgagtagctgggattacaggcatgtgccaccacgcccagctaattttgtatttttagtggagatggggtttctccatgttggtcaggctggtctcaaactccctacctcaggtaatccgcctgcctcggcctcccaaagtgctgggattacaggcgtgagacaccacgcccagccctctcttacttttaatgtccccattattgtggctgaagggctcagaagccctctgcctctgagtaggacaccctcctctccttccctcccctgcagctgggtctgggctgtcctgttctggcgtgagtggtttcttctggccctgcctctttatctagtagatttctgccactgagttttccctgggacagccacatgggcacagctgtctcccaggcagcactaggggaggagatcaggctcccagctcccccagcatgacacagagctggcgggaatttcaacaggactttctgaaaggtgagggacaacaggggccccatgtcactgtggaggctggcactcttatatattcatgggtcaaacccactgtagtctctgaagtctggcacatgctgttgtacctgagtgtcacagtcacaggctaaataagcccttttcttttacaaccttcccttcagtgagggctgagggaaattcacatcttcttgctttcccctccttcccttgatttccccaggacagccagctcttcttggcttttactgccccggagaagatgcttagacatacaggcctgcatgtgtgcaccgccccccacacagtcacacattcacacacgcatgcatgtgctcacacgctcatgctcattagcgcacacatgcacactcacattcacacatgcacctcccacacatt

SEQ ID NO: 144815 - DNA, 251 bp, Homo sapiens
aagtgtttaacccagtgcctagctcagaaagtatcagtgttgagtaataaaactaaatcgagcactgacagagactctttttgactaaatgttagccaggctcctctgagctctcttctcaactaggcattgactttggctctatcctgctaagagagtttggagtgaatccacacccttgacatgagatcaaattactcatcctccacctttgctgtctaagtcattggcctgttttcaggaagaatcct

SEQ ID NO: 144816 - DNA, 709 bp, Homo sapiens
aacagaggttgcctggggcaaccctgggaaggtgaggccctggatttcctggtctggcctctgagaacctcctagcaccccagaactcccagacagaatgttaggtaatgccaatgagcacagatcaatcatctgcacaagtaagtccttctggggttcctattccagacactctggcactctgagctcccccatccaaagcttctttccgttcctcaaactcaccatgtggtctcttggctcttagctttcctacccaagcccccaactccttgaaattctcttccctcttcttactcacaaaatacctattcattcttcagacctcggcttaaaggtcaggactccggcataaatgtccctgatccctgaaagtgtcagaaacctcagaaaagagggccagacatggtggctcatgcctgtaatcccaccacttcgggaggctgaggtgggtggataacttgaggtcaggagttcaagaccagcctggccaacatggtgaaaccctgtctctactaaaaatacaaaaattagctgggcgtggtggcaggcgcctgtaatcccagccactcgggaggctgaggcaggagaattgcttgaacccaggaggcggaggttacagtgagccgagatctcaccaccgcacttcagcctgggtgggagagtgagaccccagaaaagatgagatcttatttctccctcacatagt

SEQ ID NO: 144817 - DNA, 797 bp, Homo sapiens
cattcgccccgagacgccatgacctccccagacatagccccagggcgcactcgacctcgaggtggcttgggtgatgggagcaatcgagagccaggagacgacctcgagacctccgcccgcccattcagcccggcccagccacagtccaccgagagacgccctagatgatggtcctatccttcccaaagggtggcaaggcgcaggatcgcggagggtctccctccttgtcctgaaaggttaagaaattgggcagatgaaggtatttaaaagaggcctagagggccctggggccgaaagccctatcaacctcacactccacccaaagtcccgcgtttgcacgtgcacacctccttctccccatgcagacccagggggtcgcgcacgtttgagctcagactcaagctgagtcacctgactatgcctggaacgtacaggcaatcgtaccgaatacacatgggagaattaaaggaacactacgggagaattaaaggaacactaacaggaatttgaggaataaagaagtgcccacaggcataattatttgaatacacgggtgcacaccctgttgtccagatgcagacaaaagccacagtgcctgcgaggagtgaccccaaccacaagggcagatgtacaggaagccgtgaacgggagagttcgccgaatgaggacgcaggccgcaaggccaagggggcttcctgctagagggacgttggctcggagggagaaactttgttgagccgactgggtgaaaggtttcaggtcaagtcctggccactagaaagaaccaaggcctcatc

SEQ ID NO: 144818 - DNA, 816 bp, Homo sapiens
cttccctagatttttaattgtgatattatgatgccgattttagaccttttctgctttctcttgtgggcatttagtgccataaatttccctttgcacactactttagctgtgtcatattttaatttttaagccctcaatctttctttttcatcatgacagtcttgactgttttatgtttatgaaaactgtaaaattgtctacacagtttttacaaagactttaccaaaatattttattgagaatgtacaaacctgtcagtcaattaggggagaagttgcattgtagtaataaatagccacaaaacaaaaccctgaaggacatccaaaccagaataaaacaaaacattttaacaaagagaaaaagaacaatctcgcaacaaatatgtgcagtttatatcacaaagatgttcacatctccactttaaagagagcttttagaagttgatttaaaatatgggaaaagacattatcccacaccacagaaaaaataaatttaagcagctcttaacacatgaacgtattatcaagctcagatggaatcaaaattaaatatttgacaacagattctacagtttgagagaaatagaaaagtgtttttttcttttctccaggtccacaagtctagtttcttggactctctcactataatggaggttgtcatcagctccccaaaataagggaagcacagagcagatggtggctgaaggtggggaatcctgtgaaatcatatttaagatcatagcccgtggtccattgtattgtaatcagctggctcaggaaagaagatctggatctcctgagctctacacctactgca

SEQ ID NO: 144819 - DNA, 874 bp, Homo sapiens
  misc_feature (5)..(5): n is a, c, g, or t
  misc_feature (13)..(14): n is a, c, g, or t
gaccnagaggatnnccaggacagtcttaacacattgaatatttattataaatggcctcaatattttagggagccaacaagtgaaaatatgcaaatagattaagcagatatggctatttttagtcacccttttaaaaatttctacattatctgggttatttttctagtctcatggttaaatccgagatagttaaatcagatggttaaatcctattaaccagaatgataacattctgtcaactttgaaaagaagataaaacagtattcccattcacagttctttttgagcaaaagacaagggatatcttgactagtataaaaaaattcctttctactggaatatcttattcaacattgatgatttgggctggggttttcccccttggattgtgcagtataatgcatatttggcaaatcatgattatctgacaagtcatataatattgtagatgacttttctttttttaagaagctcaattttttgagaaaagtcttctacaaatttatttcacaatccaaacctttttttttttttaactgtttttgatagtaaaatttagctttggcaatcatcaggaaaatttgaatactacagaaaccaggatgttatatcgttcattttgttattacagaaagaagagttaatgattcccagagttattcctttattttgttataaggatacttgatggtataacaacagcaacaacgaaaaaggcaagcacttttgtattataactttgacaccatggaaagctatgagcctttgaaagttctaggagtgttcagccaggactactgaattcttgtgactactactattgtgtatgttaatttaaacatattttaagactgtcctgtattttctcatttct

SEQ ID NO: 144820 - DNA, 468 bp, Homo sapiens
caccccacccccaccagctagcagctccaccacacctgtggccagctcgccttgggaaaccacccatgccatcatcgtgcatatgatctaatggctttagagaactaggaacagagttattccccaacaaactgactgggaacctgttctgatgagtattttaatttgtgtgataaacaatcattttgagaggctggggtttgccatttccccttccaagaggaagtgcctttacgcatttgaaacttgacatgccatgaaggtatttttggagggcaggggacatttgggaagtcatgcagattacctaaggcaagtgatacttgcgtttatggtgcgtggggaatctgtaggcacagaaatgagactcagcagcagaggacagacagcacctgcctgccttctggtggaaactcagtggtgacgggagctttgctcattgcctttttcttgtgggggtaggagctg

SEQ ID NO: 144821 - DNA, 233 bp, Homo sapiens
gtgcccaaacgtatggctctgttagaggtgagtcctgaatgcaggccagggctggccattcctacctggtctggttggctctgtcaaagagtctggactcaacccaatggttgtagagagctactaaggatttaaggaggaaagtaagacaactctgtttgtttttgagcctcactttgacggctgtggagaaagctctggatgaatgggggcaagagggacaatgaaacctg

SEQ ID NO: 144822 - DNA, 828 bp, Homo sapiens
gcctcccgggttcaagcgattctcttgcctcagcctcccgagcagctgggactacaggtgtgtgccaccacaccggcctaattttcttttcttttcttttcttttctttttattttttgagacggagtttcactctttcgcccaggctggagtgcagtggcgtgatctcagctcactgcaaactccgcctctcgggttcaggccattctcctgcctcagcctcctgagtagctgggaccacaggcgcctgccaccacgcccagctaatttttttttttgtattttttagtagagacggggtttcaccctgttagccaggatggtctcgatctcctgacctcatgatccgcccgcctcagcctcccaaagtgctgggataacaggcgtgaaccaccatgcccagccacgcccagctaattttctgtattttagtagagatgggatttcaccatgttgcccaggctggtcttgaactcctgggtccaggcagtctgcccaccttggcctcccaaagtactgagattacaggcatgagccaccgggcctggccccacggtgtgactttgacctcctcatgggaggaaaaagcaggatgaagcggggatgatgtctgtcggtcctcagcaggagcatctgccaacgtctccacattgtggacctgagattgttctccggaagctgcagtcggagcatcgccaggcccagccctgggtcctccacccgggccactgcctctcaggcggcctctccctgcccgcctcgggccacaggggcagtgcacctggtttgcaggccttaggttgtcctgaacataatgtttattcgccc

SEQ ID NO: 144823 - DNA, 814 bp, Homo sapiens
tagtatgaaaggaagacttttttagtgctttttttttctttaaaataaacatgatggcatattgtacatgtacatttgtaactttatcttctgtttagtatcaatagctgtataaaccatcccatagtttaaaacatagactttaaaaccaaactagctgacttagattctgatatcttctaacatttctaggccctgtttggtttttgttttgttttgttttgttctgttttttgagatgggatctcactctgttgcccaggctggagtacagtggcctgagctcggctcactgcaacctctacctcctgggttcaagcgattctcctgcctcaggctcccgagtagctgagatcacaggcacatgccaccacgccaggctaatttttgtatttttagtacaggcggggtttcatcatgttggccgggctgatcttgaactcctgacctcaggtggtccacccacctcggcctcccaaagtgcagggattacagatgtgagcaacatagcaagacccagtctcaaaaaataaatacataataataataaaaaaaagagaaaaaacaagaacaaacagagacaagaaaagagacgagaagaaaaaagaagaacgaaagaaaaacaaaaaaaaacaaaacaaacaaaggaggagaggacaaaacaggaaagaaagacaaaaacacgacagaaagagaaagagaccaaaagaaaagacaaagagaaagaaggaaaaaaaaaggaggaaaaaaaagaaagaaagaagaaaaactacgggggcgaaaaagaaaaacaaaaaaagagaggaaaaagaga

SEQ ID NO: 144824 - DNA, 238 bp, Homo sapiens
acagctaagaatggaatgcctacagattaatgagcagccataacagattggttctaggtctcatagtggaagaggcagaggttgtcagggccctaattacacctccagttatggtacaaattctaagctgtctaacccctctgaaatagaatctgagggtaaagacaagctgagtgattggtcattgaagaagatgatcgagacagccgacatcagcgtgacagcaggagatgcccag

SEQ ID NO: 144825 - DNA, 149 bp, Homo sapiens
ggctaaatcaatgtatggcttgagtttggagaaagaatatggtcaatgacatcccgctttcagatgcaattaataaacagtggttaaaagcacagcaccactggctgggtttggtggctcacgcccagtacttggggaggccaaggcag

SEQ ID NO: 144826 - DNA, 350 bp, Homo sapiens
gtgatctgccggccttggcctcccaaagtgctgggattacaggcgtgagccaccgcgcccggctgaaatctagagtttctaaccctgaagttgagaactcctgaggaagtcagttggaagtcattctctattaattagagaagttacataatcagattttattttttttttatttttatgtctattttttgagaaaagatctcactgtcattcaggctggaatgcagtggcacaatcacagctcactgcagcctcgacttcctgggctcaagtgatcccacctcagcctctcatgtagttgggactgcaggtgtgcatcatcatgcctggctaatttgttttgtgtttgt

SEQ ID NO: 144827 - DNA, 294 bp, Homo sapiens
gcggccgcctactactactactgctcgaattcaagcttctaacgatgtacggggacatgaaacatcacctctaggctggtctgaatggcagtgggatgtcagaactaattaaccttagtgtcactatagttggcattcgacccccacactgctaaatttgactgccttttttaaaagtgaaaaaaatacatatatcttgagacagcctggcactccaggcggaggttgcagtgagccgagatcgggccactgcactccagcttgggcaacaagagcgaaactccaccccaaaaa

SEQ ID NO: 144828 - DNA, 341 bp, Homo sapiens
tcccagtccatcgcctttttggtatctttatggaagtaaaatgtggcaagctttttttcagcctcaaagactgtctcagagtaaaagtttaagaagtactgctctaaataattttattaaatatgccttattagatgaggaaaactgaaatatttttatacaagccttttgctgtagaacaatgggacagaataaaggtagctcacaaaataagggaacatttcttgcttgttcttttttttccctccaaattcttctgtacaggtccagatagatgagctatgtttcctttctattaactgaggagagagagatgaaaggactggagcatgtcatcactg

SEQ ID NO: 144829 - DNA, 346 bp, Homo sapiens
ctaaataaatactgctgaacagttttgcaaagcagttgtaccaattcacactcccaccagcagcgcatgagggtcctaaggcctctttgaactccgtctattaactccacagttttgttgtacatatgtggcaggcttggaatgttagcctgggaagcctactgaacaagacccagctggttccctgacccccaaaagcagacagtccggtagaggggttgcaggttggttagatcaacacacaacgctgtaatcacaaagccttaaggaatgctgtggagcttggagagcacatgccaaggggagccccagaggaatttccagaagtgatgcttcacccaagacc

SEQ ID NO: 144830 - DNA, 263 bp, Homo sapiens
cacaggagttgccagcctgtggtcccagctaggagatgagctgtggtctcaggaggctgaggtgggaggattgcttgagttcaggaggtagaggctgcactgagccattttcatgccactgcactccagcctcagtgacagactgagtccttgtctcaaaaaaaaaaaaaaaaaaaaaaaagatctaccatttgatccagcaatcccactacagggtatctacccaaaggaaaagaagtcattatttcaaaaaaagacacctg

SEQ ID NO: 144831 - DNA, 266 bp, Homo sapiens
tcctgcctcagcctcctgagtagctgggattacaggcgcccgccaccatgcctggctaatttttgtatttttggttgagacagagtttcaccgtgttggccacgctggtctcgaactcctgatctcaggtgatccacccgtcttggcttcccaaagttctgggattacaggtgtgaccatgcctggcccagtgtggccaaagttttcaacagaaatagttttctctttttcttgaatgtgtggaagacctgagagcccatgaaccc

SEQ ID NO: 144832 - DNA, 355 bp, Homo sapiens
atctagaggatacctctcagtaggtcgtagctgtatacatataaataatacaatgcaaagagatgctcaatcagattatgcaccttttccacgttattaccaggaagatgcaacaaggtttgaaagcgagcccaaaggcagctaagaactttgtatcacagtgacacctagtgttaatttcactgggttgttaatgtttttagggtccttattgcagtttcatttcaatacccaaaaccttctgaattctgttttcttatcttgaataaatttaaagaattattttaaagcatttgtcctcctataaaatggtgtctgatgtgaagtattgtgatctctttgaggaggttacatg

SEQ ID NO: 144833 - DNA, 352 bp, Homo sapiens
ttttaattaggggaaaaatgcataatttggatctgtgtctccgcctggatctgtgtctccacccaggtctcatgttgaattgtcatccccaatgctggcggtggggcttggtgggaggtgactggatcatgggggcagagctccctcttggtgttggtctcatgagatctggtcacttaaaagtgtgcggcaagtccccccatatcgcccccaccaccaccgccagccatgtgaagtgccggctccccctctgccttctgccatgatggtaagtttcccgaggcacccccccggaagccaagcagacgccagcatcacatttcctgtacagcttgtggaacagtgagacaac

SEQ ID NO: 144834 - DNA, 228 bp, Homo sapiens
  misc_feature (28)..(28): n is a, c, g, or t
  misc_feature (31)..(31): n is a, c, g, or t
gtggggtgtgatgtgccatgatgtggtntgnaggtggtgtgtagtgtgcctttccttcctgaactgttaaaatggggatcaaatgttattagttcctgcctctgaagcccttggggcagtgccaggcaggtagccagtgcttaggaaggcttaggtctccacttgtgtgactctctaccctgccactgggatcttctctttaaaacatcaacctcagctgaaaaccct

SEQ ID NO: 144835 - DNA, 564 bp, Homo sapiens
ttcaaagtatgtaagtcagaaattgaagaaactggtgaatccactaccatattgtgaagttttagctcacttatttatagatcaagcaaatgaaaatttaggaaagacaagacaactaataaaataactaataaacttgatctaagggcaattatatacatacataattggccatgtacatatatatacagatatatatatacataagatatatatacagatatatatacacagatatatatatatatataaaaccttcagttattatacatgtttccctccagaactcatgaaatagacctccccagtacattttataaggctagtatgatcttgatgccaaaaccaaagacaacttggggaagaaaaattataggtcaactttatttataatttagatgcaccagtctcagtcaaaatatttacaatcaaattcaacaatgtttgtaaaatacaacacattataaccaagttgggattgaagatcaatttaaaattggaaaaatatgctgatgtatcaaaaacctaagatcacaccaatagatgcagaaaaaggattggaaa

SEQ ID NO: 144836 - DNA, 348 bp, Homo sapiens
ggtgaattttcaaggagaatgtagctcaggagtcatctatggatagcagtgagacactcacctctttttcacctctggaaactttccaccatcacctcctccacccccagctctctcagagtaacaacaacttctttaaagagcccagcaaagttatttcttcagaggttgtttgggttcatcccatcatgtcctaatatttacattttggatacaattggtgaatattaatattttttccaaagagctcaaataaaatgtttatttcatgtttaaagtgaaataaaaagaaaatccctcaatgagaagagtccctagaggaacatttgaggtttgagaatattgcta

SEQ ID NO: 144837 - DNA, 253 bp, Homo sapiens
ccggccacctggagcaggcggggagcgtctctagggctggattcgagccttgtgcgggccagatggaccaactctagaccaaaggccacttgctggggctgaggagacgctgtggcagtgccaccaaatacagctgcttcttgcctctcctggctgctcccatccagatgggtccagaagggttgtccctgcagaaggcgctcactaaggactctttaccccttccctccttgttcagaactgagagagagag

SEQ ID NO: 144838 - DNA, 334 bp, Homo sapiens
acggagcatttaaaggggaatcagtggccaggtcttagaatagagagtttcttaatttgggtatcccaggaggagaccttcagacaagggttccagaaaaagtagcttatatgaaaggcgcaaggaagactgagagggggtagggaactgatataggaaaataaaggttgatcaagctaaccgcccctggaggtgactggcctgtgaccctgctgggggcctctaggcggcagtgtcaagcacatgcctcagactcatctccccaggcttccaagggtgagggagctcgggtgtatatatttataatacaccaattcccaacagtcagtggttg

SEQ ID NO: 144839 - DNA, 302 bp, Homo sapiens
ctcattgccaaggtcatccagaacctggccaacttttccaagtttacctcaaaggaggactttctgggcttcatgaatgagtttctggagctggaatggggttcaatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctct

SEQ ID NO: 144840 - DNA, 508 bp, Homo sapiens
ctcattgccaaggtcatccagaacctggccaacttttccaagtttacctcaaaggaggactttctgggcttcatgaatgagtttctggagctggaatggggttcaatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctct

SEQ ID NO: 144841 - DNA, 309 bp, Homo sapiens
tctccctcagcctcccgagtagctgggactacaggcacccaccaccacgtccggctaatttttgtatttttagtagagacggggtttcaccatgttggccaggctggtctcgaactcctaacctgaggggacccgcctgcctcagcctcccaaagtgctgggattacaggcatgagccaccatgcctgggctgggggtaggacatttctagaaaaaaactgggttgactctttagaaggtcagggatatttgaaaaaatgggattgttctcatttagaaaagaaaggaaacaaaacaaccaaatgcagt

SEQ ID NO: 144842 - DNA, 767 bp, Homo sapiens
cacctaccaggtctcacccacaggatcattacaaatgcatgagaagccagggactggtctgtaaagcagagatagatttcatagtctcacaaggattagattccaagtccacctggagggagaggcctgtccaaatccttaagcgtttaaaaccaatcttgagctgaaactacttaaaactgctctagccccaacccagctcaactcctaatgatatcacaggtcagctactcagcttcgctacctagtagagaatacagtatgttcatcctagtgtgaaattttctactttgatttccactgttcttatacgcactatgtctaagaagcaagaaatgatgacacataatctaaagaagaaacaatcgatagaaaaagaccttatggatcacccaagtgttggaatttagacaaagactttaaaattccatgaaaaattttctttatgttaaagaaaaacgagaggcagaatgattgagagaatagaaaatttgagcagagaaaaaaagtaacaaaatagaaaatctagaactgaaaatatatccgaaatgaataaattgttttatttgttatttatttttgtagaaacaggatctcatggtgttgcccaggttggtcttgaactcctgagctcaagagatcctcctgcctctgcctcccaagctgctgggattacaggcatgaaccactgtgcccagctgaaatgaataaattggataggcttaacaaaatggatacaacaaaatggatacaacagaaaaaaaaaa

SEQ ID NO: 144843 - DNA, 844 bp, Homo sapiens
aaaaactctaggtagaacaactaaacatgagcctaaagatagtttcaagtacaccagatgctagaaatatatttatatagaaagtgaaatagattctgaaatataataaaggtgctcaaagaaatgcaggaaataaacagggtctttcttaagactgcatgctgaatgaaaattatatcccaaattaacttgatttgtcatataggttgacaagtaaattttattctaaactccattcattttgagaagttagttcttattgaagcctaacaatctgatttgaaaaaagaatcattctttttttaagtttaaaacataagaaaaattgattgaaaatttttccaaatgccaaatatcattacttatataatttgatatttatttataatccacttacttataatccatcatgcgtatatattttagaagggttataaagttacattgtttaagttaaataatttgttaactttgaacaccctttttcctcaaaactataaaccttttaagtcagtaataacagagatttccacagtgatgtttctgctaatgaaaccaagtgaatcgagttgaccatgctctctcaaccttttgaatatgcagatatttacagcaaataatgctctgtgtttaatagcgagcccttggagcctttgccttcatctttcatttaaattggctgcacacattccctagaaatgataaactgtcaaatgcatcacgagatgtggggcttggggttaatttatagaccggtggcttctacactgagtaaagcccctttttttaaaacgctcactaacctttgggaacccccgcgaatgtgccctcttgggctcccata

SEQ ID NO: 144844 - DNA, 241 bp, Homo sapiens
tgtggcctgccacctagcacctccatccagcacacggccaattgccaagggctcaaacaggctgactggtcgccatggggtttagttttccctcaagtaagcaccttctcccagtgagcctgtctgatgtcagcccaaagaagtacaggggacaagctctgctgcgtgtgactgggcagcccaaatgaaggaggtgggagcacaggcctgtagctgaccaccagggtcccatctcaactcc

SEQ ID NO: 144845 - DNA, 585 bp, Homo sapiens
gggtgatctagaggatttcggtattgagtggctgtgagctggggaagatgtgtgtcctccaccttaccctgcagcattcactgagggccacacgtgctgaccctaacaattgctgcagaccctaacaattgctgggccattcaatacctgagcatgagccagcaagagatgatgtgaactggctcttcttctgtgtgtgggtagacaagttccttacctttgctggcctcagttttctcatacgtgaaatgtggatgccactcttcctccctgcaggggttgtggtggtgctctagaaaacacaacttgccttcctctccgtgcctgccctttctccagcatgctcagagagtgcaaaggatttgccaaagaacagtcatttcctgttttttgtttgtttgtttttgagacagcatctcactctgttgcccaggctggagtgcagtggctatgatcatggctcactgcagcctcaacatccctgagctcaggtgatcctcccacctcagcctcccaggtagctgggactacaggcatgcaccaccacaccaggcttccatgtaggcactcacatggccactaata

SEQ ID NO: 144846 - DNA, 305 bp, Homo sapiens
ttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccactgtaaca

SEQ ID NO: 144847 - DNA, 170 bp, Homo sapiens
ttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctgga

SEQ ID NO: 144848 - DNA, 286 bp, Homo sapiens
tagcccggtgagtagattcctctcaaatagggacgattctgttactttaaaaagcactaatcaaacaccagaattgagtccaaatactttaccgggacacccacgggaaaaatgcccaaccatttttccatcatggcacacatggacggtgataacactgtatttgtaggcacgctgaagataaaagagaagaatggctgctgcttgaggccacctggccaggactgctggcaaccccaggccacacttgatgtccaagagagaggaatctacttcaccgggtcct

SEQ ID NO: 144849 - DNA, 273 bp, Homo sapiens
  misc_feature (273)..(273): n is a, c, g, or t
tagcccggtgagtagattcctctcaaatagggacgattctgttactttaaaaagcactaatcaaacaccagaattgagtccaaatactttaccgggacacccacgggaaaaatgcccaaccatttttccatcatggcacacatggacggtgataacactgtatttgtaggcacgctgaagattcaccccaaaaatggctgttgatttagaactcttgataactgctagtatgactctgagacctggtttgttgttcacgtcagaggaatctan

SEQ ID NO: 144850 - DNA, 383 bp, Homo sapiens
ctcgtggtgtaaataatttcttaattatgcaaaaaattgctttcttgggtttgatatatgcatttataggccgagttttttactcaaaggattaaggtatttatccatctcaatctgggaatatccaaaatactcattaaacagttctttgtaaatgcctgatgccacaggccccattctgataatatcatatttctctatacctcacacttaggctagacaagaactgtaatgagggataataattgaccagatgacattttacaaaagattcaagtttcttcttcttcattccttttttttaattgagtccagtaaaccgtatgcgaagcactgtgttaaataccttgatctaccctatctcagtggtcctcgactgaatc

SEQ ID NO: 144851 - DNA, 188 bp, Homo sapiens
agaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagt

SEQ ID NO: 144852 - DNA, 551 bp, Homo sapiens
cttcctatatgctaagcctcttcctccatataccttagcacatcccaagtctcttcctctcctcctcccacccttgtcaaataggtcaacgttaagatacacacacacacacacacacacacacacacaaaacaggcacactaatactaacaccgtgtctcctgcatcatctagtgaatgtcttggtcattttagcatcattatcaaagtatgactttaatggctacttgccatgcctgtgggttggtgtgtagcgtatttaactgttctcttagttttagacaactgatttattaggagggcaaatgttaactttctcaaaaactcggtagatggttgtgatgtgttgaattgctgttacatctttacctgtttttttctcttttcgctttgaaactagtgctgcagtgaacagcttcatgcatggaatgcttttcatttgaactatttccttaggataaattcttagctgtgggaagccttaccaacgggtttgaataatttcatgctcttgaaacacattgcccagttgccttccaagacagcgctac

SEQ ID NO: 144853 - DNA, 713 bp, Homo sapiens
ggatttgaggtcggtgaagcagagttcagacctgtaggggacttcagggatgacagaggaatctgtgagagccgggggagacgggctgtgctcacagccagtgatctgtcccattcacctgggaaagagcacacatgattgaacaggaatttgagcataagatgagaaaatgtgttggctccttagcgctggtgggctgggatggtggccacagcacacaggggcacctcattccgcaggagccactgcagaggagaggagggacctgagggcttgcgccagggagggaggacagtggtccagaaagcatctggcaaaccccatggtgggagggtgaccagcgagacccaggtggggtgagctgaggtgctgtgagtctcagcccagtgggaaatgtgcggctttggggacacatccttaagaagcaagcaggtgactgtggccagggactccatgtgggaacatggcccaggaggggtgcagagctgagggagaagtttggctcagcaaacctatgggaaaatagcctgagagggttccatgtgactgccggcggtatgggcggacagtgggccctccagacccttcggaaggaccaggtgaggtgggtcaagtgcaccagcaggggaaagcagttttccagttcacatgtggaggtcttcccctccccttagctgcaggaaggatgttacggctcaggatcccaggccagg

SEQ ID NO: 144854 - DNA, 236 bp, Homo sapiens
tgaggttaaaaaaaaaaaaaagtatgaaattcactgagggggtccctttcagcatcttaaaagccacagccaattacagcccagatgtcttttttcttttttaaattaatattacttttaattgacaaatcataattgtatacatttatggagtacaatgagatgttctgatacatgtttacagtgtggaatgactaattcaagccaattacacatccatcaccttatctttgtga

SEQ ID NO: 144855 - DNA, 300 bp, Homo sapiens
tgactgatttcactgcgtggctaactccactgttgcctgactccagctgcgtgacttcagctgtgtgactccatgtatgtgaccctagctgtgtgactccaactttcagttgccacgaagacaaccagctgagtcaggagtgggcctccctttcaatgtttttagctaagcatctctgcgcaaagaaagaggcttccccacaggctcttaatttgggacaagttttcccttagtttgggaaaaatttcaatctacctaaattagccttttacattagaaatcgagaaatatgcacaaaaa

SEQ ID NO: 144856 - DNA, 747 bp, Homo sapiens
gaaacctcttttccctttctaagaacgtgggcaccgcaaatcaaactatttactgttgattgggatggaaagacactgctgtcttagtcattcatctttgacttgtgaatgaaatgattttactgttagtttttgtgttactaaagcagaaacctagagtgctgcttataggcaaggaaacttacatgtttacatatgacataatttttcatgggtttgaatttctgaatagcatattatttagttagcatattatttaaacattatttttagccacttcctccataaatcagtgttctaaaactcaatcctgataatccttattaaagtaataatttataactaaaattttaaaatcacttatttgttcatttgaaccaatcacactttgctaagttgcaaacaaatgtggatggcagggattccatgagcaaaggtcatttttttttagtagtaaaatttattactttatcttaaagccatttattaaaattaagcaaaaataaagaggaatctttaaaaagatgtttcaggccaggcgcggtggctcatgcctataatcccagcactttgggaggccaaggagggcggatcacctgaggtcaggagttcaagaccagcctggccaacatggtgaaagcctgtctctactaaaaatataaaaattagccgagcatggtggcgggcacctgtaatcccagctactcaggaggctgaggcaggagaatcgcttgaaccccggaggca

SEQ ID NO: 144857 - DNA, 384 bp, Homo sapiens
gttgttttttaatatttacttatgccaaacattgtgcttagcattgtgattatagttacaagcaagaggaacaaggatcctgccctaagggagcttatactttaaggcagatacaatcaccagcttttaagtatgtgcagactatttaacagagacttatatgcaaacgtgtttcaattgcagtatctgggtcagaggaaatgtatcttatgaccacaattataaagtataaatatttgtgttccacatgaacaaataatctggaacctaaacatcatttgcatgttgacccaccaatcatttaatgagatttgttatcagtgctagctttattttaacctgcatgtttttgttgggtggtggtggtggttgtttccatagaca

SEQ ID NO: 144858 - DNA, 264 bp, Homo sapiens
cccatgtgcctctaagacagccctttgctcctactgtggctccccttgctcctaaattacttgtcttgctgactattctattctgtccttgaaccccagagaactatacttggttttgtgtctttgtgtgtgtgtgtgtgtgttcccagcatcttgcaaaatgcctggctcacagtgaatgtttttcaaaataactgaatgggacccatgaccaggtcctcttgactcaatatcccagtggtcctgttcatgcccagggccacc

SEQ ID NO: 144859 - DNA, 300 bp, Homo sapiens
aatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaat

SEQ ID NO: 144860 - DNA, 319 bp, Homo sapiens
gctatgcatagctatgcctttagtgagctgcatttcagtatctgggttttggcttctaccaacaattagagggagaaatggccatctggcttcagctgaaattgccattccttgtttcttagagtatttcatggaggggactatgccataaattcctcttcgagctcagcagtagaaaatggatggtccctcctgacgaatccatctgcttccacatttcaatttcatttatgaaattgagaattcataacctatcctgtttcctttttagctttggtttcctaaagcttgaagccaaaattagtgcttcattacaata

SEQ ID NO: 144861 - DNA, 274 bp, Homo sapiens
ccctccccgtgtgtgtgtgtgtgtgtggtgtgtgtgtgtgtcttgagcattgagagtaatttttaaatttattttggccccatggctgcagaatccctgctcgtgtgtgtgtgtgtgtgtgtgtgtgtgtgtgtgtgcgcgcttagccacattatgtgcttagctctgcagccaccttggcagcgctgtttctcttcgactcagttccatctcttgacttctcaggtccctcgggctctccccactccctcctatcacagggtctttcttctac

SEQ ID NO: 144862 - DNA, 475 bp, Homo sapiens
taagaaaacctataaaaaaatcaatcttaattacataaaactttaccaacaaggctttccatagcttttgtgtcattaagttcaggacccgggagaaggtaggagaggggaagaaaatgggctccagacaatgaaaagttgcatggggcatatgagttcaatggcatgttaagtgagagaaactagattgccttggtgcattgatagtttggttctagagggagagaatcactcagaaacaagttcccttgagaaggggaagagagccacagccataagaagaaggattggccttcaaaggagaaggagcgttttctccattctgccaggagggaatgagtgtgcaagagtgtctgggggcgtcagtgcagggaatccaagcaccagctccttgctctccttctgtgagacctctcaggccttgaattctccatttgcttacttattttatcttgagtttcaactaaaaaataaa

SEQ ID NO: 144863 - DNA, 863 bp, Homo sapiens
gcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagggggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacgggtaagtcatatgatactggtcatttattttttaaatattctagccaaaagtacatggtagacaaagtgagaatgtcagaatgttgataattagtgaaactagacgaagatacatgaaagtttaattttgattctcacctactttcatgtgcattaggaaactttcataataagttaaagtaacaaaataggccagactcggctgctcatgcctgcaatcccagcactttgggcggctaaggcaggcggattacttgaggtcacgagtttgaaaccagcctggccaacgtggtgaaaccccatctcccctagaaaataaaacaaaaaaaaa

SEQ ID NO: 144864 - DNA, 207 bp, Homo sapiens
tgggcccagaaacagggtggtcttatggaagggagcataggatgtgggtcctgaagagaaggtgttcactcctggccccatcgctagttgcatcacttcatcttgcctggatttcatctgtaaaatgggataatgcctactccacaaagttgatgtgctttgaaatctttaatacaaacatttgttattggaaactaaatacaaacg

SEQ ID NO: 144865 - DNA, 306 bp, Homo sapiens
atagatagactggggggtcgtttttaagtatagaaagactttaaaaaatccgtttagtacaattttgttgtgagaatgtgctccttatttagattgctggatatccaatctttcactatacctgttttttctgagagtggtgctagaaagcagatagcaaaacgagacttcttgaccagcaaggcatgagaacagaacttttttctgtattacaaactgatctactggtgggaactgagcccatcagcacattagcttcagttgtaaccaagaagcatatttaaaagtaacatctgatgacatttt

SEQ ID NO: 144866 - DNA, 201 bp, Homo sapiens
ccagctcctccttgggactggcactgacccaggcggggcagatacagctgctggtccttcagaccaaccgtgctgtgctcaggcctcagaccctggcccgtgccttctgtgctgaaggcccctgtgaacagtgtttgctcttcaaggttcattctcagcctgaaaacttcttccttctggcatgtttacagtttatgaagt

SEQ ID NO: 144867 - DNA, 273 bp, Homo sapiens
ctgcaaagatggagtttccacatgtaatgtcaggacagcacccgccacacactgcgcagtctgcagggctgtggtgatggtgactgtgggggtgacgggaggcagagagctcagggacagctcaggataggcgggaacacaagcacatgtgaaaagcaaggcgatcgccaactctgaggaaaacaaatgggcaccacccggggaggccgggcagctctgccccaaacatcattcgtgccgggatgatatggacagggcagcgtgtggaagaca

SEQ ID NO: 144868 - DNA, 685 bp, Homo sapiens
aatcaggcagggcaaagtggctcatgtctgtaatctcagcactttgggaggctgaggcaggaggatcacttgagcccagaagttgaagaccaggctgggcaacatagtgaaaccccatctcaaaaagaaaaaaaatttaaaaatttaaaatataatagtaaccaaaaaggtgaaatacatagatgtaagaaataatatctatgtgaagaaaattttaatgctttaaggtttgcaaaaagttataagtaaataggaagataccaagttcttgtaaagttaagattcaattttgaaaagatgatcagtatttaaaattaagatagacttgtcatgtcctgtctgtcattccctctggacagctagttaatgacctcctgctgtacggggccttgataccttctatgattgcacttatctccctatagtctaattaatttgcacgtcttatctcccctgacataggtaccggacatacatatgctctttaattttcactctttccatctaaataccactaaaaattcaaagttaataccgttctgaaccttaaatatttatttattgagacagagcttcgcacttgtcacccaggctggagtgcagtggtgcaatctcggctcactgcaacctccgcctcctgggttcaagtgattctcctgcctcagccttcagagtaggtgggaca

SEQ ID NO: 144869 - DNA, 447 bp, Homo sapiens
aacacacccaccccctccaaatttccacctgctcactttttgaaaccacaagacaccacagagagtgaaataaaaatcactcatcatttatatggagaccagcatgtcaagtacaattcccactggaataaactctccagttatattaggaagacaatatcctaggatgtgacaaaatggaaaagatgagaaggggaaaggcagaaatgctacatctaacaacatggctggcttagctggatcccagccaactggccccatcgatcagatattcacagagcagcaaggaaaaagatgggaagaggcaagcgtgccagccttacacttggatgctacttgggattcaggcaacagctgcacaccaggtaatgctcccgcgagcagtcagctggggaagcgtcgtgcctcatcctcactaagagctccggctgcagaccagtccatgct

SEQ ID NO: 144870 - DNA, 274 bp, Homo sapiens
caggtttttccactttggggcctttgtagatgtggatgctccgcatgcttctcctccgctgcagaaggctgtggtcttctgttcatttcgtcaggaaatactctgggaactctccagggccacggcagctgggggcccttccagcctccaaacttaggggttccctgggaccccagaatccctatgagccccaggatctcccaacctgacagccacccccaggcaccgcgctctttctcctcccaagatgcctctcctctgcgtctcaccccca

SEQ ID NO: 144871 - DNA, 403 bp, Homo sapiens
ggaaggatatgggagcccagatcacacagggcctgaaagggcaaacacgagaaggagcttcacttttactttagagtgaaagagccactgcagagttttgtgtaaaggggtgattagatctaacttacattacaaaagcatcactcagccaggcgcagtggctcgcctataatcccagcactatgggaggctgaggcaggaggatcatgtgagcccaggagatctaggctgtagtgagccatgattgcaccactgctctctggcctgggcaacagaatgagaccctgtctcgtaaaaaaaaaaaaataaatgagtgaatgaatgcatcactctggctgctgaattgagaacagatcgcaggaagccgagggccgaggcagacaactatatgggaagatcaaac

SEQ ID NO: 144872 - DNA, 575 bp, Homo sapiens
catctttaaaatttagtgtttagatttacataatacaacattcaatttttacattcaaaaacaatatcaatttcaataagcttagttttaaaagtaaaaggtttttttgcctcatattaaaagaatgttttgagatttatattaaattttgtaatacatggaaaactacaaattaaagttttgatattcaatctgcatattcaaaatgcaaagtatcaaaaccagccttttaactcaaaaagcccttaaaattgtaaatagtgtaggagcttatatctgtgttccataaaaatagcatgcttattttctaggcatttaaggacttcatttgcgtatctgttatggttaaagaaattggtattctgtcacagaattacatacacttgataaaacctttaattttgcccataacaatttaaatactaacaattaccatgactgaattttcagtaagtttcccatgattactgaaaataatcacataaagagtatttacctatgaggggtttgtttagccttaatttaatttgaatatgccaaccaacatataaagaaaaaatattttaatttacaga

SEQ ID NO: 144873 - DNA, 612 bp, Homo sapiens
gaaggaaggaggagagagaagagaaagagcaagacaaaaacagagactccaagaaggagagagaaatgcaggccacgagaggggaaaaagggaggcagggagatggaatctgacgtaaaaggagacaggtctggctccacacttccaggctgggggtgggaacctgcaccacatagttccttcaggcatgatgggggatgagctgaggggatggtgctgttgcgtgaaggacagaatgtgccgcccttgacagaagcacagggacagctgggccctgtggccaacgctcgggaccaggccccactgctctcccactggcgaggaacagaatgacccagtcctgagagggctacggagcaggcctccatcttcagtgtcctccgggagcccagactcgagttaccgcccccatgatgggatgtctgagactaaatgggcagcgtacctgagcctctggcccagctcccttccgaacctcttgggaccagaagggggcacttgaagtggcttctctggaaccccactggccacagctgtggccactggccccctgtcagagaggaggggctaggggtacccattcctggatgtttctggctaggtgtgttcact

SEQ ID NO: 144874 - DNA, 253 bp, Homo sapiens
ccactgacaacagctagaattgtaagaaaatggccaccaatggaaagagcagtagaatagtaagggattttttgttttttggtaaaattccaaggaaaatacaagcaaagcactgcgagcgtaataatttgccgttgcatggactaaggggtaaggaaggatgaactggtgtattaaaggaaatccagtttcgttcccacctatgaagattactcaggtttatggagagttgttttgctttgggctgttgcgg

SEQ ID NO: 144875 - DNA, 874 bp, Homo sapiens
acactaagccttgaagcccaggacatcaaagaaagcctgcaggtaaccagattactgaccaacgcctgtgaccgttttgaaatttataagacgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccaggcatggtggcgggcacctgtagtc

SEQ ID NO: 144876 - DNA, 268 bp, Homo sapiens
tcacatctatccagcatcaatagagtatctgccagggttttgagagttaagctggtcggtccttagtggatgtttaaagtgttcagtgtcaccttctttgttcccagacaacttccccatttctgtgtcttgctgtaaaagaccataatgccttttcttccctccatggactggagctgcctttatctcctggagctgggaagttcagatcatttgtagaggggcccctggtttccccataagacagaatgttattctttaatctgaa

SEQ ID NO: 144877 - DNA, 190 bp, Homo sapiens
ttagaaagtagcctttattctctgtccctctagagtgatgtttttaaaggagaagagtataatgtttgaagccttgcctccagtgaaaactgcccagtagtttgatgtaataaagatgttcaggcaaagttagcctacctgttgaaaataacatataattggaaaaaatactcagtggtgagagggttct

SEQ ID NO: 144878 - DNA, 199 bp, Homo sapiens
aagcctgggcaacaagagtgaaactccatctcaaaaaaagaaaaaaaaaggaaagaaatattgctgtgaggggactagcacaatgatgccttgggccaaggctttggttgggtgagctgggacccgggtggtggaggttgcagcgagccgagattacaccactgcactccagccttgccaaagaacaagactccatctc

SEQ ID NO: 144879 - DNA, 691 bp, Homo sapiens
tgactagcctagggaataaatgccaaattttacaaacatttcttccacttttgtgcttttctaaaaacaaacaaaaaatccacaactaaataaacaaaattaaaactccacctgcttgattattttatgtacttcacacacctctctccaaagcaaaagggaaagctaactgaaatccgaatcattaaatctgggtttttcattaacatttcccccaactattctagaagcaaaggatacgtaatagataaacaagaagaaaaatgcatttaaaaccttaagggggcccagcactccatccaagcttatctatgcagcctgctcacaggctcctgtatacaggcgcactgtcatgaaattagcacttctacccagctgaagcctagcacccaagccccaagaactttctaccagaaagctttgtgagcaagccctgaggatcacaaagggttacccaacattttttctaaatgtatcttgtagctatagtgttctgacttgagagctgacagtatatgctgcccactagatttttagaagaatttatcaagaaaagctcagctgggcgcggtggctcacgcctgtaatcccagcactttgggaggctgaggcgggcggatcacgaggtcaggagatcaagaccatcctggctaacatgatgaaaccccgtctctactaaaaaatacaaaaa

SEQ ID NO: 144880 - DNA, 549 bp, Homo sapiens
caacagagagagactccgtctcaaaaaaaaaaaaagggagaggtatatggaattgtttatactgaccaaaggtttacacaatttaaagcttttgcgcttctggcttgaatgtgttttcccttcaggtggtattggctttgtagacccagcactccatccaagcttatctatgcagcctgctcacaggctcctgtatacaggcgcactgtcatgaaattagcacttctacccagctgaagcctagcacccaagccccaagaactttctaccagaaagctttgtgagcaagccctgaggatcacaaagggttacccaacattttttctaaatgtatcttgtagctatagtgttctgacttgagagctgacagtatatgctgcccactagatttttagaagaatttatcaagaaaagctcagctgggcgcggtggctcacgcctgtaatcccagcactttgggaggctgaggcgggcggatcacgaggtcaggagatcaagaccatcctggctaacatgatgaaaccccgtctctactaaaaaatacaaaaa

SEQ ID NO: 144881 - DNA, 320 bp, Homo sapiens
tgactagcctagggaataaatgccaaattttacaaacatttcttccacttttgtgcttttctaaaaacaaacaaaaaatccacaactaaataaacaaaattaaaactccacctgcttgattattttatgtacttcacacacctctctccaaagcaaaagggaaagctaactgaaatccgaatcattaaatctgggtttttcattaacatttcccccaactattctagaagcaaaggatacgtaatagataaacaagaagaaaaatgcatttaaaaccttaagggggccgagtgcagtggctcacgcctgttaccccagta

SEQ ID NO: 144882 - DNA, 439 bp, Homo sapiens
agggactgatattctttcttcattttggctacaagtggcccagagagggctctggtggcccagtgagggcacatgcagcctcctggacccaaagaacacagcgacacccgtgatgacctgggaagggaagggcctgggcagggaaggtcacctgaggtccctgggacccctgtccagcatccccttttctatctcctgctttatgatgtctgtgcctgggggagggttatttgtggatgagtgtggattcctggaagctcttggccacactctaacctgggaggtgggactcaagcctgtccctcatggccctgaggaaggggtagagcttttagcagacacaggcaaggcaatgaaaacataactgaatgaatagtcgcacactcatttacaactttcttgaagattttggataaaatttctattatttcttgcttaa

SEQ ID NO: 144883 - DNA, 177 bp, Homo sapiens
tgactaatgagagtggggagaggatataggtaagggggcccaggaaaaaaaaataatgatggctttatattaaaagttcatgaaaagcagaaaatgatgagaaattttttttaaacttgtttttcagagttgttattttgaaagttctgtcctttctaaggacatgagctctgatcc

SEQ ID NO: 144884 - DNA, 537 bp, Homo sapiens
ggaataaggataggatttaatattgtagctattagctttatctgtatagctgcatagcctgtgctgtaggaggttccagaacttactggactggtctctaatggtgaccatttggattattttgagccttatgctgtaacgatgccacagcaaatatctgtacccatttcatgcaagtttaagtttacctgataaactctatttaggtattgccaaatgacctgccatatggggatgcagcactttaaagccctaccagcaaagtcagagagccctgcccatagaaggtgttaccaaactaatttttaaaattgattttataagtgaaaaatggcttttagcattatttttaaattcttgtttttctttgttttttaatctctgcttcccacaggtgataagcattgttttaatatctggatttaattcctttgaatgagggtaggatcttcctatatgttgaagagtgaactatttttattctttgtttttttgattttgtgagacgggtctcgctctgtcgcccaggctggagtg

SEQ ID NO: 144885 - DNA, 301 bp, Homo sapiens
gctgagcctctgggctaagaaggcattgtgaaaagtcatttttcattgtttctactaatgagaacacagacatccatataaagaaagcaaatctctctctgatatgccttgagttcaaagttttagagacagaatgttctctacattcttggatgtctcataatctaataaaagctgttgaacatcatgcctctgagcagacccaaattcacttcccaagctagaaagaaaaaaattgattgatagatgtaaaacaagactgtaaaaacatatgcgccagggcatgaaacaccaggtagca

SEQ ID NO: 144886 - DNA, 613 bp, Homo sapiens
gcatagatcccccagtttacaccaatcccaggccatagttgggctaacagatgcttgtttgatgaatgactatatgaaggcaactacggccagtctgctgcttctactgtacagatggggaaactgagaccaggcctgggactgtttccctgaatgcttgccacagcttgtggggatatgcgcctgaagacccagtgcctccttccctcggctggggcagtgggcctggctgaggttccaggactgcggcccctcttccctctgcccaaacccccgggcccagggcctccaggaagcctcctctgcctgttgttcaccccaagctgtgtggttgcaacttgagctgtttccaggccttcctcccatgactctgttgaagtcattctcggtccttggcctttgagatcatcaaccctggactgggatcccggccagccccagctggtccccagggccatcactgcctgtagtcatgagacagtggttgcccgtgtcccacggaccgacacacccagccctcagtgtttcttgcatggttcaggaaggtagacagaattccttctcacccatgacctagttgggagtgccattgtccccagatgccggccccctc

SEQ ID NO: 144887 - DNA, 388 bp, Homo sapiens
ctttccatcgacaactgacccctggtgtggccggggcgctctcctcacccagtgggggccacgacagaagggcgaggctgtggtcctagaacacaagttggatgtcctttgacattacctacacctgtgtttccctgcagagtctctgtaggagacagagagagagagagatagagaacaagggtgaaatgaccccaggaggaaaactttactcccctttcctgctctggaaaggacagggcttgcatttacttcagcaacagacacacagtgaaggagctcagcgcagggtctgatcccatgggctgcaggagacagaaaacgtgaatagaagcaagcaaggagaaagaaaaggatgagggaagccttcgggaattcccaccaactg

SEQ ID NO: 144888 - DNA, 130 bp, Homo sapiens
agagtaaatcttaaaaatagtaagaggaaaaaaacacattaaatataaaggaagaaaaataccaatgacactgaatttctcatcaaaaacaataaacgtgagaagaaccacatttctaaaatactcaaat

SEQ ID NO: 144889 - DNA, 360 bp, Homo sapiens
tttttttacctttctcatctataaagtgaggatgctaggctttgtctctaagactcttccagttataacattctatgactttagatgcgttgaatgctttatatcaaataaaatttttgtagaatccacagtcatatacatcatccccctaactccttctctcctttgactttgtttcaaatgacctgagagtggattgcagagtagtatacatgcattttattttcttcttttttatgtgtgaactcacctcagtggatcgcttacatactttgggctttgcttgtttctgtgtctgattctggtcctgagaggcacccattcttgcctacagtgatgactgagagcagctatctgggg

SEQ ID NO: 144890 - DNA, 264 bp, Homo sapiens
actaaagggtaacattcattcattcatagttcgataaatactggctgtccatcctgtccatgccaggtgactttctcagcatctcacacataggaacatgtgtggccccttataaccaccctatggggtggcaatcaccacccccaccctacagatgaggaaattgaggcacagaagtgcagtaccttgtgcagagtcccacagccagcaatgacagtgcagggggttaggacccaggccacctggctggggtccctgctctca

SEQ ID NO: 144891 - DNA, 424 bp, Homo sapiens
gctagggttacaggcgtgagccactgtgcccgagccacttttccttttaacataaaaacattgatatcctagagagggcactgtattttgggtacatacaggttcagatcacggaagagttgtattctatactttttttcatcattcttagttcagtatgatgtattttataatttcatatgagaaactgtaacaatgggcatgtgtcatccagcaatacctactcataaatcatattaaattttgatccaaacatgggagaaactgaagttttctctgtgtacttggatgctttcagaggcataaaattatattaccatgtgaaagcaagcctacaaaattcctcaggtggtccactctgccactcaaatgagagccagacttacagtgcacactctacaaacggacttccagctcgtcaggg

SEQ ID NO: 144892 - DNA, 185 bp, Homo sapiens
gtcatccttgtcactcataatatgtacatactatcaggaggagtgctgttatcatggtaaaattagcactggaataggaggtcacaaaatgctggctaattagctatgtgactttgagaaatcgtttaactttttttttttttttttttttgagaccctgtctcaaacaaaacaaaacaaaaaca

SEQ ID NO: 144893 - DNA, 669 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctggtgagtgattttatttaaaatcgggtggtctgagaacctttgaggagttgggagagaaatgtgaccactactggggccagctctgcttctcttccatagagtgaggatcatcattttactcgaatcacttcagcctaacaagcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttca

SEQ ID NO: 144894 - DNA, 527 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttca

SEQ ID NO: 144895 - DNA, 755 bp, Homo sapiens
ggaagtccaagattagggcactgaccgatttggcgtctggtgagggctgtcttcatggtttctagctggctggtcttctcactgtaccctcacaggatagaatgagagcgagctggccctctggcttcttattataagggcactaatcccatttatgagggctccaccctcataacctaatcacctcccaaagtccctaccttcaaatgccatcacgctggaattaggattccaacatatgaattttggagagacacaaacattcaattaattgcatcatccacagtcctaatccagtgttttgttaaccccctcatgcttaaccttctgctggccagcagcctccacagccagctgggtggcttattaagtatgtctattttagaaatattgctacttcaaagcttcgtctccatccctactgacattatttctgctcaagctctcactatctctccttagactagtgctgctagcagtcttgttacaagtcttcctgaatcttaattcttccatgaccatagtttagctttcccaattcatctctctccctcctttccctcactccccctcactttctgtctctcccttcctctctctccccttctctcttttgctctttctctctccctccctctcccaccttttcttcctctttttccacctcctcctgccctccacttgaaaatctctgttgcttctccataatagaataaagtctaaacacttcatacagggtacaggtacgtaagggc

SEQ ID NO: 144896 - DNA, 603 bp, Homo sapiens
cttattttcctgtgtgtttgggatgaacttgacaattttttgcaaaacaattcgctaggattttgagtctttaggttgtattgggaaatatggacatcttagcatattaagtttttagatccatgaacatgagatgtctttccattttttttaggtgttctctaatttcttttaacaatgtttgtaatctctattgtacaagttttgtatgtctgttgttaaatttattttttttgatgctattatgaatggttttcttaattccattttttggattgttcattgctaatgtgtggaaatacaaatgatttttatatattgatcttgtatcctgcaaccttgctgaacttaatagttttaatagttttgttttttaagtggattccttaggattttctatatgtaagatcatgttacctgcaaatagagactgttttgcatttagcttcctgatcttgaatgccttttctttctttttcttgcctaattattctagctagatcctctagtacaatgtcgaatgcaagtggtgagagtaaatatccttgtctttttcctgatcttaggaggaaatatccagtggttcaccattatcatgttaat

SEQ ID NO: 144897 - DNA, 427 bp, Homo sapiens
actagttcctcatagaaactaaacaggagagaacatctagagatcatcaggtcaagttacctctcatgaattgagtgttactgaactcacctactcatgatgtcagggaccaactgcattccatcttcaagtggctggatagatctcaaagatatgggaaagtagcatattgcttgcattctcagaatgcctgcttctgccatattataattctttccttaaaacacacctacgtcttcaagcagagttccctctcaccaaatgactcatgaagaaacaattacagcctggcttacaatagctggccccagctattgtaagtgagctactataggattataactccattcagaggtggccctagcaggcagaacttcaatcactgtctatgttatcagtagaaagatggtctcaggtaagaagttat

SEQ ID NO: 144898 - DNA, 449 bp, Homo sapiens
gggttattgtttctccgaacagccactcagaagagattctttgagttgatgcaaaaatctcaaaacttactgtgtgactttgtggtagaaaagaaaaaatgcaatttggatccagattacaaacttgattgtgaaaaacaaaaacaaaaacagatagtccttatgattttggaatgatacagttaagggtggtgtaggagatcaaataaattatcctttaacatccagactataagattttgacttctacctacccaaagcacttgggtcagtatacgttttagtgcactgatgcatccacttgcccgtgtgaatgcattaaggacaggatatcgtattcttctaagcaaaaagattgcagcatactctacgcacagcactgggtagaaatcccactattccacttcgtagcaatgcgactttaaacatgttttcaaacctgtgtgagc

SEQ ID NO: 144899 - DNA, 351 bp, Homo sapiens
atgagtgcccattctcaggttacccacattctgcatgttgatttagtcatccaaccaatgttggttgaacactgatgagaacaagcaggcctgtgctagaaggtgcctgcagccaggagctggtgagctggtgtccttagggacaccaatggcgagggacccagtgtgtggaaatctgggggacaagcatgccagggagaagagctcacatggggaaggcccggctccacaaatcagtcaggcttgttggggcgggcaggagagcagggtagtggagtcagagggagtgatcccccgaaaggcaggaagaggacatgagagagccttggagatgaccatgaggatgtggtt

SEQ ID NO: 144900 - DNA, 483 bp, Homo sapiens
catgacattgagctaggtcttaaagaaaacgagagtattaagcagtcactgatgtatatcttaagcaccaagaatatcctggcagttagtgctaaataaatgcttacttggttgcttagaagcagctgtggacagcagctcccaccaagcagaatgaaaacggcgaatgaatcctgcaccttcaactgaggtatccagattctctcactgggactgactaggtagttggtgtaccatggagagtgaggaaaagcagggtggagccatggcacacccaggagctgcacagggcaaggggaactcccaaccccagccaggggaggcattaagtgattgtgctaccctgcccaggaaaccatgctctttccatagatctgtgcaaccgtggatctggagataccctcgtgagcccatatcaccaaggccttgagtcccaaacacagagctgtgcagactttcagtggcctcttggtttgtggccag

SEQ ID NO: 144901 - DNA, 342 bp, Homo sapiens
aggacaggagctttgagatagacttttaacagtcatgggcctaattgccttgactttagaaaaggggtcggtgacaatcgctaaactgcaggcttccaagctcacttcttgctctgcaatggtaggttaaaaagaaataggcccatttaaacccacatctcattaaatggcgccggttttcaactggccttggtttacacctggccccctggcatgagatacatgcatttaaaagcttctgactggtggttatcccaagttgggcgagtcagtagtcaggtgaaaaaggaaaaaacctgtctgtaaattgaaaaagagtgtttgtggttggtcctggaagct

SEQ ID NO: 144902 - DNA, 221 bp, Homo sapiens
acaaccgtttggtttgtattcatggaaacaagaagtcttttaaactttaaagggcatatttaaccttttgagcatttattgagtgcttgctatgtatggaacacttgtgttagatgttgaagataaaaattgttctacattgccgtctgtgccctgaaggagtttaatggattttccctattcaccacctgtctattacaacaccaaggttggaattgacc

SEQ ID NO: 144903 - DNA, 378 bp, Homo sapiens
cccaggatctcattcctggggatttactcaagagcaatgaaaaccccactcaaagatctctacaatccacaaaaagaaaaaagacatctacacaagtatttatcacaactctattcataatagtcccacactgtgagcaacccaaatgtctatggaaaaacaaacagatacctttatatcatagaatgctatttggcaatagaaaggaacaaattgtaatatatgcaacaacatgagtagatctcgaaagcattctgtgaagtgaaagaagccaaacacagaagaccacatattatatgattccatttatgtgacattttgaaaaagacaaagctatagggacagaagtcaaagtaatggttgtagaggtaggggaag

SEQ ID NO: 144904 - DNA, 299 bp, Homo sapiens
tttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaggtaggtgaaggataaggaccaatcaggagagagcatgccaaacaggaatgagagctctctagtcc

SEQ ID NO: 144905 - DNA, 618 bp, Homo sapiens
gtggtcggatcacttgaggtcaggagacctcaagtcagagaccagcctggccaacgtggtgaaattccatctctacgaaaaatacaaaaattagccgagcatggtggtgtgcctataatcccagctactcgggaggctgaggcaggagaattgattgaacctgggagacagagactgcagtgagccgagatccgcggcactgcactgggtgacagcgagacacaaaacaacacgaactccccccccaccccccagcacaactgtgaagaaatgtaggagtcatgtccatttttcagatcagaaatgaaggcattgtaatacctaactgccttgtatgatgacaaggacctgtttcccactgaggtcctccctggtttgcatttttaaagcattttaaattctcttggtgcattggcccagtggagcctcagcagtaggacatgcttttgttgaaggtgtaaggtttattgtgctgttgaaaactattgtcttcatacttaaaggttttgcctgtggctgactctcctgttctttttcaggagatagatggttcaataaatgtgggcctgagtgcagtggctcatgcctgtaatcccagcactttgggaggcagaggca

SEQ ID NO: 144906 - DNA, 860 bp, Homo sapiens
aagtacagtgtggaatcagtaactttctcacgctggtatggtatcatgttcttgctaaccttgtttgagtattcaccattgtttgctatcccatggtggcagtataactaatgatattttgcaaaaataggagagaactttcagatcatgaaatatacaggaagttgtttacatattacaaggaaggcaatattttcaccaaaacaatagcttgggcattttagagtattttagtatgcctcaggcactgacattttagccaccttctaatgaatgggcttgaagcagaactgcttctactatcaggtaatggttgaggggggatgtctattacacatgtactttgttttgtgtaaagtatgttctggaaagttacattcttttggtgagtacatgtaagtatttgagggatattcatgatttaaggaggcctgaaatgaatctttttgattagggaaagaaatattttgcagtgtaaatgattaaccatttcttccagtttacctgtttggtgagttcataccataaatgttacgatgtttggttttataaaagagtacctgtaagtttttagtttctgtgtggaagattttttcagagagaatacagatagccttcttgtattagaatttgtcatatgtggtttgaaactgttcattggagctgaggaattttgttacgtttgttttaactagatatgattaacaaaatgaccatagcaagagcatgcattgaaatgagagaagttacgtgtgtttgtgtctagtttgggtaatatgattcattcttaagaattcttcaaactttattataatttttggaaataacaagtttgtcagttgattaaaccagtgtcttgt

SEQ ID NO: 144907 - DNA, 165 bp, Homo sapiens
acagtcccgttggaggggagtgggaaccggtcacaactaggaacaatgccaccatcccttccagaagtggctccaaacctcctcctctttgcccaagccttcagcacacctccaccctcactgaaccccaacagcccctgctgggataaaactcatcaatgacag

SEQ ID NO: 144908 - DNA, 471 bp, Homo sapiens
gtcaaggttacaacatggactcgagttcacatcccagctctgttatttacaggccgtgtgggtttgggtctagaacttaactgctctgggccccagtttcctcacctgtaaagttggggataaggtatccatgtaggagcattttcaatgcattttcattagtcaatgaatcaaaggactcctcgaatccaacagaggagttaatgagttaaaataggtaaagtgcctagaagagtatttggcacatggtaaatagaaatgtgagctgtgattattatttcttagtgggagaactctggaatatattctagaagtgcaagtaatttttttaaaaaagtaaccctttctgtgtcaaccaacagtagacagtgacattgtgttgaaaacttggggaaaaatctggcattgtctcttaccgtgccgacaggccccttattcagcaaatgtgagctctccctaccccatgaccac

SEQ ID NO: 144909 - DNA, 428 bp, Homo sapiens
tagaagtaatatactgagagtaagggatgttatagccagacatttgagaaagtatagaacattatgacagctggtatggagacaagaagaaagggctgagtaaggaaatgtaacaggattactaggttgtattgacctgtgtatctgggttgttttcagcagcagaacagtccaggcgtaggcatgaccatttggtaatggtagtctgcctatgtatggttccttgcaagtcttcactgtggatgacattgagtaagacttgctcttgcaaccgaacatagactctggttaacactacaatgtcagcattgcattaagaagatagattgaacttccttccactttctctgtcactgctagacttggcagaagattttgactacagcatctttaccttgtagagaactgcacttagaagcaaagttgaa

SEQ ID NO: 144910 - DNA, 451 bp, Homo sapiens
agcactccaactacagtggcatcccccacaactccaattcacctaggtcctgtcatctatcatctctaattcttcacccccaaaatgatcgtcccattacttgccacagtctcccacctcttcctaacccttaagcctttcctctggttctctaaaggaagagctttatctcaattttattcccaaactgacttcactaaacgtgagctctcctgaggatactacttcccatctctttcaagtgaaagtattttcctgtcataccctagaccctaagagcaggacatgagtccccttcttcctcttccaacactacttcaaacaagttctcaatcctcatcccaaaactgtaactataggagcttaagacaccaccgtcctcgtcgctatattctagtgatttctgttcactccctctcattcagaggtcactctctctcatcccccatgc

SEQ ID NO: 144911 - DNA, 341 bp, Homo sapiens
ttttgcagccaattcctcctcagaggcacatcaggaaagcatcaatgttgcttagattctgatacttcatgggcaccttcctaaagttctcctatagtcataatggctccccacacaatacctgttccaaaatactccaggcatgcttctcatgctggcttcaaggtaaatggaaattaaaatagtccagcaaaagccatccctgccttcatcaacagcagcagctctaggatcacaaccaagacctttctgggccttaagagaatggcttgtcttctgtcaacatcaggcctagcaagtcactgaaggagctattcaacgagtggcacattggctgccaa

SEQ ID NO: 144912 - DNA, 349 bp, Homo sapiens
aaataggccaggaaatcataagcaaaagtacagactgtagggggtgactgtggggcagcaagaccagccaggcatctgtcaccaggtccaggtcagagctcgcggtggcttggaccagggctgtggcggtcatgtggttatgagaagggcatgtttcgggagtagagtcgatggattatatgtgctgtgctaggatgaggtggggacattgaacaggtgagtgaatgatggcagacctttcagcaatgtgacaaaggccataggaaaatgggtcagagagggcagaacctgagtgtggtttggtcatgctgaatttgagatgtgtattagacatctgagtaggactctg

SEQ ID NO: 144913 - DNA, 272 bp, Homo sapiens
acgaaatgtctgaaatgtgaatagacttttatatgcttctatcccaaaggattaaaataaaacaaaatgaagtgtactggttgaatagaatattatgtacatttttctttatcagaagattttttcatactccttttgaatcagcaattttgaatgctaaatataaattcttgactaagaaatcattccctacagtaataataaacagtttggttagtcgtccaacatgtatttattgagtgattattgagtgcttgatactattctaggaa

SEQ ID NO: 144914 - DNA, 422 bp, Homo sapiens
ctctagtgttatgtgtgtgtctcaatctttgattccaatatctgaagaatcgaaaatgtaaattaaatgaaggatgccttaggatcttcaaaatactccactgcaattcctcccacttaaattcccaggtaatgtaattctgtgctggaaggcctacctgatacctcctctgtgaatgaggacagaggctctgaagagaccaagcccagcccatcaggtccaaagcttctggtgctcctaatggaccaaaaggagtggggtgagttctcctgaagaagtcaaatgtcctctctggaaaccaggagaggactcttggtatagcaccaggatgccaggcaagactctgctctccagaactaagaaggggttggctgcagtggctcacacctgaaatcccaacactttgggaggccaaggcacac

SEQ ID NO: 144915 - DNA, 822 bp, Homo sapiens
cgtggggcacatggggcctggggagttggctggattaggaactggtgactttggccagagagttaagggtggacagggtcatggaggcagagtgaggagagagacagcggctttcctgcagttggtcaggaaggccagagagccaaggacaacgctggggccctggaagcctcctgagagagttgtccttttcaaagatcaggtcgagttgaggcctttcagtgccgatggggacccactgaagtctctggggaggtaggagagggtgcaattgggggattgggaaccaacttcaagcctccagggcacgggccggcgacaatccgacaatccagcagagaaggatcggtccagaggatgggtgtggctgtggtgggagccgagcaactgagagtacctccctttttctctctggggcctggagagggctccctggctcagagcagggcatgttctggggaggaggcctttcatggagggggctccagagccaggctcaatatggacccgagctctgccactcgctgtccagagctttcccactgtccttgaccactgcatgtgtcagcagaggagatcacggggtgggagtggggtctttctggaaaggctctggcccttgggtgctccagagcccacttcctgtctaccctctgactttcagcccttgctgacctcaaagccaaccccaaatgcattcttgatccttggtcacagtggtggcagtgtaggatacacaggttaggagcctttttgaaagcaccccctgtgcttgggctgggcatggtggctcacgcctgtaatcccaacactttgggaggc

SEQ ID NO: 144916 - DNA, 336 bp, Homo sapiens
tgctactgtttaaactttcatgtaaaaatgcagtttccttgctgcctcggtggtcttggaaagtggcccaaagttgccatcttcagaagatatggttatgattcttcctttgctgtgacagagcggagtggtggagagagtccatgcagggtggttgctccaggttaagggtctggaataatgtgggtcctgttcagctattgctaaggttccccttcacatttcccctgtgtgatgtttctggtcatagctttaatgttagtttaactagactttcgatttaattataactgttaggataaagtcagatgtcagctcacttggctgcatgctgag

SEQ ID NO: 144917 - DNA, 192 bp, Homo sapiens
taattaaactagaaatgttccaaattaactataattcaccttaatataatcaagttaccataattaagattttgctgtcctactcaggtaattgaagactttgatcttggttaaaagaacgtaagatagcctgagcacggtagctcatgcctgtaatcccaacactttgggaggactgcctgagtttaggag

SEQ ID NO: 144918 - DNA, 326 bp, Homo sapiens
gtgcaactgtcgcttcccaaaaggaacctcattgttgaacttacgaaaaatcagttggcaatatacagtgtgggaactgtactgtgatcattggctaaccaagatgggtgacagtttatgatttcaaagactcaaaggcggcttgagtcctacaatgtcctactcataaaaatggaaagcatggcagcctcaggttgttacagagtactctactccaaagtaaaagttattctctgagaaagtgcttactgccttttctgttctctagtttgcttgtttaaacatttactccacaaaattgctcaaacttacccatctttgaatat

SEQ ID NO: 144919 - DNA, 606 bp, Homo sapiens
caggcttgcagccctcctcaggtgtgcacgatctggcccaggtatcacctcaggctagctggatgaatcccaagactgggcctttgtcttctgttacaccaaagacctttagggaagtcctctaaggtacacctggaaggaagtgtagaaccttgggtgttccttctgtttacgtctggctccagggagtcccgaggcatcggagcagctgcctctcccaacccatggatactactgctgctggcatagccatttgtgctgggtcatgcctgaggctgcccagaggccctgccctggggcagctcctgatagccctcgaggcggtgtggttgagtgggaagaacacaggccttctagtcagatctgtgctttcagtctccacgcagaaactgcagggtcccggcaaggaacccaagctgcctgcactcagcttcctcatctctaaaataggagtcataattggctcccagaggtgtcagtgagagaatgtctgccaggcttctggtccccagcagggtttcactaaacaaatggtagctcctggccagccccgctccaggcaggatggagtaaaaagcccctaaaatgatatgacctccttgcatc

SEQ ID NO: 144920 - DNA, 385 bp, Homo sapiens
ttggatactgatctaagaacctaacatgattatcacaaagtaggtgtttaattaaatctgctgaattaaatgtagagaagaatttaacccagtgaatgttaatgaggcatcttgtgctatagagaaataaatgtaattacataaagtagggagtaattctaaggaaatacataagcaagtgcctgatagttttgagccattttgtatctttggctaacttgtcccttcatctcctgctttctggtctggcccttgtgtatggttctgcttttgaagtatgatgtaactcttagaaatcttttgctgacttccatagcatactggggaggggaagaaaataagaattaatattggaactttgtttacggtcgttggtttttttggg

SEQ ID NO: 144921 - DNA, 370 bp, Homo sapiens
gctctgaaagtcctcctatcccaggaccccatgcttccccaaaccctgaaaagatcagcctcttgcttgatttggggagactacccttgcgaagtataccaatgaattcagcttcttgctttcgatattgaatgatgccttcttctttgacacatgtgacaaaggccaggataaggttagccaaggggagcagaagcaaggcagagggtctttccagagaagcatcctgaaaaagtgacttggaggctccatgatgtaggaagcaaaggaggtgactaggcaaggagcagggaatatgacatccaaggctgctgtgagcactggccaaagagcacctactgtataccagcccttatcccagagctgtgac

SEQ ID NO: 144922 - DNA, 330 bp, Homo sapiens
tcttgcgctgtaagagttctctatatattaagggcatcctgttgttgctatatgcggtgtaaataagttctttcaacttattattgctgtacgtgtctaacttcaatccctgggagaagagacagatttgaatcctccacggcacatagctcagtctctcttctgcggcagctgcccaacatatatgccaagatgagcgaattatttttgtccgagctactttatgaaactcattctgccccactccagaaatggaagggatctgtcaaacgttcagactccccttgctcacagcagcatcaacattgtctccttgtttccttcattcat

SEQ ID NO: 144923 - DNA, 191 bp, Homo sapiens
tgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttct

SEQ ID NO: 144924 - DNA, 289 bp, Homo sapiens
aagagtagtacaaagaaagaaagaaagaaattgaataagaggggaccagtggaagtggacatctaaagggaccctcagaaggaaagaggtgtttacctaagtggcataaaggtgacatagagtaatgggctagccacagtgctgattcagggctgtctccccaccactactcacctgggctctctgtgcctgaatttccatggccggtcagcctcctctgggttgacctccagtgatctctcttgacacccccgcccacacaccaacccttccttctttctctttcttt

SEQ ID NO: 144925 - DNA, 307 bp, Homo sapiens
ttgaggagcgtggatatagttaagcccttcatcttgaggaatataatctatgtttaaaaaaccaaagctagtggctgagcacggtgctgggctacggaatatttcactgctacatggagtactcccgactgcgtggtgaggccggctctgatgtctctttggtggacctcggctttcagacgggagtactccatgtagcagtctaaaatatttcctgtctggccccttacagaaagtttgctaactcctggcatacattatatattagtgaatattcttatttgaaagcatctcattgcttctgcat

SEQ ID NO: 144926 - DNA, 144 bp, Homo sapiens
aattcagtgatcatatgacttaacagagcacctgatggcagtgggagccaagggcagtatccaaccctgtgtgcttctgttgctgttaggagaggagctggaagtcaggagaggagctggaagtcaggagggaagcacccagtg

SEQ ID NO: 144927 - DNA, 866 bp, Homo sapiens
tctccttctttcctcattttcttggctgcggccaagccttcctcagacaagggccctggccacctcccaggagggtgacacaggcctcagcaatccgcccgctgccagggtgggggacgcaggctgccacccgccccagcaaggggtggccggcttcccgggcctccctggccccgaggcccgcacccccttccgctttcccagcggcatgtagagtcctgccctttccctacatcgcgggggcagggcgggggccgggagctgggtggtctgccatgggggtggccacagcagcagcagcagtggcgtgggggcagagccggggtcccgagccagggcgggggctgcaggtgatttcctggggcgagtgtgagcagagctccccgccgctggggggctgcggttggcagggggcccagggcgtgttggcttcacaccctcctccctgggcgcctgcgtcaggaaggagctgggttggggggggctggagggggtgctgggcggagacactgggctccccagggttgcttccctgcctggcaccgagtcatgcccgcccattagccttccccagggaggaagttgcagggcgggtggtggtggggactccagctgctctcgggaagccaccccgggcccttcctgcaaaggctgtcttggggcaggggggtagggggccgggcaggctgggccgcagggtgggggcttcaccctgccctcctccctgcctccctccccatgggccccaagcagagaaggttacgccagctactgccagtggagaggagagccgggagggagagctgggaggcggtcggttctgagtcatcccagcctatgtcacttctcagaaacctccgccaccc

SEQ ID NO: 144928 - DNA, 196 bp, Homo sapiens
cccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttgg

SEQ ID NO: 144929 - DNA, 245 bp, Homo sapiens
aatgaggcccagatggaagcgggaattagactgatctgagttgatcagatgatcaattgatcatctcccaaaccaggctccatcatttaagataggattgctttggtttattcacctgcaaaaatgaggatctttcaaggactttaaaggatgttgggaggagtaagttaaggtgtgtaattatggtgggtactcccagagcggtagctgtgttgagttgtgttgattgagttgcttgagtctca

SEQ ID NO: 144930 - DNA, 403 bp, Homo sapiens
tttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtat

SEQ ID NO: 144931 - DNA, 419 bp, Homo sapiens
ttctcttttttggaagcatatatactgcctttgtattctgtattactaggatgattaggttaatgtgtgtttaaatgcctgttccatggtggacatcctgtagatgttcattatgtctgaaatattcttttgagtaaaaatggatgagagttgtgtcatcagatgttttcagattataggttggacaaggtcattggcaatgtcctttttatcacagaaacaccatgtttctacctccagcctgtgtgtgcctccttggttctttttcacttacaagctttgtaacctttctgtgcttcaggtttctcatttgtaaaatagggaataataatagtccctatctcatcagaattttgtgaagatcaaatgagttaataaatgtacagcgtttagaatagtgctcagtaaactttaggctt

SEQ ID NO: 144932 - DNA, 557 bp, Homo sapiens
accctctcccccactgtagtattttgaagcaaatctgaaatgtaccattccatctgttaccttgttcatgtttataaaacacaataacacctttttaaaacataaagccattatcagtgtacttagcacttcattttaccctctactatccagtcagcatttacattttcctagttgtctctttcctcttacccagtttgtccaaatcagtatccaaacaatctacacacgttatatttggttgatgtctcttagatctctcttaatctttttctcttgctctttattttgttccctgtattttacttgaacaagtcatttgtacggttcacgttttctacaaccaggattttgctttttccatctctggtatcctttaataagcaggtatttagacctgcagacttgttcaggtcaggttcgattttttggcaagagaacttaatgggggattactgtgtttttcacattgtatcataccaggagttagatagcatcttgcctctctttgtggaccttttatgtacaagtagcaccgtagggtaacaattgaccag

SEQ ID NO: 144933 - DNA, 295 bp, Homo sapiens
aaatccctcctttcatttgtaagatgggagaagcattgttcctgggtatgtaggggatcagaggattttaaaggcctgcctttaagccagagtgagaaagccaagggcttggcttcaggtactttcaggacttggacctggagttttcactcctcctggggacacacctgggatattcttccctttaaggagaggctaaggtggtgccgaccaaagtggttcctctctctgatctgagcagtttggaagagggtaacagacagaccaaagtgggtcaaccatagagcccaggcag

SEQ ID NO: 144934 - DNA, 842 bp, Homo sapiens
cctggctaatatggtgaaacgccagctctactaaaaatacaaaaaattagccaggcgtggtggcaggcgcctgtagtcccagctactcgggaggctaaggcaggagaatggcgtgaaaccgggaggcagaggttgcagtgagccaagatcgcaccactgcactccagtctgggcgacagagcgagactctgtctcaaaacaaaacaaaacaaaaagctaataatttatcaaatagtaagttctgtgtcaggtagtgtgctgagtgtttaaatagaagttaggaaataaaaatagtttctattctcaggaagtttatagactagtcagtaaaaaaaaatcagtaattaaaactcagtaaagtaaaatttttgtttatggttataaaagaatatcagaccaaatctctgacgagactactgtaaaaactgtttaaaatacaaaaataaatatctttgaaggcattggggactaaccaaggcagccaagtcaaatttggcaggagccaaaattatagagaaaaattcaattgagttgagcccatatttacccctgcttttttcccttagggcggtggctaactcttcacatggggtagaggccagacaaagcagtggtccagagtttgtttcagaatcactgagtagcaggactaaaatttgaattgagggattctaaggcagccaagatgttgagggtccaagatcctaggaagaagacaacctcaagagtaatgaggccgggcgcggtggctcccgcctgtaatcccagcactttgagaggccgaggcaggcggatcatgaggtcaggagatcgagaccatcctggctaacatggtgaaaccc

SEQ ID NO: 144935 - DNA, 286 bp, Homo sapiens
aaaagaaggtttgaggcacagtagggtgggcactgtagataaatgttaccatttaggctttggcttaattttatttccagatggctgagaaaagggagacactggatcagggcatgaggaacaggttccaaatgtcttcccccaaaacactgggagatgcagagttgacaataataggctggtacttacagacatgagcactgttcttagcattttacattggtcaactcatttaatccacatgcagccacacacagtaatattattatctttattttacagacga

SEQ ID NO: 144936 - DNA, 161 bp, Homo sapiens
cccaccagctaagagagaagaggacaggacagatgaggcccgagccgtctgagtccaggacgcaggcacaccgtcgtcagggctgcagaagcagcgatgtctggatctagggtccagtgatgatagaccagccagccttgtgtcaggaggcccccactcac

SEQ ID NO: 144937 - DNA, 473 bp, Homo sapiens
tagaaagctcgtctcagagtttcatatgatcaaaaccttatgaaatctcattattacagatggaaatctttttaaatcagagaaagagatgataaaatcaaattttcagagactactagaatatttcttctaagccctgacttcattatttcttcctgctacgcttttaccattaaagttattctttttattttattaaatttttgtttttgtttttgtagagacagggtttcactctgttgcccaggctggtcttgaactcctgggctcaagcaatcttctcgccttggcctcccaaagtgctgggattacagaagtataaatatctaaggatttaagcttatttatatctggtacataaaaatagcatactcattactgaaatgctctgtcaagataccagtatatgtccggttaacataatagtatctctctaaagagtccttttctttttcctcctcccaaacaccccc

SEQ ID NO: 144938 - DNA, 237 bp, Homo sapiens
cctgactctgaactcggagaataatttgtcgttgagaatttaaaggagagacactgaacaacataatgaggtcctgtgttttcaaaaagcaagttttcaaatggatgtgtttcacattttgcctgatgaaagccagggacatagcattacactcttgctctgtaaagttaattattcaaaaggccagagtgacatagtccaaagaagtaacctaaggacagtctcaaaggtggaaaa

SEQ ID NO: 144939 - DNA, 353 bp, Homo sapiens
tgccgctggcctctctccatccactgcagtcacactggccttcctgctggtctggcctcagcaccttggttcttgctgttcctcctgcccaggatgctttctctcttctttcagtgctctgcccagacttggcttccccagagccgccttctctgtccaccctcactagaacagccttcttgccatcttggactccttaccctgcttgatttaccttctgaacatttccctatgtgaataaggctataattttctttgtttacttggtgtctgcctctctactagcaaggaagctctcctcttgttctctgctctgcttagaacagcactgggcagagagccagagtccattg

SEQ ID NO: 144940 - DNA, 293 bp, Homo sapiens
cttcagctagaatatattcagacgctagtagagatatgagacaaaagtagattttctgatcagatttgaggttaatttagcaaagaaagaagtgagagcagaggagcatcaagacaaaagaagagtctgtcaggtacatatagcccaaatagccctcagattcatccatataggaacctgtaagtgaaagtcttaatcataactgcagccatgtcactcatgcagaaagatgttatagagagtattatggccaggccaggcatggtggctcacacctgtactcccagcacttt

SEQ ID NO: 144941 - DNA, 625 bp, Homo sapiens
gcctgccttggcctcccaaagtgctgggattacaggcatgagccaccttgcccagccaggggcactttttaatgtcattgataattaaaagttggagataccatgcaaactgtacacctgacaaagggttactacccagaacatatagcgaacttaaacaactcgacagcaaaaaaaacaagtaacccaattttaaaatgggcaaaataccttaatagacatttcgcaaaagaagacattcaaatggccgagttatatgaaaaaatgctcaacatcactaatcttcagggaaatgcaaatcaccacatgaggtatcacctccagttaggatgtctataatcaggctgggtgcagtggctcatgcctataatcccagcactttggcaggccgaggtgggcagatcacatgaggccgggagttcaagactagcctggccaacatggtaaaaccgtctctactaaaaatacaaaaattagctgggtgtggtagcgggttcctgtaatcccagctacttgggaggctcaggcaggagaattgcttgaacctgggaggcagaggttgcagtaagccaagatcgcaccactgcactccagcctgggtgacaaaagcaagactcttgtctta

SEQ ID NO: 144942 - DNA, 846 bp, Homo sapiens
tacggcagcggcatgagaccaccacccaactccctcggcccgccatgcccgggattaacatgggcccgggagctggcagaccctggcccaatcctaacagtgctaactcaattccatacccccaccccaatcaacctctatgctttcttcttaaaaaaaaaaacaacagggaaaacagaaaagaaaaaaaacaaaaaaaaaaaaacactgttgttgtgggcgcccccttgggcccccccgagagaagagccttctcaagaaccttgcgccggtcggggccgcgcgcgcgaggcaccccaagtaagcggtaaaaacgcaaaacccgcgtgggcccaacagcaccgtgcttcacccagaggcaacacccccgcgggtcacaccagggcacaactacgccgcgcgtgtgaggaactctcacccaccgtagaatcaaaaaaaaaacaccccccgcgcgggcgcagcacaactcacgatccggtctcctcgtggcacacacccaattctccccactatgcgagcaacttcctcgagaagcggctcctattacccggggacctctctatatcctcaaccaggggtgactccccacaggacgacgcctgctaatctaatccaacaaccaacctcgccccaagcccccgggggacccccaccgcggacacgccacgccacacaacaccgctcaatacccacccacacggtgcgccaccacaaggggagacacgcaccaacccacaagcgccccacccgcaaacaccacaacaccaccacgaccgcgccaacacgccacacacacaccgaccgaggaaccaaacaccaggctcgccgtggcccaccacacgcagc

SEQ ID NO: 144943 - DNA, 298 bp, Homo sapiens
aggcctgggatgttgctaaagaccctacaatgcacaggacagccttcataatggagaactaactggtccaaaatatcaatagtgcgaaggtgagaaatcttgctctagaggagctggttccaagatgtgaggactctggggacaacaggggttaaaagaacaatcaattcatccacctctccacttataatttttttttttttccaagacggagtttcgttcttattgcccaggctggagtgcaatggtgtgatctcggctcattgcaacctctgcctcctgggttcaagcaattctc

SEQ ID NO: 144944 - DNA, 488 bp, Homo sapiens
aggaggtggcggctgaggacgggtgatggcactggctggcctggtggcagctggcacaggaatgcatgggcttacgggagttcactgggtgggcagagggatcggccacaccagcacagtaacagctgcacaagcaagggtctgagacacgccgcgaggaaggggtgacggtgtagctgtgctcaccacaccatgaagcccctgaaagcaagtcttatttgtgaggtccacggcgattcttctgcctgctgtatttgtgcatttctatgaaagccgcgtggctcacagtgtgtctcctttccctgcatttctacgaaagcccgcgtggctcacagtgtgtctcctttccctgcatttctacaaaagcccgcatggctcagtgtgtctcctttccctgcatttctatgaaagccgtgtggctcacagtgtgtctcctttccctgcatttctacgaaagcccgcgtggctcacagtgtgtctcctttccc

SEQ ID NO: 144945 - DNA, 581 bp, Homo sapiens
tgggcccttccctgcccatgtggggtgcttcctgcccgcggctttttttgagtcccacgaggtgcatttttcagcaccatgtaaatgttgcattttgaaatggtcacggaggccactgggtagtagtaaaggtccttgttggccccgagctctgaacacctttggttcccgcctctcaatagaggggttggggtgttggagaatcaggcccacccttttcatgggcagctggcccctttctggccccagaccgcacgtcagaggccacggtcccggctctccaatgtccatgtgcaagggcgggaccctgtggctgtgttgtcgaccccacagtgtgacctgaagtcctgggctgggggctcccagcacgccgagggacaggtgtgggggcactggctgtgactgatgtccggcacagggtgtggtgcaggtcctgggactgttggctctgctgggctcaccgttgtgggcaaggttatagagctgggcgtcccgcctgggccgcgggcgacatgcgccctagatgccgtggggctcttgggtcatggccatgtagcaggagggacctgggcgggagtctt

SEQ ID NO: 144946 - DNA, 189 bp, Homo sapiens
cagactcgcacagtcatttcacagataagaaactgagaccagaaaggggaaatgatctgaggctgggactagcctctagtaaagtcaacccgataagtgacctttagtgagccctgacccaggccatgcagcgcctggtgctaagtgacacacggaccacgggatggggggtcattgtggctatgtccc

SEQ ID NO: 144947 - DNA, 152 bp, Homo sapiens
ctacaccatataaacaagaagcagcctgctccattcccttctaaagtggtagctcctgtggcactgaccacttcatacaaacaagaagtacaggtgtggcattagctacaccacacaaaggagaagcagcctgcccccttctctttcaacaa

SEQ ID NO: 144948 - DNA, 332 bp, Homo sapiens
ctgatcctaacaccactcatgctggccctattggaaattggatgtgcttgctgctgctatccagaatggattagccacagtccccactttctctcattagttcacacttaaatgtggggttgatgtgtttgttgatggagcctgaattatgtgtctgtacactagctgcaaatgaagctggtaaatatataatgggaagcaggttctgctttataaattgtggggatttctcaaaaataggaagagaaattcagatgctgggcttgaataccaaccagagagaacatataagtacagttgagagtcattggtataaggattccattcgtttg

SEQ ID NO: 144949 - DNA, 683 bp, Homo sapiens
atgcaaggccttaaggctggggatttcctaagcctgtcccacatgctcacccttggggctgcggcttccctgagagctgggctctgggaggaggccagataggcaggaaactagagcccagattctttccactgccattcctgggctggggctgcactcaggtgcaggtgttgccaggaacacaggtgagtgcattggactttcacagcctgaggccctatcctcagtggccagacagggccaggatctagttgatgctctgacctctggcagaacgggagctccacaaatgttggctgcatgagagcaattgagtgcatgtttgggggccggggaaggcagagtttctcctgggtccctctagaaagtcagtgagaagcttgtactctcagtgatcattgctgtagttacgagataagcttctctgaacatgcagagcagtggtaactatgaggaggcacagtctctcctgagcatgactctggctgttggtgtggctttgctgcagctgccgtgtgccattgatgatcctgctcctcttccttcgggaaagtaagagggagagaacagtctgagtgggggtgaaagtcagtgagctgcagtgtggggtgggaggaaggaggtgcagaggattacaggccatcttccctgattgctcctcatccagcaggaagaaggaatga

SEQ ID NO: 144950 - DNA, 467 bp, Homo sapiens
tagtgccactgcactccagcctgggtggcagagtgagactgtctttaaaaaaaaaaaaaaaaaaaaaaaagactacaattaacaaaaagttagttcaggtcagagattgctgccaaacaattcaccaaaacaacttgatttccagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtagtggactcaggattccaagccagataa

SEQ ID NO: 144951 - DNA, 453 bp, Homo sapiens
ggcacaatcatggctcactgcagccttgaactcctgggctcaagcaatcatcctgattgagcccaggagcctcccaagtagccgggactacgggcacctgccaccacacccagctaattaaaaaaatttttttgtaaagacaaggtatcactatattgcccaggctggtctgaaactcctgggctcaactgatcttcccgcctcggtctcccaaagagctgagattacaggcatgagcgaccatgcctggtggtttctaaacagcaggatgttctcatcccaatatgggtggttagcagagaactggagagagctgagtttcaagtccttactcctctacctgttagctgtgtaagcttggcccaagtgacttctcactttttctcctctgcaaaatgggactttctgcacacctcaggctgtagtgaggattaaatgcatcatatgtggaaa

SEQ ID NO: 144952 - DNA, 718 bp, Homo sapiens
ggacgcgtgggtcgacccacgcgtccgagtccccagagtagctgggataacaggcgcgcgccaccccgccctgctaatttttatatttttagtagagacgggatttcaccatgttggccatgatggtcttgatctcttgacctcatgatccgcccgcctcggcctgtaatcctgctgggatgacgagcgtaagccaccatgcccagctgggttttatttattttggtttttttcctgaccccttaactagaaataagctccacgagagcgggatcttttgtcttctgtgcactacttgtcctcggttcttagaacagaacctgagagaacctgatcgcaaatatttttggaatgaatgaatgaatgggttcaccagggcaccatgggaaactgagtccgcaacctagaagccatgaaagacagtccacttccaagcttccctgggtgacctcgcagggcatgctgggaaatgaaatttgcggtgaaaaggtcaggaccacgatcctagggcacgctgggaaatgtagcccacagggccacacccctaaaagcacagtggggtgcaaggcagggccccaaggcatttagggctcggggcaagagaaatccacactccactccctaatggtaatccctgagccacaccgagtaaaggaacccaagacacagtgtccacagggacagggctctcagagctttcactggcccgcgcttctcc

SEQ ID NO: 144953 - DNA, 273 bp, Homo sapiens
  misc_feature (20)..(20): n is a, c, g, or t
gagacagagtcttgctcttncacccaggctggagtgcagtggcacgatcttggctgcaggttcaagggttcaagtgattctcctgcctcaccctcctgagtagatgggattataggtatatgccacctcgtccggctaatttttgtattatgtatggggtaatgaaagtcttcaaagaaagggatcacgagttactgccattctctgtaattttaagtcttcagcatgtccaagaattttgtttgcacaggaattgcttatttctatgtgagt

SEQ ID NO: 144954 - DNA, 503 bp, Homo sapiens
gtctttctctggcctttactctttgaggtgacaagctggtggagaaaccatgagttctggggccgggagaacggtcacagcacggccttgacgggcaacctgggggagtcacaacagtcatgtatggtggtgtcgccagagggcatttaagaattccaggtgatcatgtaatgacctgcttagcgcagtgtctgacacggtgaacccgccactagtcaccatcgtcttcactgacagagtcttgctctgactagcacaggacttacactttctataaacgcacaaatgggggcatgcatgagccaggaaagaaaccgcgtaacatcagaataaggcattcctcgacaatgaatcaatctgtgagcagaaatttatttttcccaggttgtgacactgaattggaaatacaaagaaaacaacagatcacagaatataccacaaggatctcctaactaaatgccattaagcttttaaagtccattaacatttctaggaacaaaata

SEQ ID NO: 144955 - DNA, 421 bp, Homo sapiens
tataaatcaatccttcattataaacttcaaaacagctcttatttatcaccatcattctcagcaatatttattacagtgcttagttgactgaacaacctcctccttgctttacttgcaagtaaacatgattgtgtagtgttcatttcttccgttcacattcttaccctgttgcttttgccatccagtgcatacatgtaaaggacatgaactacctgaaggcctctctgaatggtctcctttttaaccaacttgttctccttatgaattaatcttagagggaaggagtcaggaagccgtagaatagagtagtaattgggttacccagtaagcctttccctctattagcaataacactcccaaccccagcagcgttggcttctttaggtttcaagctgactttgggaagacagagatcaatctg

SEQ ID NO: 144956 - DNA, 955 bp, Homo sapiens
ctcagtcaagaggcggggaggagaggaggaaaaagcgctgagtgagggcgggcgggcgggcgggagggagggagtggaggagccggggaggggctccttaaagaaacgcttctgtcgctcgcctgctcgcttttcgctcggcattgcggccagccagccgggcactcggggggcacgcgcggccaccgctagagctctgcccccaccccacccgccagcaggtctggggtggggacccaggtgggggctcctgcagccactgcccggtgcggaccgcacggagcgacccactcctcccagcaccgaggaagaagcaacggagccctcagcaggcgaccggcctccccgcccctgaccacccgcttcccggctgcctttgtggccgcagcttctcgccgccgagccgagggccggcgggggcgcggcgcgcacggccgagcgatgcccagctcgctgttcgcagacctggagcgcaacggcagcggcggcggcggcggcggcagcagcggagggggagagaccctggatgaccaaagagccctgcagctcgcgctcgaccagctctccctgctggggctggacagtgacgagggcgcctctctgtacgacagcgagccgcgcaagaagagcgtgaacatgaccgagtgcgtgccagtacccagttctgagcatgtcgccgagatcgtggggcggcaaggttgtaaaatcaaagcgctgcgggcgaagaccaatacttacatcaagaccccagttcgcggggaggagcctgtctttgttgtgacgggcaggaaggaggatgtggccatggctcggagggagatcatctctgctgccgagccacttctccatgatccgcggcctccgcgaataagaacccggcactcacggcgcgtgcctgggccgcccactgcccgggcagaccacatccaagtgcgggtacctaccgcgtggtggg

SEQ ID NO: 144957 - DNA, 180 bp, Homo sapiens
tttaatgattgcattattataaataagacaaaactgagaggcatcccagaatgctgtctgaagaagtgacatttcaaatgattcatgaaaggacaagtatagtaactaatattccctcatgttttcctgtgtgccaaacacttcacaagaagggaaagtacttgcaaattcctggtagcg

SEQ ID NO: 144958 - DNA, 245 bp, Homo sapiens
cttggctcggcactcccaagctgcatgctgaattcctgggacaacaggactggcttgtggttccattctccagatccttgggttggcttctgggtacactaggagatctgaaatgctctcaggccaccaggaaagtactcagatgcaagaaagcacccagacactctgagcttttggtgttataactgcaatttataccatttgactgacaccaccctcttttttatatgtccatgcccctagta

SEQ ID NO: 144959 - DNA, 664 bp, Homo sapiens
gccttgttgaaaaatccagctttaaaccttccctgtaggcctcaatagtgcatactgcattgggattataaatagtcagtctgtttctggagtgtaggttagtatgtattcccaggaggcatgaactatttacatttctaacaaatgtttcacatatgttgctgattcatatttctatgtacaaatttaggctttaatttttttaatttccttttttattagaagttttgttataaaaagtttcttaagtgtttcattctttctagcatgggtggcttaaggagattgggggggagcgtttcatttatttatatagagattttgatgttttgaaagacaatagaattaatagagaaaattgtccagatatccagcgcttggatttttgtttgagaagtttgaggaagcagatgccatttgagttggtttctatggaaaaatttatcttagagatgatgtagggctatatttatgttcacaaatgagaaattgaagctgagagaaagagaaaatgtttaatacataattactcaatatgtcttggaagaacctaggtttttattcatacctggtgtttctttataaactgcctctcttttatcttgagatggtattttcgaaattatttctctttctcattttcttctaccatttcctgacattt

SEQ ID NO: 144960 - DNA, 145 bp, Homo sapiens
gccccctctacggcgggagcttgcaggggtgcgggggtgtgactggcgctccgcggactcgtgtccacagtacagaggacatgtagggttcggccggggcgcggctgcaccggggcctgcctcgcggacctggactcgggactcc

SEQ ID NO: 144961 - DNA, 425 bp, Homo sapiens
agggagtggttggagatatcaggaatccgtctagctacaggtgagatcaggttttgttttttttgagacggagtctcgccctgtcgcccaggcaggagtgagtgcaatggcgcgatctcggcccactgcaacctcccactcccgggttcaagcgattctcctgcctcagcctcccgagtagggggttacaggcgcgccaccacgcccggctaattttttgtatttttagtagagacggggtttcaccgtgttagccaggattgtctccatctcctgacctcgtgatccgcccccgtcggcctcccaaagtgctgggattacaggcgtgagccaccgcgcccggcagagatcaggttcttaagggaagtccggagaaatggggtttttaaaaaacccgagtccaggctatctgtttggaggggttg

SEQ ID NO: 144962 - DNA, 182 bp, Homo sapiens
ctttacaccatggttgcactgatcaagtcagaatgttcttcccagtagcagtaatttactgtaatactgtattttaaatggcaggaaaagagtatagaattttcaagtggctggaaaaattcctaactgtatgttaaaaatgactcaggagagttaaaaaagaaaaatactgacaagatgag

SEQ ID NO: 144963 - DNA, 278 bp, Homo sapiens
gctgatatggaggaagagggatgaggaattattgtttaatgagtatagagtttcagatttgcaagataaaaaagttctgagccaggcgcagtggtgcatgtctgtagtcccagctaccctggaggctgaggcaggaggactgcttgagcccaggagtttaaggctgcagcgagctatcactgactgcaccactgcactccagcctgagcaacagagcaagaccccatcacacagtcaagatagagaatatccccttctgccttgggcatagcatgcta

SEQ ID NO: 144964 - DNA, 208 bp, Homo sapiens
tagaaacagggtttcaccatgttggccaggctggtcttgaactcctgacctcaagtgatccacttgcctcggcctcccgaagtgctgggattacaggcatgagccaccacacttggcctcaatgagtttgaccaatgaagtcacccatgtaaccatcaccacagtcaagatagagaatatccccttctgccttgggcatagcatgcta

SEQ ID NO: 144965 - DNA, 323 bp, Homo sapiens
ccctaaactctaaatgcaactggttttaaatctctatccaaccatacttggcaaagaactgtaaaaaattctaagagaacagaaagcaatacttttgtggctcatgtgtaactggtcttagcagacttattacctgatcagtggggatctttgtttccatagacactgcttcccgaagtctggcgacagtcccagacagaggtacggccacaccaatcctcatgcagtgagaacatttgccttgatacactacagtgacatagagaggcctgtacagatcaaagtcagatcttctcattagtcacttatttcaactaaaatat

SEQ ID NO: 144966 - DNA, 256 bp, Homo sapiens
ctgcaaatgatagaaactctgacagaacagtgactgaaattgatttctctttcacatgaaagtctggaggttgtcatcccagaactactgggctggtctcacaaagtcttctgggccccaagcactctatgttttgcttttctgccctccttagcagaaaggagcttaatatggctgcttgagttttgccgtcatttttattccaggcaacagtggataggatcacctccctttcccctctcacttccttaacaca

SEQ ID NO: 144967 - DNA, 286 bp, Homo sapiens
ctcaggtggtaacgcttgcttgccactcaccacctgctgtacgacccagctcctaacaggccacagagcagtactggtctgcagcctgagggttgagaacccctgacgtaaagcaccccctttgtgagaaaacaagctctgggcctttaattcctgcagccagctgctctgtgcacatggggtgaggggcaggagggagtcaggcaggagacctctggtccctggcacagctattctcgcaacagccattggtcaatctccccggtccctacccacaaccaccctg

SEQ ID NO: 144968 - DNA, 281 bp, Homo sapiens
cgtgcctagtacagaaagcagatctgtggggcttccttaggggtttcaggaaaaacatgttagacgcagaggtggcttaggatttaacatctgaccttgaatctgtcagatcacttgttattttgtaaacgtgagccctcaaaggaagccgtaggcctgcagtcgtgttctgcctgagatgtgtgtggaaaatggtggtgagaagagccgtgaagcgtagcccaggaaagcaccgccggtattgagtgatgcattcagcatgtgaggtcacagaccaggtc

SEQ ID NO: 144969 - DNA, 442 bp, Homo sapiens
tattggtattacaggcgtgagctacggctccacctcaacaagtatttctaattgatgataatagtttagttctaagccacttaacttatgtgttcatgtcattgactttgtaggtaaataaagctattaattttaaatatgagaaacatgtaaatagtgctagcaaaagatataaaactgatggggcaatctaattaatctctgagttagttccaatgacagaatcctattgaattgtacaaagaataaatttgagtgaaaataatttgtcgaataatacaccctatagcagaaagtagccttggtttaaaaaaatttagagatttataccaaacagggacagcataaattgataaaacccatagcatagcaaccatggtctagcaacacagttttgcataacttccaagaagactgtcaacacttgaaattatctccagag

SEQ ID NO: 144970 - DNA, 400 bp, Homo sapiens
gtgcgactccaggctgggctctggcattctcctaactctgagcattcattcaatgagagatataaagacagatgctgctccggctgccacagacagtggggcaggttgttcactgcacaagaggacccagctgcagaggtgagagggccccaggaaggggcccttctttgtaattcatccaacagctcccatacaagttagtgctggttctgaccttgccatctttctttctctctctctcctctcccttcatctgtctctgtgtctcagtctcttattttatttttgttgagacagggtcttgttctgttgtccaggctggagtgcggtggcacaatcacagatcactgcagcctcaacctccccagctcaagcgatcctcccgcctcaggctcttgag

SEQ ID NO: 144971 - DNA, 294 bp, Homo sapiens
cagaatcaactactgtactttcagagagaaaaaccctcttctggcttctcaggcaggaagtgactcagacctcccctgtttgaggcatgataattgctgtcctgctttagctctgcattgtttattcggcggatatttactgagcgcccactgtgtgctaggcgctattctttagtctgagaattatagccatgcataaatgctgcaatagccatacaagtctgactaaaattaggcacataatagacatttaaatatttcttattgcccaattgtccatattctcagcgttca

SEQ ID NO: 144972 - DNA, 611 bp, Homo sapiens
gcgggagactcggcagaacggaggtctgcaggaacccctgctgatggctcttcattagccaacagattttcctcttcaaacataaatgcagcgcaggaaaacgaagttgagaaataattgtgtattgaatggtatggtgggttcctagactctggcaggacccgaaccccagtgatgtcatgttgttccttggttgagtaagctgcgtgtcacctcctctttgaagccttccctgaccaccctccccagccactgctttgtgctcccactggaccccgtgcagccttcgcttacagaacccgtgaactgtccgcactcattggcttctatatttgaatccctggctatagagcaaacaccttgagagtggcagtgagcgtctctgtcactccccatccactgccactcctggtcgtccttgtagagaatgttgaatgaacagaagcttgggttctccagaatccttgttttgctctctaaatcccatttagcacatttagcctcgagctacttgccatttccaacaaggatgaatcaagcctttggattttctaacaaagacgtgtatggtgggaaatacaggccattgatacccaacatcagggaggaag

SEQ ID NO: 144973 - DNA, 473 bp, Homo sapiens
tcagctcgggggaagcaggaagaatccccagttggttggctattcttgggaccgaagagataatccccattgaacagagcctacactcacatccttgagtccgtgatgttcttcgcttccctgggaacagccagagtccagctttccgtgtggattgctttcacagggatatctggcccttcaagccagtggtgtgaatgtcaccccaagaaccttgacgtgtagatactgcctacttcaagtcatactgcagctctgcctcttcccaagataggatttgaagcagcttccaacagaaaatggatgtgaaaatgtattgtgaacacatgcataggaccatacatacatcatacacacacacatacacacacacttaaacatacacatgcacatgtacacacacacacacagctatgggcacaacttcatttcaacttgtagattgtgaagtaaaggcattggaactttgtggc

SEQ ID NO: 144974 - DNA, 602 bp, Homo sapiens
gactgcatcacaggagacaggtccctccacacctcattcaattcactcactcaccaggagccaggtccctccatacctgatctcaattcactcactcaccaggagccaggtccctccacacctcatctcaattaattcactcaccaggagccaagtccctccatacctgatctcaattcactgactcaccaggagccagatccctccatacctcatctcaattcactgactcaccaggagccagatcccttcaacctgcatttcctaccaaccccagcagccaaactgtatctctaaccaaccctctccccttcctcaccctcatccctcccagtaccatgcccagccaagtttttgtatttagtagagatggggtttcaccatgttagtcaagctggtctcgaactcctgaccaaaggtgacccacctgtcttagcctcccaaagtgctgagattacaggcatgcgccaccactcctggcccagaaatattatcttattcgctcttcacaaaaattctgaaaaagaagagaagccagagaaagagcgaaaggctaagtgaaaaactggaatagtgaagccttagaagtcagaggagaaagc

SEQ ID NO: 144975 - DNA, 353 bp, Homo sapiens
tctcagttcattctttccctccccaggcccctcaaagacattctagtgtcagtcagccaaaaacacaaacatcaaatgtggtttgtgatacttggcagtgacccagacacaacatgcaagtgaaattgaggctcatgtgcttgttttcttgcttcttttcttttttggggggaggaggtggggattttctttattttaaatgataatttattattattattatatatttttgtatcctctgtgattttttttcatagtagttggttatgtctatctatggatggggaagaatatttatggcttaaaggaccatattaattagagatataattctaaggggaattcaattttat

SEQ ID NO: 144976 - DNA, 331 bp, Homo sapiens
taggggcaaatggcatggtattgctgatgctattacaaagattaaatgatggctggtgtgaacacaacgtcattaatcccttactattttaagggtgccaaaactgactattaaagcagctatttggctatttggctttcaaaggctgaggctgaagctgaagctaagtagcagatttttaccaaacacataggctgaagtcaaactttagagctttcgtgttataattgaaagccagtgatttctgtgtattaattttgtattcagttgtctcattaaattctcctattttttcagtcattttctaggttttacaattatgtggtctgca

SEQ ID NO: 144977 - DNA, 335 bp, Homo sapiens
gttaatccctatgccatgttactactgtgaaatgtttgagaagcatgggttagggcatccacagcagctattatgttgaacactctatgaaaagccacaatccagggtgaaagagtagcatcagcagaggaagaaaactgggagagtgaaatgtgtggcacccacggagtttcttttattgtccatgcaggatgtgaatggacaagcagtgtaatatatgactgacagagtagatgatactcttagttttgaattccagggtaacgtttctggatttaattcatttggcaactggtgtccattgaaggttttagagcaaggatctgttaggagct

SEQ ID NO: 144978 - DNA, 438 bp, Homo sapiens
acaactgaggctggatggctcttgagaagttacacaatactagcgggcttcatgctgcatttcccccagtgtatttgttgtatagtgaatctgattaggtattatttctagaacattttggatatgtcatttgtaccacactcgttcttgtcccctgtcccaccactatggtgtctgtaatgatgcatctttttattaggttgataagatgactaaccctggaattgaaaaatcattttttaattgattgctttaccaagactaaaagcagatgtcacaaagtatatatcagcttttaactggaaaggctaataattagactgtgttgttgacttatttaatataatacagatttttaaaaataaaataaatttataatatgtcttttctaaagaaataaacaatgtactttctcgagaataaaaattaaaaatagat

SEQ ID NO: 144979 - DNA, 455 bp, Homo sapiens
aactcactatcagagagttgtttttcatgtacaactggcaaactagagaatgctcaaaatatctaagaataaattccccaggcatgttttatttggctcatacagtcttttagggtcttttcccccagatattttgaattaattgccaatatttcaaaattgagacactatacacaagcaactggacctagttctcactgaaaaatcaaaagactcagcaaacaccggccagcattcccatatggcagtaataagcagataggtagcagttggtgaattagggtaagagctctcttgttccccactgtcctttctctatccaagtcattaatttacatgcctggggtctacaggcatttaatgttgcaactactcatacagggaaacagctaagtagtaaacacagcttttaatctggagcatcaaactacattaagtcaacagcaaatatcaaa

SEQ ID NO: 144980 - DNA, 727 bp, Homo sapiens
tacagtaaactgtgatggcaccactacactccagcctggttgacaatgcagacaaaaaaagaaagaaaatatagcctgggacctaagaaagcagcagaacataacataatagttctctctctttttttgggatggagtcttgctctgtcacccaggctggagtacagtggcacaatcttggctcactgcaacctctgcctcccaggttcaagcgattcttgtgcctcaacctcctgagtagctgggattacagatgtgtgccaccgcacctggctaatttttgtattgttggtagagatgggtttcgccatgttgcctaggctggtctcgaactcctggcctcaagtgatccaccctcctcggcctccgaaagtgctgggattacaggcgtgagccactgcgcccagcccagcctgttacactttcaataaagagaactaatcacagataacagtgcttccttcaaacacacacacatacccacacacccttcatttggtaccacttctggtcttgattacatccaagtcaggaagaactttaaggatagtatatttaatgcaggaggcactatctacagatagcaccatctacctaataatcctactctgttgaatctattccccaatttgcagatctactagcctgagagagatccatagatagaatcaagaaagcatggtctggaggcagaaataagaagagctacagtcagaattgtctgagt

SEQ ID NO: 144981 - DNA, 355 bp, Homo sapiens
gggctgtttcagcgcaaagaccaattaaaagttactaatgtcctggagaacctagagaacaccctctcagctctactttcactctgtgaactctaaagaatatgctcatcattttatatgccaaagttattacagacactggataacctgccaatttgtcagcagattgtttcctaatgagcagttaatttttcttttggaaagggaacaaaatgagttaaaagtttccctcagaagatgcctttcatttttgatcacctagcccataaaactgtcatttggaaggggccacttctcagtcactgcaattcctttaaacacacaaacaaaacaaagattgggaaagatttgggct

SEQ ID NO: 144982 - DNA, 246 bp, Homo sapiens
ctccatgcaatcaatgttcctctatccaaccaacatccttctatccaaccaatattcctccatccaattaatgcctctccatccaaccagtactcctccgtcctatcaatgctcctgtatcctatcaatattcctccatccaaccaatacttccccatccaatcaatactccttcattcattcactgctcctccatccagtcaatacctttccatcctaccagtgcccctccatccaaccaatact

SEQ ID NO: 144983 - DNA, 195 bp, Homo sapiens
gtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagc

SEQ ID NO: 144984 - DNA, 486 bp, Homo sapiens
ctggataactgagtcttgacttatggaatggcataaactcttgatgcaggcatgaagaataaaattagtttttgtaaacaagagaatttgaaactgcttagagaatagaggtaaaaaggaatttccttctttgggtaagagtggatccaaaccatatattctctggctattagagtctccagaggtgtgtggtcattttttgttatggtgattcccaaagatttgcagtgttggcaagtacccaaaatttatctcagctggtcataaaccttagtgccttttgatggttttgttttatagagttacttattaaagttctatgtaaatcattactgttatccttttaagtttctgtatttaactattaccattttttattttatagtcattacatattggatattatgtagaatgtagttatgtatagagtgttttatctacttatttgttgctgcccttttctgagagttatttaatacagtttga

SEQ ID NO: 144985 - DNA, 315 bp, Homo sapiens
atatctttcaagtgccagaagttcctcaagaagccgcagaaaaagaaattcccgtggctccacccaaaaaaccagaagctccgattgtcccagtgcctgaagctcaagaagttgtcccagaaaagaaagttcctaaggctcctcccacaaaaccagaagccccacctgccacagtgcctgaagtcccacaagaaattgtgccagaaaagaaaacactggtgcttcctaaaaagccagaagttccacctgttacagtgccagaggctcccaaagaagttgtccttgaaaagaaagtgcccttggctcctcctaaaa

SEQ ID NO: 144986 - DNA, 499 bp, Homo sapiens
gttcagaggatccgccaaggtggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccaggagacagccaactgtggattctgcc

SEQ ID NO: 144987 - DNA, 528 bp, Homo sapiens
tgtccatgtatcgccgttgggaagggaaatcactccgaagacggtgatgctgggtacaggctctggagtcatcttgatttggtaaaaggcatgaagtctgagttcattccgaagattctggcttttgagaacttatataaagagaacttataaaaaatggaaaatgagaaacgatgatgtcagtgaacatttattggcctttttttctgtgccaataactctcagtgcttaacctgaagaagcccacttaatccttccagcatcctgtcctagaactttccctgctgtctggataaggaaactgaggcacagagggtcgaggaacttgctgtggtacacccagacagcctgaccccagagtgggcacttcaggtcccgctccatggccgtgtgcaccttcatggtacgtgctggggttgtgccttatgaaaacaacggacttggctacatttcgacaaggggaagttagacactttagattcacagttaactgttgatgcttaaatgacatttgaggaacctattggt

SEQ ID NO: 144988 - DNA, 291 bp, Homo sapiens
agaattaaaaatgatttcctaacacaatctcacatgctgtccatattaaaatttcaccaactgtccctcaaatgtctttttatgactgttttaatttttctggtcaggatccaatgtaggatcagaaattgcatttggtttttgtctctttactctttttttctagaaaagatttctacccttttgtaagtgacactgatttttattttttaattttattaagacagggtctcactatgttgcccaggctggtcttgaagtccttggctcaagcaatcctcccacctcggc

SEQ ID NO: 144989 - DNA, 354 bp, Homo sapiens
cccatgggccccaatcacatcttaactcctttgcccctccctacctccaacacactcgccctatttatggttacatttaccttggccttacttcagatgtgcacccaagcagccaaatgaaaatagccacagtaacttttctcaatttaaatccacagccacaaactttaagcagacggatatggtttggctctgtgtccccactcagatctcaccttgaatagtaataatccccatgtgtcaagggtaggaccaggtgggcagtttccccgattctgttctcgtgacagtgagttctcataagatattgtagttttataaggggcttcccccttcgctcagcactcattctct

SEQ ID NO: 144990 - DNA, 348 bp, Homo sapiens
gacggtgggggaggctgtgggctgggggactcggcctcaccatcccaggcgtggggagagacagccacacgcactcatggttggcagaagctgcaaactgctacggcttcaaaggaaggcaatttggcaactgcttccaaaatttaaaaaatgcacatcctctgtgatgcggtatttctacttctaagaatttatccttagaaactcagcatgcatgtgtgcagagatggagtcactgcggcagctagtcagagtggaagacgcgtagtcagatcgagccgcgtagtcagatcgagccgcgtagtcagatcgagccgcgtagtcagatcgagccgcgtagtgagatcg

SEQ ID NO: 144991 - DNA, 434 bp, Homo sapiens
gccgagaggtcatgccaccgctccagcctgggcgacagagagagaccctgtcttaaaaaaaagaaaaaagaaaaaaagggatccattgtggctggagtatagagaatctgggagcaggcagagatgagaaagtagggctgggctgcatggtctcatggccatagtaagcaattggggttttgagcaacacaggaagcagttggagggcactgagcaaggaagtgacagggatttacagtgaaaaagtttttgtgatcactgtggagtgatttggctctaggtggcgagagtaggcatacacgggtcttgtggcagccgtcccagcaatgagatgacgttggtggttagtgacatggcggtcaggagcccaggcttgggttgtatcaggaagaaaatggtctgaacacagacttcctctcagacctcaccggcta

SEQ ID NO: 144992 - DNA, 282 bp, Homo sapiens
tggggactctgtttttgagactatttattcattaattatttaggcaaactttattgcccatctgccattggttgccaagcagtaggaactcaaagacaaatgagacaaggtttctctttaaggacctaactgccagtaggtctgtaagcagaaagcccagtaatgcattaagaagtatctgcagagctggggggttggagtggggagtggcacagatgggaagaaaggtgatgccaggcagagggagccgcatgaacaatgatactgagaagcagcagggtg

SEQ ID NO: 144993 - DNA, 346 bp, Homo sapiens
acttgttccccactccaagataactaggagaaagccaccttcccacccaccctgagtctatggctgatggaatccttatcgtagctacttcctggcctctcaggacatgggcagagagaacccgggggtttacctctgtgggaccccaggggtgactggaggggactttggtggatctgtccacacagcctaaacaaagagcaccaagctgacacacggcagtggagccttgattcaccaaggatctcgggcaagctagcttattgtattaaagggagactgtgaatgtcccctacccctactcatcacacactagagctggagagatcttaacaagcagtgtcta

SEQ ID NO: 144994 - DNA, 405 bp, Homo sapiens
ctcgttcatatactcactgtatttcttgtgaaagccgtaacatctctaagcatagtttcttcaattgtacaatgtagaaaattactttgtagaattattacaaaaattcgatgagttaggctgggtgtggtggctcacatctgtaattccagcactttgggaggctgaggcgggcagatcagtttaggtcaggagttcgagaccagcctggccgatatggtgaaaccccatctctacgaaaaatacaaaaaattagccaggcatggtggcacctgtaatctcagctccttgggaggctgaggcacgagaatcgcttgaacctgggaggcggaggttgcggtgagctgagatcacaccactgcactccagcctctagtctgggtgacagagcaaggccctgtctca

SEQ ID NO: 144995 - DNA, 825 bp, Homo sapiens
accataactgctttaacaaaaatatttaaattgtcttataagcctatgttttaaggagataaaaataatctgggatgatgtaaaataagaatacagtggaactaactaatggttattaactgtgttctgggtctgacttgccttggctgtaggtttcatttcagttactgaaagatcttccttttttcattaggatctgcttcatcctttcccatagcaaacctgaattccaccagacaggcaggaagcctgaaggcaaatggattcgtaaatgtggtgccaataaataatggaaaatgtttacttttcaactttatgacaaatagattttggaaaagttctgggatttagatcagctgtcttacttttatacagcgatttttgtaatgtcctaaataaggcgagtcaggacatagagtacctccaaactgggttactctggggttcttctgatccctagagattgggggaggactaccttctagcaatgaggctttgaaacatctgcaagcaaatgtccctctggatgccagatgtgacatgtggtccagaatgtagtgcttaacaaaagaaagctcattgcagcatatttctaatagcaaaaacctggaagtgacattaatgctaatgtaggggaatggttaaattttgatacactccagaagaaatagtgtttgcagccattaacaatattaaggtagaaataaaaaagatgggtgggcgcagtgactcagacctctaatcccagcactttgggaggctgaggcgggtggatcgcttgagctcaggagttcaaaaccagcctggaaaacatggtgaaaccct

SEQ ID NO: 144996 - DNA, 375 bp, Homo sapiens
gtacaatcgagctcggtaccgacgggatatgatcaggatgtgacatactgggacaatgacacctgctagtgaccctcactcctcccaggagccgctttccacccacagtctcccttctgggagcatggggcaggtggcgaggtgctgggttcctttctcacccatgctggtcccagcaggctgaactgagcagctctgttctccagcaggcgctgcaagggctggcctgcctgctgcctctgtgcatgaagctgctgcgtccaggaaaactgagatgacctggactgctggttgtttctacctgtgaatcaccccagagcaaagctcctgctacaagccacaggacacgtggtgcatgaagccccaaatgtccca

SEQ ID NO: 144997 - DNA, 112 bp, Homo sapiens
gaaaggggaagaaaaacatgtcctaaggagaggacaacgtgagcacgtaaagagtggaaaacaaactcagattagctggtgagtggtgggagtggtgaaatctaagtaagag

SEQ ID NO: 144998 - DNA, 295 bp, Homo sapiens
ctgaaagcagcttctcccgctgtcggacccctggaatctataaagcgcaaagcctcgccctcttggagggctttttgatgtaacagttaagctttgcaatgcaacttacaaccatctcagcagggagcagacagaatgttggaaatgtctactttgtgtttgtgtcctcttttatcacttagggatgaagataattttatataaatgtaaaggtgactctaccatttcttttattttggagaaaaaatacaatgaaattataaatacagatgttggacacgaacattcctcttgc

SEQ ID NO: 144999 - DNA, 232 bp, Homo sapiens
tgtgtatgaagcaaattatatgtgctacaagctgttgtcattcattattaatatttactccttttgagtgtctataatatgaagcagatgggcaagctaatctggattatttgtatgttatacgtagggccataaagaactattagttctttggttaatcttaatttgttctaatattattctacaaagcacatgaggattgttgatattttgtaacattattttatgtgaa

SEQ ID NO: 145000 - DNA, 517 bp, Homo sapiens
ttacaccattgattaaaaatgctaatcaggagaggatcaaggctatggacctccttctaggttgttgcagaactcccactctggcaatggtattcagctggttttgaatttttctgctttaagaactatccctgggaagactagtggtctgaagtttgcttggagagtctcaagccggaaactgatttgtggtccaaatgcttaatggcatcagacacttattcctacaagagaggcatgtggtccaaggggtggcacaggtcaaatgtgatggccaagtcccgcctcagcagggcttgaatccgcacttggcaacttttatttctctctgtccattcctgtggatactttatctgtgttaatgtcctcatttaggctaaggtcaaactctgttcttctctcttctggccagaaagacttcctgttttacaggtatatgatcttatctgtgttgataccttaactgtgagtgattccctaaagcaggtccttggacaagtgcccatcctccaggaaa

SEQ ID NO: 145001 - DNA, 311 bp, Homo sapiens
ccagctagggaaacgtcaatattttgaggatctcccaccgcccatgtggggataaaaaccttatcctgttcgtctctaatgccccagcatccagcagggcagagagacgtacagagttacctgacaccttcctatccatcatcttactctcaatctgatacaaagaccaggctgaagacaaatcaacaaaatcaggccgaagctcctccgccgggtctttatttgactttggcactagcgggctcttctagcttaatctcccgccgcagcccaaatccaccgccgagccatcaagctcagagggggagcct

SEQ ID NO: 145002 - DNA, 812 bp, Homo sapiens
atcaattgtaaacatctattggtttctcccaagtcactcagaatgttttaattaggtacacctgtttttctttatatatctctttctggagtatagggttacatactgatgaacccagtgtaactcaagaacgcatctaatatcccaataaacccatcgtaatgttgaaaaatcataaataaaaccatcataagtcagggtttgtccgtggttatgggtttcatcatttctgttgtaatcattaatgccgtacacctttaaaaatggcatagtggtagggaagggataaacctagcattttaaaattcagttgttgcagggatcccacataatattttgtcatttatatgagggtggatgagggctgaaatttcatcttgggtcttggaacagattcatggaacagattcttggaacagattcattttaaagcgattggtcctcagttctgcaaattaagaaactccaatttattgattccccagggtaatgagaaaatgtattgagtgatatataacagccaccacattcacaggaaatgctgtcctggatcaaaaactgacctggtcattgaattatgatagagaactcataaaaattccatggagaaagtgatattcaagttgggtcatgaattctgagtaaaagtttaaaaacaaaggagaggatagccttacagagataacaatagcaacaaagtcacagacttgtggaaatggaagaccgcgctggaaattaggacagttcatattcaagcaaaaagggttgggttttgaacaaataccttgaagctttggatgccttggagccct

SEQ ID NO: 145003 - DNA, 364 bp, Homo sapiens
cccccccattcagccagcacatgtttggtgttggtcctagaggacaaatgccgcccatccctgtttttaaggaactgccaagttggggaggtggatgaggggttctgtaactgtgagctggcgttcttctagaaatactgctcagcctttgtagcattctctcttcctgaatcgtctcctaaatttggagcttctgtgtctttgttctacaaatagcacagacttgtggcagccctcttctatgcctgagggatataggcgtgaacaagacagataagtccttgttcttacgggacttaattttagagggggtggtagacaatgcacgtgtaagaaaatagcaaagtgagtgttaggaagactg

SEQ ID NO: 145004 - DNA, 369 bp, Homo sapiens
agctgcaccgcagccctttaacacacgaacgtgcggggcccaaccgctgctcctttccgaggggcccaccttcctccagtgcaggggcccttccggcgcgtgtgggtgtggcaggcccgcctcggctcttgccatcttacaggcatggacctgctgctcttctctgtggttcaggcccttgcgacgtgactaggaagggcttcccattccagcaagaaggtggaatccacacctggtcttctctgatacgttgatggtttttcacttctatgtttgcgatctgtctggaattattttcagataagaggtgaaacaggagcttgctctgaaggacctacgccacacctggcccccacagcctgcacccca

SEQ ID NO: 145005 - DNA, 447 bp, Homo sapiens
aaaatctcgctatgtttgccagggtggtctcaaacttctcacctaaagtaatcctcctgcctcccaaagtgctgagattacaggcatgagacaacacatttggcctgcaacttgctttttttcctgaatataatgtcttagagattgtttcatgacagtgaataaagtgttgtgggggttgttttggttggtttgtttgtttgcttgtttttgacagggtcttgctctgctgccgaggccaaaatgcagtggcgcaatctcagctcgctgcaaccttcgtctcctgggctcaaatgattctcccacctcagccccgcaagtagctgggactacaggtgcatgtcaccatgcctgactaatttttgtatttttagtggagatggggtttcacgatggtgcccaggctgaggctcttttttaatgaaaaataatacatgtctgttgtta

SEQ ID NO: 145006 - DNA, 253 bp, Homo sapiens
ccattaaaagtaggggtggtggtcacttttcctccttaccttctcattgcttcagcgttctcacctctctgaccactttcctgttacacttaacactttctgtgtttttttctgaagtccgtcatctgacagagttattgtttagtctgggaggataaattgtaactctttggaaattatatctggtaacttactttgtgctcccaccacagtgattttctttttaagcaagctcccggggtgaaaaaaccat

SEQ ID NO: 145007 - DNA, 157 bp, Homo sapiens
tccggaggccacgcatgtggtggtttgggctgtgacacctgagggatattccagcaggagagacgagctctgcctcccaccatagagaaacagcttccagatggcttgtggtgcccaagcaggacagcgtggagaggaagacccgggatggtgtccg

SEQ ID NO: 145008 - DNA, 276 bp, Homo sapiens
gtgcacacctgtgatcccagctactcgggaggctgaagcaggagaatcgcttgaacccaggaggtggaggttgcagtgagccaagattgtgccactgcattccagcctgggcaacaaagcaagactctgtctcagaaaaaaaaggaaaaaaggaaaaaaaagaacttctaatttaaatgactgtgacttgaaaatttaaatacatgtttattaaattaattgaataatagtttctttttacatgtgaaaagaaattaaattcttcttttaaaaatt

SEQ ID NO: 145009 - DNA, 125 bp, Homo sapiens
caaatattggcccctttaatctcagaagaaaatcaataaccatggatttatgagtattagattagtatctggtaacatttagagtataatttatggcatttcaaagaattgtccccaaattaata

SEQ ID NO: 145010 - DNA, 303 bp, Homo sapiens
caacaaattacccaaaatctaaccctctcagaaataagcagtgttaacatttgattaacattccagataactctctgtgtgtatatttagtggaagactgaatggatagctagaaaaatgaatggatttttttaaggaaagaattttttaaggaaagagattacatctgtaatcccagcactttgtgatgctgaggcaagtggatcacttgagcccaggaatttgaagccagcctggacaatatagtgagaccaagcctctacaaaaaaatacaaaaattaactgggcatggtggtgtgtgcc

SEQ ID NO: 145011 - DNA, 351 bp, Homo sapiens
gaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggagtgagtccttgggggaggctgagctcccagaatgtggggccgcctgtgcagaggccggaggtgggagacacacctgtgagtgccggtgagtgtggggtgagccactggggctggatcagaagatg

SEQ ID NO: 145012 - DNA, 427 bp, Homo sapiens
actcactacagtaaccgtgatcactttgttcagggatagaaactaaaagttttttagctgtcatgtctgtgtccttcaaagctgggaccggcttcatgggccctcgacttggccctgttctcatagggctgcacttggttaaatactctgctgtcattgtcttgaagttcttaatacttttttaaaaagggcccccacattttcattttgcactgggccctgcaaattacatagccagttctgctgacagcatttcatttaatcaccccaaattctctctttcttcctatcttgagtgtttgtaaaaggtggagcctggccctgaagtctttgcaagtttggtgtttttaactactttttggctttcattttttagacaaaaaaaaaaattgtttaaatgtagatgctttcaagtttcctaattttg

SEQ ID NO: 145013 - DNA, 412 bp, Homo sapiens
cctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctc

SEQ ID NO: 145014 - DNA, 291 bp, Homo sapiens
gaaatcacacctttgcttagcttcttcctcttcctttcctacttccccttctctcttctggttgtttttcgcttgggcagttttttaaacagccacctgcacacaaaacattgtctcagctctgcttctgggaagccactttcaagagtaaatgaaaacagtctattgaaagcaagagactgaaggtctgagggaaaagtcagttttatttcagcccaccaagtgccctccctgtgctgttctgggctttgatggggacagtggaggggaaggccctgcgcagccccccaa

SEQ ID NO: 145015 - DNA, 263 bp, Homo sapiens
ctgagcttcggttcccatcattataggaatcattatatctgccctgactaccccacaggtatatggtaaaaatcccgagaagacagatgtgaaagcactttctaaaccataagtgcaacactcatggtcgagctataatgatgcttattggcggctccctcacccttcccacctggaatcttctccagggaggagaaatacaggagcgaatctttcctgtagttcaacatctctgctttgcagagccctcccctctacccctt

SEQ ID NO: 145016 - DNA, 591 bp, Homo sapiens
taacattctgggctggggattcctctgtatggtgggggctgtcctatgcattaaagaatgttagcctgggcacggtggctcacacctgtaatcccggcatattgggaggccaagaagttcgagaccaacctagccaacatggcaaaaccccgtctctactaaaaatgcaaaaattagctgagtgtagtggtgcacacctgtaatcccagctactacttgggaggctgaggcataagaattgcttgaacctaggaggcagaggttgcagtgagctgagatcacaccactgcactccagcctgggtgacaaagtgagactctgtctcaaaaacaaaacaaacaaacaaaaaaacttgtttaccaccatccctgacctctactcactagatgccccagtgtgacaaccaaaaggttctccaaacattgccagatgtctcccaggtgagatgaggacaggattgtctcagttaagagctactggtttagaccttaacattccgaaaatctattaacttgattcacaactcagctcgtaggccatatttcagatactaacattgagtctacggacatgcaaccccgaacacggata

SEQ ID NO: 145017 - DNA, 318 bp, Homo sapiens
tgttcctctcaatggaagtgttccctctcctcagcttcagggtctcttcatcactcagaggcaccatcagatgtttgttgagccattctcctcatagaacgcagaggagaggccaggtgtgaaaccagaccagtctatctatagctaagaaatattcctaacggacctcgaggagcgcgagagggaggttttaaatgtaatcctgagcttttctgattttggggttccaggtctgctatacatactcttgcacgttatattgggcacagccctagtaactctgtgatttgaaatgatgatctgaagttatcgattagg

SEQ ID NO: 145018 - DNA, 271 bp, Homo sapiens
aagagggaggggaagcagagaaaggcaaaggcgagaaatccagggcgtccgagtgaaaagtcggaaaatgtttccagagcgcgccacaaacaggcgcgcgcgcgcgcttgcgggcgcatagtctctctgtctctctctcgcacacacacaaacacactcttacatgctcacactcattccacacatggagcccacgcacgcggttcctagtcgtgcagggtcgcatgcctgggcacccaaagtgaacgcagagtagagccgccctcccacc

SEQ ID NO: 145019 - DNA, 230 bp, Homo sapiens
gcgactgtcctgattctctgaaggtctcaaagcattttcatattaagttattcaagtgacccagagaacaagaaaggagttgctactgcatgatgtcagagaacactcagaggttggaagggaattgggagaactaagtaattattaataaattctaaaagtttaatactcagtattcaaaggagaaagagtggagctaacactttgtaccaagggtgctggtcttggga

SEQ ID NO: 145020 - DNA, 304 bp, Homo sapiens
gtcttacttcccgatagcttgtcaactagggattcaacagaacggagctgaagcagtgcctttaacacccacgagtgccctgaatgtaaacagttactcaatagtttacagaactggcaaggactatcctgggccatcaacgtctttcacacctagtccaagaatcccctcttcagcacccctaaagggccatgacaggaagctctatttgtaaaacatgcacttgtaaaaatcctctgtatctagaaatacctttccttccatttcacacctggcttcacacacctgtaggagaaacaaggca
